US009862959B2

(12) United States Patent
Goldman et al.

(10) Patent No.: US 9,862,959 B2
(45) Date of Patent: Jan. 9, 2018

(54) TRANSGENIC PLANTS WITH ENHANCED AGRONOMIC TRAITS

(71) Applicant: Monsanto Technology LLC, St. Louis, MO (US)

(72) Inventors: Barry S. Goldman, St. Louis, MO (US); Joshua Stein, Acton, MA (US)

(73) Assignee: Monsanto Technology LLC, St. Louis, MO (US)

( * ) Notice: Subject to any disclaimer, the term of this patent is extended or adjusted under 35 U.S.C. 154(b) by 34 days.

(21) Appl. No.: 14/121,455

(22) Filed: Sep. 8, 2014

(65) Prior Publication Data

US 2015/0089684 A1 Mar. 26, 2015

Related U.S. Application Data

(63) Continuation of application No. 11/311,940, filed on Dec. 19, 2005, now abandoned.

(60) Provisional application No. 60/638,099, filed on Dec. 21, 2004, provisional application No. 60/660,320, filed on Mar. 10, 2005.

(51) Int. Cl.
*C12N 15/82* (2006.01)
*C12Q 1/68* (2006.01)

(52) U.S. Cl.
CPC ....... *C12N 15/821* (2013.01); *C12N 15/8209* (2013.01); *C12N 15/8247* (2013.01); *C12N 15/8251* (2013.01); *C12N 15/8261* (2013.01); *C12N 15/8271* (2013.01); *C12N 15/8273* (2013.01); *C12N 15/8274* (2013.01); *C12N 15/8275* (2013.01); *C12N 15/8282* (2013.01); *C12N 15/8283* (2013.01); *C12Q 1/6895* (2013.01); *C12Q 2600/13* (2013.01)

(58) Field of Classification Search
None
See application file for complete search history.

(56) References Cited

U.S. PATENT DOCUMENTS

| | | | |
|---|---|---|---|
| 5,463,175 | A | 10/1995 | Barry et al. |
| 5,714,474 | A | 2/1998 | Van Ooijen et al. |
| 6,084,153 | A | 7/2000 | Good et al. |
| 6,111,167 | A | 8/2000 | Mahajen |
| 6,329,574 | B1 | 12/2001 | Lundquist et al. |
| 6,395,966 | B1 | 5/2002 | Mumm et al. |
| 6,479,734 | B2 | 11/2002 | Iba et al. |
| 6,501,006 | B1 | 12/2002 | Ismail |
| 6,518,483 | B1 | 2/2003 | Bruce et al. |
| 6,664,466 | B2 | 12/2003 | Bailey |
| 6,777,589 | B1 | 8/2004 | Lundquist et al. |
| 6,914,176 | B1 | 7/2005 | Nagel |
| 7,390,937 | B2 | 6/2008 | Good et al. |
| 7,446,241 | B2 | 11/2008 | Rock et al. |
| 2002/0108139 | A1 | 8/2002 | Iba et al. |
| 2002/0160378 | A1 | 10/2002 | Harper et al. |
| 2003/0044972 | A1 | 3/2003 | Ristic et al. |
| 2003/0046723 | A1 | 3/2003 | Heard et al. |
| 2003/0233670 | A1 | 12/2003 | Edgerton et al. |
| 2004/0019925 | A1 | 1/2004 | Heard et al. |
| 2004/0019927 | A1 | 1/2004 | Sherman et al. |
| 2004/0031072 | A1 | 2/2004 | La Rosa et al. |
| 2004/0034888 | A1 | 2/2004 | Liu et al. |
| 2004/0045049 | A1 | 3/2004 | Zhang et al. |
| 2004/0116682 | A1 | 6/2004 | Cheikh et al. |
| 2006/0107345 | A1* | 5/2006 | Alexandrov ......... C07K 14/415 800/278 |
| 2006/0150283 | A1* | 7/2006 | Alexandrov ......... C07K 14/415 800/288 |
| 2007/0294782 | A1 | 12/2007 | Abad et al. |
| 2008/0148432 | A1 | 6/2008 | Abad |
| 2011/0277190 | A1 | 11/2011 | Abad |
| 2014/0115737 | A1 | 4/2014 | Abad |

FOREIGN PATENT DOCUMENTS

| | | | |
|---|---|---|---|
| AR | 051856 | B1 | 8/2016 |
| CA | 2570033 | | 12/2005 |
| EP | 1033405 | A2 | 9/2000 |
| EP | 2562259 | B1 | 7/2016 |
| WO | WO-98/07842 | A1 | 2/1998 |
| WO | WO-00/09726 | A1 | 2/2000 |
| WO | WO-00/32760 | A1 | 6/2000 |
| WO | WO-00/40694 | A2 | 7/2000 |
| WO | WO-00/69883 | A1 | 11/2000 |

(Continued)

OTHER PUBLICATIONS

Shah et al. Engineering herbicide tolerance in transgenic plants. Science. 1986. 233: 478-481.*
Friedberg. Automated protein function prediction—the genomic challenge. Briefings in Bioinformatics. 2006. 7(3): 225-242.*
Hooker. The genetics and expression of resistance in plants to rusts of the genus Puccina. Annu. Rev. Phytopathol. 1967. 5:163-178.*
"U.S. Appl. No. 11/311,940, Declaration Under 37 CFR 1.132 of Daniel P. Schactman, Ph.D., executed Nov. 19, 2010", 18 pgs.
"U.S. Appl. No. 11/311,940, Examiner Interview Summary mailed Dec. 26, 2013", 4 pgs.
"U.S. Appl. No. 11/311,940, Final Office Action mailed May 7, 2014", 15 pgs.
"U.S. Appl. No. 11/311,940, Final Office Action Mailed Dec. 5, 2011", 15 pgs.

(Continued)

*Primary Examiner* — Ashley K Buran
(74) *Attorney, Agent, or Firm* — Schwegman Lundberg & Woessner, P.A.

(57) ABSTRACT

This invention provides transgenic plant cells with recombinant DNA for expression of proteins that are useful for imparting enhanced agronomic trait(s) to transgenic crop plants. This invention also provides transgenic plants and progeny seed comprising the transgenic plant cells where the plants are selected for having an enhanced trait selected from the group of traits consisting of enhanced water use efficiency, enhanced cold tolerance, increased yield, enhanced nitrogen use efficiency, enhanced seed protein and enhanced seed oil. Also disclosed are methods for manufacturing transgenic seed and plants with enhanced traits.

19 Claims, 14 Drawing Sheets

(56) References Cited

FOREIGN PATENT DOCUMENTS

| | | | |
|---|---|---|---|
| WO | WO-01/02430 | A2 | 1/2001 |
| WO | WO-01/07639 | A2 | 2/2001 |
| WO | WO-01/55433 | A2 | 8/2001 |
| WO | WO-0155433 | A2 | 8/2001 |
| WO | WO-02/15675 | A1 | 2/2002 |
| WO | WO-02/38599 | A2 | 5/2002 |
| WO | WO-02/079403 | A2 | 10/2002 |
| WO | WO-03/002751 | A2 | 1/2003 |
| WO | WO200403578 | * | 4/2004 |
| WO | WO-2004035798 | A2 | 4/2004 |
| WO | WO-2004/061080 | A2 | 7/2004 |
| WO | WO-2004/087927 | A1 | 10/2004 |
| WO | WO-2007/044043 | A2 | 4/2007 |
| WO | WO-2007/078280 | A3 | 7/2007 |

OTHER PUBLICATIONS

"U.S. Appl. No. 11/311,940, Non Final Office Action mailed Apr. 27, 2011", 23 pgs.
"U.S. Appl. No. 11/311,940, Non Final Office Action mailed Oct. 2, 2013", 21 pgs.
"U.S. Appl. No. 11/311,940, Non-Final Office Action mailed May 21, 2010", 22 pgs.
"U.S. Appl. No. 11/311,940, Preliminary Amendment filed Apr. 7, 2006", 2 pgs.
"U.S. Appl. No. 11/311,940, Response filed Feb. 23, 2010 to Restriction Requirement mailed Dec. 23, 2009", 7 pgs.
"U.S. Appl. No. 11/311,940, Response filed Apr. 2, 2014 to Non Final Office Action mailed Oct. 2, 2013", 16 pgs.
"U.S. Appl. No. 11/311,940, Response filed Jun. 5, 2012 to Final Office Action mailed Dec. 5, 2011", 17 pgs.
"U.S. Appl. No. 11/311,940, Response filed Oct. 27, 2011 to Non Final Office Action mailed Apr. 27, 2011", 18 pgs.
"U.S. Appl. No. 11/311,940, Response filed Nov. 19, 2010 to Non Final Office Action mailed May 21, 2010", 17 pgs.
"U.S. Appl. No. 11/311,940, Restriction Requirement mailed Dec. 23, 2009", 10 pgs.
"U.S. Appl. No. 11/374,300, Advisory Action mailed May 8, 2009", 3 pgs.
"U.S. Appl. No. 11/374,300, Final Office Action mailed Mar. 9, 2009", 15 pgs.
"U.S. Appl. No. 11/374,300, Non Final Office Action mailed Jun. 11, 2008", 10 pgs.
"U.S. Appl. No. 11/374,300, Notice of Allowance mailed Jun. 3, 2009", 9 pgs.
"U.S. Appl. No. 11/374,300, Response filed Feb. 19, 2008 to Restriction Requirement mailed Nov. 16, 2007", 4 pgs.
"U.S. Appl. No. 11/374,300, Response filed Apr. 16, 2009 to Final Office Action mailed Mar. 9, 2009", 7 pgs.
"U.S. Appl. No. 11/374,300, Response filed Oct. 10, 2008 to Non Final Office Action mailed Jun. 11, 2008", 11 pgs.
"U.S. Appl. No. 11/374,300, Restriction Requirement mailed Nov. 16, 2007", 10 pgs.
"Australian Application Serial No. 2005337132, First Examiner Report mailed Jun. 11, 2010", 2 Pgs.
"Australian Application Serial No. 2005337132, Response filed Dec. 3, 2010 to First Examiner Report mailed Jun. 11, 2010", 16 pgs.
"Australian Application Serial No. 2005339717, Examination Report mailed Aug. 11, 2011", 2 pgs.
"Canada BLAST(R) Results", [online]. [retrieved Jun. 5, 2012]. Retrieved from the Internet: <URL: http://www.ncbi.nlm.nih.gov/BLAST/Blast.cgi>, 5 pgs.
"Canadian Application Serial No. 2,595,171, Office Action mailed May 16, 2013", 2 pgs.
"Canadian Application Serial No. 2,595,171, Office Action mailed Jun. 6, 2012", 3 pgs.
"Canadian Application Serial No. 2,595,171, Response filed Nov. 14, 2013 to Office Action mailed May 16, 2013", 4 pgs.
"Canadian Application Serial No. 2,595,171, Response filed Dec. 5, 2012 to Office Action mailed Jun. 6, 2012", 17 pgs.
"Chinese Application Serial No. 200580048534.0, Office Action mailed Mar. 7, 2012", w/ English Translation, 17 pgs.
"Chinese Application Serial No. 200580048534.0, Office Action mailed May 21, 2010", (w/ English Translation), 14 pgs.
"Chinese Application Serial No. 200580048534.0, Office Action mailed Dec. 4, 2012", (w/ English Translation), 13 pgs.
"Chinese Application Serial No. 200580048534.0, Response filed Apr. 18, 2013 to Office Action mailed Dec. 4, 2012", (w/ English Translation of Claims), 9 pgs.
"Chinese Application Serial No. 200580048534.0, Response filed May 21, 2013 to Examiner's telephone message", (w/ English Translation of Claims), 8 pgs.
"Chinese Application Serial No. 200580048534.0, Response filed Dec. 6, 2010 to Office Action dated May 21, 2010", (w/ English Translation of Claims), 10 pgs.
"Chinese Application Serial No. 200580048534.0, Response filed Jul. 13, 2012 to Office Action mailed Mar. 7, 2012", (w/ English Translation of Claims), 15 pgs.
"European Application Serial No. 05857224.9, Office Action mailed Apr. 7, 2010", 3 pgs.
"European Application Serial No. 05857224.9, Office Action mailed Apr. 15, 2011", 6 pgs.
"European Application Serial No. 05857224.9, Office Action mailed Nov. 4, 2010", 5 pgs.
"European Application Serial No. 05857224.9, Office Action mailed Dec. 8, 2011", 5 pgs.
"European Application Serial No. 05857224.9, Response filed Feb. 4, 2010 to Communication and European Search Report mailed Dec. 1, 2009", 8 pgs.
"European Application Serial No. 05857224.9, Response filed Mar. 14, 2011 to Office Action mailed Nov. 4, 2010", 9 pgs.
"European Application Serial No. 05857224.9, Response filed Oct. 13, 2010 to Office Action mailed Feb. 7, 2010", 10 pgs.
"European Application Serial No. 05857224.9, Response filed Oct. 17, 2011 to Office Action mailed Apr. 15, 2011", 6 pgs.
"European Application Serial No. 05857224.9, Supplemental European Search Report mailed Dec. 1, 2009", 15 pgs.
"European Application Serial No. 05858591.0, Extended European Search Report mailed Mar. 12, 2012", 21 pgs.
"European Application Serial No. 05858591.0, Office Action mailed Mar. 29, 2012", 1 pg.
"European Application Serial No. 05858591.0, Office Action mailed Jun. 30, 2011", 2 pgs.
"European Application Serial No. 05858591.0, Response filed Sep. 22, 2011 to Office Action mailed Jun. 30, 2011", 10 pgs.
"European Application Serial No. 12160506.7, Extended European Search Report mailed Aug. 20, 2012", 5 pgs.
"European Application Serial No. 12160506.7, Office Action mailed Apr. 3, 2012", 1 pg.
"European Application Serial No. 12160506.7, Response filed Jun. 13, 2012 to Office Action mailed Apr. 3, 2012", 5 pgs.
"European Application Serial No. 12186097.7, Extended European Search Report mailed Jun. 4, 2013", 12 pgs.
"European Application Serial No. 12186097.7, Office Action mailed Feb. 13, 2014", 5 pgs.
"European Application Serial No. 12186097.7, Office Action mailed Oct. 11, 2012", 1 pg.
"European Application Serial No. 12186097.7, Response filed Jan. 2, 2013 to Euopean Search Report", 6 pgs.
"European Application Serial No. 12186097.7, Response filed Jan. 2, 2014 to Extended European Search Report mailed Jun. 4, 2013", 6 pgs.
"European Application Serial No. 12186097.7, Response filed Dec. 14, 2012 to Office Action mailed Oct. 11, 2012", 5 pgs.
"Indian Application Serial No. 5701/DELNP/2007, First Examiner Report mailed Feb. 19, 2013", 4 pgs.
"International Application Serial No. PCT/US2005/046031, International Preliminary Report on Patentability mailed Sep. 27, 2011", 9 pgs.

(56) References Cited

OTHER PUBLICATIONS

"International Application Serial No. PCT/US2005/046031, International Search Report and Written Opinion mailed Sep. 30, 2009", Published with WO20070440043, 8 pgs.
"International Application Serial No. PCT/US2005/047111, International Search Report mailed Sep. 9, 2008", 3 pgs.
"International Application Serial No. PCT/US2005/047111, Written Opinion mailed Sep. 9, 2008", 5 pgs.
"NP_013190—Alt1p [*Saccharomyces cerevisiae* S288c]", NCBI Database, (Dec. 9, 2009), 3 pgs.
"RecName: Full=Probable alanine aminotransferase, mitochondrial; EC=2.6.1.2; AltName: Full=Glutamate pyruvate transaminase; Short=GPT; AltName: Full=Glutamic-alanine transaminase; AltName: Fun=Glutamic-pyruvic transaminase; Flags: Precursor", retrieved from EBI accession No. UNIPROT:P52893 Database accession No. P52893, (Oct. 1, 1996), 3 pgs.
"Rice BLAST® Results", [online]. [retrieved Jun. 5, 2012]. Retrieved from the Internet: <URL: http://www.ncbi.nlm.nih.gov/BLAST/Blast.cgi>, 5 pgs.
"S.cerevisiae chromosome XII reading frame ORF YLR089C", Retrieved from EBI accession No. EMB L:Z73261, Database accession No. Z73261, (May 28, 1996), 2 pgs.
"Written Description Guidelines", Federal Register, vol. 66, No. 4, (Jan. 5, 2001), 1099-1111.
Aguan, K., et al., "Low-temperature-dependent expression of a rice gene encoding a protein with a leucine-zipper motif", Mol Gen Genet., 240(1), (Jul. 1, 1993), 1-8.
Aharoni, A., et al., "The SHINE clade of AP2 domain transcription factors activates wax biosynthesis, alters cuticle properties, and confers drought tolerance when overexpressed in *Arabidopsis*", The Plant Cell, 16(9), American Society of Plant Biologists, (Sep. 1, 2004), 2463-2480.
Bateman, A., et al., "HMM-based databases in InterPro", Briefings in Bioinformatics, 3(3), (2002), 236-245.
Bateman, A., "Pfam 3.1: 1313 multiple alignments and profile HMMs match the majority of proteins", Nucleic Acids Research, 27(1), (1999), 260-262.
Benes, V., et al., "Unnamed Protein Product [*Saccharomyces cerevisiae*]", GI:1360461, NCBI Accession Number, (May 28, 1996), 1 pg.
Bork, P., et al., "Go hunting in sequence databases but watch out for the traps", TIG, vol. 12, No. 10, (1996), 425-427.
Chapman, K. S. R., et al., "Aspartate Decarboxylation in Bundle Sheath Cells of *Zea mays* and its possible Contribution to C4 Photosynthesis", Aust. J. Plant Physiol., 8, (1981), 237-248.
Collins, N., et al., "Molecular characterization of the maize Rp1-D rust resistance haplotype and its mutants.", Plant Cell, 11(7), (Jul. 1999), 1365-76.
Di Renzo, M. A, et al., "Microsatellite markers linked to QTL for resistance to Mal de Rio Cuarto disease in *Zea mays* L", Journal of Agricultural Science,142, (Part 3), (2004), 289-295.
Doerks, Tobias, et al., "Protein Annotation: detective work for function prediction", Trends in Genetics, vol. 14, No. 6, (1998), 248-250.
Eddy, Sean R, "Profile Hidden Markov models.", Bioinformatics, 14(9), (1998), 755-763.
Emanuelsson, et al., J Mol Biol., 300, (2000), 1005-1016.
Frickey, T., et al., "Phylogenetic analysis of AAA proteins", Journal of Structural Biology, 146(1-2), (Apr. 2004), 2-10.
Furbank, R. T., "Evolution of the C4 photosynthetic mechanism: are there really three C4 acid decarboxylation types?", Journal of Experimental Botany, 62(9), (2011), 3103-3108.
Garcia-Campusano, F,, et al., "ALT1-encoded Alanine aminotransferase plays a central role in the metabolism of alanine in *Saccharomyces cerevisiae*", Can. J. Microbiol., 55, (2009), 368-374.
Ghaemmaghami, S., et al., "Global analysis of protein expression in yeast", Nature, 425, (2003), 737-741.
Good, Allen G, et al., "Can less yield more? Is reducing nutrient input into the environment compatible with maintaining crop production?", Trends in Plant Science, 9(12), (Dec. 2004), 597-605.
Good, Allen, et al., "Engineering nitrogen use efficiency with Alanine aminotransferas", Canadian Journal of Botany, 85(3), (Mar. 2007), 252-262.
Good, Allen, et al., "Purification and Characterization of an Anaerobically Induced Alanine aminotransferase from Barley Roots", Plant Physiol., 99(4), (Aug. 1992), 1520-1525.
Grandier-Vazeille, X., et al., "Yeast Mitochondrial Dehydrogenases are Associated in a Supramolecular Complex", Biochemistry, 40, (2001), 9758-9769.
Guo, H. H, et al., "Protein tolerance to random amino acid change.", Proc. Natl. Acad. Sc.i USA, 101(25), (Jun. 2004), 9205-9210.
Hatch, M. D., "C4 photosynthesis: a unique blend of modified biochemistry, anatomy and ultrastructure", Biochimica et Biophysica Acta, 895, (1987), 81-106.
Hong, Haiping, et al., "Isolation and Characterization of a delta5 FA desaturase from Pythium irregulare by heterologous expression in *Saccharomyces cerevisiae* and oilseed crops", Lipids, 37(9), (Sep. 1, 2002), 863-868.
Hu, T., et al., "Agrobacterium-mediated large-scale transformation of wheat (*Triticum aestivum* L.) using glyphosate selection", Plant Cell Rep., 21(10), (Jun. 2003), 1010-19.
Jensen, R. A, et al., "Evolutionary recruitment of biochemically specialized subdivisions of Family I within the protein superfamily of aminotransferases.", J Bacteriol., 178(8), (Apr. 1996), 2161-71.
Johnston, et al., NCBI, GenBank Sequence accession No. P52893, (Oct. 1996), 2 pgs.
Jou, Yingtzy, et al., "Tissue-specific expression and functional complementation of a yeastpotassium-uptake mutant by salt-induced ice plant gene mcSKDI", Plant Molecular Biology, 54(6), (Apr. 1, 2004), 881-893.
Keskin, O., et al., "A new, structurally nonredundant, diverse data set of protein-protein interfaces and its implications.", Protein Sci., 13(4), (Apr. 2004), 1043-55.
Kim, J. C, et al., "A novel cold-inducible zinc finger protein from soybean, SCOF-1, enhances cold tolerance in transgenic plants", The Plant Journal, 25(3), (2001), 247-259.
Kodama, H., et al., "Genetic Enhancement of Cold Tolerance by Expression of a Gene for Chloroplast [omega]-3 Fatty Acid Desaturase in Transgenic Tobacco", Plant Physiology, 105(2), (Jun. 1994), 601-605.
Lea, P. J, et al., "Nitrogen use efficiency. 2. Amino acid metabolism", Annals of Applied Biology, 151(3), (Dec. 2007), 269-275.
Liepman, et al., "Alanine aminotransferase homologs catalyze the glutarnate:glyoxylate aminotransferase reaction in peroxisomes of *Arabidopsis*", Plant Physiology, 131, (2003), 215-227.
Lin, Zenwu, et al., "A cDNA sequence encoding glutamine synthetase is preferentially expressed in nodules of Vigna aconitifolia", Plant Physiology, 107(1), (Jan. 1995); 279-280.
McAllister, Chandra H., et al., "Analysis of the Enzymatic Properties of a Broad Family of Alanine aminotransferases", PLoS ONE 8(2):e55032, (Feb. 7, 2013), 9 pgs.
Mehta, P. K., et al., "aminotransferases: demonstration of homology and division into evolutionary subgroups", Eur. J. Biochem., 214, (1993), 549-561.
Miyashita, Y, et al., "Alanine aminotransferase catalyses the breakdown of alanine after hypoxia in *Arabidopsis thaliana*.", Plant J., 49(6), (Mar. 2007), 1108-21.
Ngo, et al., "The Protein Folding Problem and Tertiary Structure Prediction", K. Merz., and S. Le Grand (eds.), (1994), 492-495.
Nishimura, A., et al., "Over-expression of tobacco knotted1-type class1 homeobox genes alters various leaf morphology", Plant Cell Physiol., 41(5), (2000), 583-590
Parsons, Thomas J, et al., "Transformation of Poplar by Agrobacterium tumefaciens", Bio/Technology, 4, (Jun. 1986), 533-536.
Portis, Jr., Archie R, "Rubisco activase—Rubisco's catalytic chaperone", Photosynthesis Research, 75(1); (Aug. 23, 2002), 11-27.
Quan, R., et al., "Improved chilling tolerance by transformation with bet A gene for the enhancement of glycinebetaine synthesis in maize", Plant Science,166(1), (2004), 141-149.

(56) References Cited

OTHER PUBLICATIONS

Reinders, J., et al., "Toward the Complete Yeast Mitochondrial Proteome: Multidimensional Separation Techniques for Mitochondrial Proteomics", Journal of Proteome Research, 5, (2006), 1543-1554.
Ricoult, C., et al., "Characterization of Alanine aminotransferase (AlaAT) multigene family and hypoxic response in young seedlings of the model legume Medicago truncatula", Journal of Experimental Botany, 57(12), (2006), 3079-3089.
Sentoku, N., et al., "Analysis of the transgenic tobacco plants expressing Panicum miliaceum aspartate aminotransferase genes"; Plant Cell Reports, 19(6), (2000), 598-603.
Smith, Temple F, et al., "The Challenges of Genome Sequence Annotation or "The Devil is in the Details"", Nature Biotechnology, 15(12), (Nov. 1997), 1222-1223.
Sonnhammer, E. L, et al., "Pfam: multiple sequence alignments and HMM-profiles of protein domains", Nucleic Acids Res., 26(1), (Jan. 1, 1998), 320-2.
Sugimoto, Megumi, et al., "A hypersensitive response-induced ATPase associated with various cellular activities (AAA) protien from tobacco plants", Plant Molecular Biology 56(6), (Dec. 1, 2004), 973-985.
Temple, S. J., et al., "Modulation of glutamine synthetase gene expression in tobacco by the introduction of an alfalfa Glutamine synthetase gene in sense and antisense orientation: molecular and biochemical analysis.", Mol Gen Genet., 236(2-3), (Jan. 1993), 315-325.
Thornton, J. M., et al., "From structure to function: Approaches and limitations.", Nat Struct Biol., 7(Suppl), (Nov. 2000), 991-994.
Umemura, I., et al., "Purification and Same Properties of Alanine aminotransferase from Candida maltosa", Biosci. Biotech. Biochem., 58(2), (1994), 283-287.
Valle, E. M. et al., "Alanine Synthesis by Bundle Sheath Cells of Maize", Plant Physiol., 95, (1991), 839-845.
Vanjildorj, Enkhchimeg, et al., "Overexpression of *Arabidopsis*ABF3 gene enhances tolerance to droughtand cold in transgenic lettuce (*Lactuca sativa*)", Plant Cell, Tissue and Organ Culture, 83(1), (Oct. 1, 2005), 41-50.
Vedavathi, M., et al., "A Novel Low Molecular Weight Alanine aminotransferase from Fasted Rat Liver", Biochemistry, vol. 71, Suppl. 1, (2006), S105-S112.
Wells, J. A., "Additivity of Mutational Effects in Proteins", Biochemistry 29(37), (1990), 8509-8517.
Welsch, R., et al., "Transcription factor RAP2.2 and its interacting partner SINAT2: stable elements in the carotenogenesis of *Arabidopsis* leaves", Plant Physiol. 145(3), Epub Sep. 14, 2007, (Nov. 2007), 1073-85.
Wong, H.-K., et al., "Correlation of ASN2 Gene Expression with Ammonium Metabolism in *Arabidopsis*", Plant Physiology, vol. 134, (Jan. 2004), 332-338.
Xie, Q., et al., "SINAT5 promotes ubiquitin-related degradation of NAC1 to attenuate auxin signals", Nature, 419(6903), (Sep. 12, 2002), 167-70.
Yang, Daichang, et al., "Expression of the REB transcriptional activator in rice grains improves the yield of recombinant proteins whose genes are controlled by a Reb-responsive promoter.", Proc Natl Acad Sci U S A., 98(20), (Sep. 25, 2001), 11438-43.
Zhang, Ning, et al., "Light modulation of Rubisco in *Arabidopsis* requires a capacity for redox regulation of the larger Rubisco activase isoform", Proc. Natl. Aad. Sci. USA, 99(5), (2005), 3330-3334.
"Argentina Application Serial No. P050105470, Office Action mailed Jan. 28, 2015", 6 pgs.
"European Application Serial No. 12186097.7, Examination Notification Art. 94(3) mailed Feb. 25, 2015", 4 pgs.
"European Application Serial No. 12186097.7, Response filed Nov. 3, 2014 to Examination Notification Art. 94(3) mailed Jul. 28, 2014", 9 pgs.
"International Application Serial No. PCT/US2005/047111, International Preliminary Report on Patentability mailed Jul. 9, 2012", 7 pgs.
"Argentina Application Serial No. P050105470, Office Action dated Jun. 11, 2015", 4 pgs.
"Argentina Application Serial No. P050105470, Response filed Sep. 28, 2015 to Office Action dated Jun. 11, 2015", 5 pgs.
"European Application Serial No. 16169061.5, Extended European Search Report dated Sep. 9, 2016", 10 pgs.
"Indian Application Serial No. 6255/DELNP/2008, First Examiner Report dated Nov. 16, 2015", 2 pgs.
"Indian Application Serial No. 6255/DELNP/2008, Response filed Nov. 16, 2016 to First Examiner Report dated Nov. 16, 2015", 13 pgs.
Enkhchimeg, Vanjildorj, et al., "Overexpression of Arabidopsis ABF3 gene enhances tolerance to drought and cold in transgenic lettuce (*Lactuca sativa*)", Plant Cell, Tissue and Organ Culture, Kluwer Academic Publishers, DO, vol. 83, No. 1, (Oct. 1, 2005), 41-50 pgs.
"Sequence of BAC T20M3 from *Arabidopsis thaliana* chromosome 1, complete sequence", (Sep. 13, 1999).
Theologis, A., et al., "Sequence and analysis of chromosome 1 of the plant *Arabidopsis thaliana*", Nature, 408(6814), (Dec. 14, 2000), 816-820.

* cited by examiner

Consensus sequence as in SEO ID NO: 10031 of SEQ ID NO: 136 and its homologs

SEQIDNO MPGNEYGERIHNFFGQEGLSQDSHQPQAGDGSWSGFRNGLVSNQRQIDPSLIANLKTYST
7669
3429
8564
136
7856
5562
8365
5927
2547
5459
Consensus (SEQ ID NO:10031)

QQSVDPERGQSSNSQHGLNFAQQPMRSDYSRSVLREHQQSTTGYMHGNLMLQASPNEGSF

VGVDVESSRDRLSGSGFTLDRHKTPMRFDMGESPVNYDFFGGQQQLNNQLPGMIQPFPRQ

FIG. 1A

QMTFNDMQLLKQHAMAKQMHEYQIQQQLQKQQLEARQLNSLHSNAVNGSLSSDNQSHPSI

SGVPLQDASNNWLQPDLMTGNTNWMHRGISPIVQSSSSGLVITPEHGHANLMAQQFETSL

YGMPVGGTDAPQNAFSSFQMKMLAAQHGSANMSSSLTNQPTSFLNQSDSHMLPRSTYQEN

LYSHISVPGSNDRPNFESFQQDNSGQQNISGQEEFGQMDGSGLSEKSFMKVPENINTLQK

FIG. 1B

FIG. 1C
STTLDPTEEKILFGSDDNLWEAFGNSTDMSLTGNLMSSSSDLFDACPSLQSGSWSALMQS
AVAETASDDAGVHEWGSKQQSVWANNINAPHPDSRIGNRAQVSGGHTDSTRSTVQHLQDK
GNIVSDHGLLEKPMTPQSQMAGNMFQSLSSGIDVQNNSCSIGKNEDIDDRLGNWRGASNP
NSAALMERKNHFTQNLQMQRASYGAGDDSRASRDIQQNIQHHLDNNSVEKAIHQLNSGDS

SQILESYASNNVSKVMTESNEMGNSGKENSSDSFRSKFSPESLTQVNARDLSVLPGGKET

QSPSRSDGLIRDGLNHKDSANCMLQFGPTISQSFFNKNHAVSAGSDHQQISPQIAPSRFS

QYEAFKNGLVQPVNDTGRFTLLKIGERYSNLGNSDDGLHSVQSSKQLNTADPGYIVHMQQ

ISGSTPGVETLSSASLPCGATDQLLKVYKPKKRKNVTSELLSWSKEVMQRPQRLKTLGFL

FEAEVDWARATNRFAEKGLFVEFATLLEDGPPIRSKRRLIYTTQLMQQLFRPLPGRVKSL

FIG. 1D

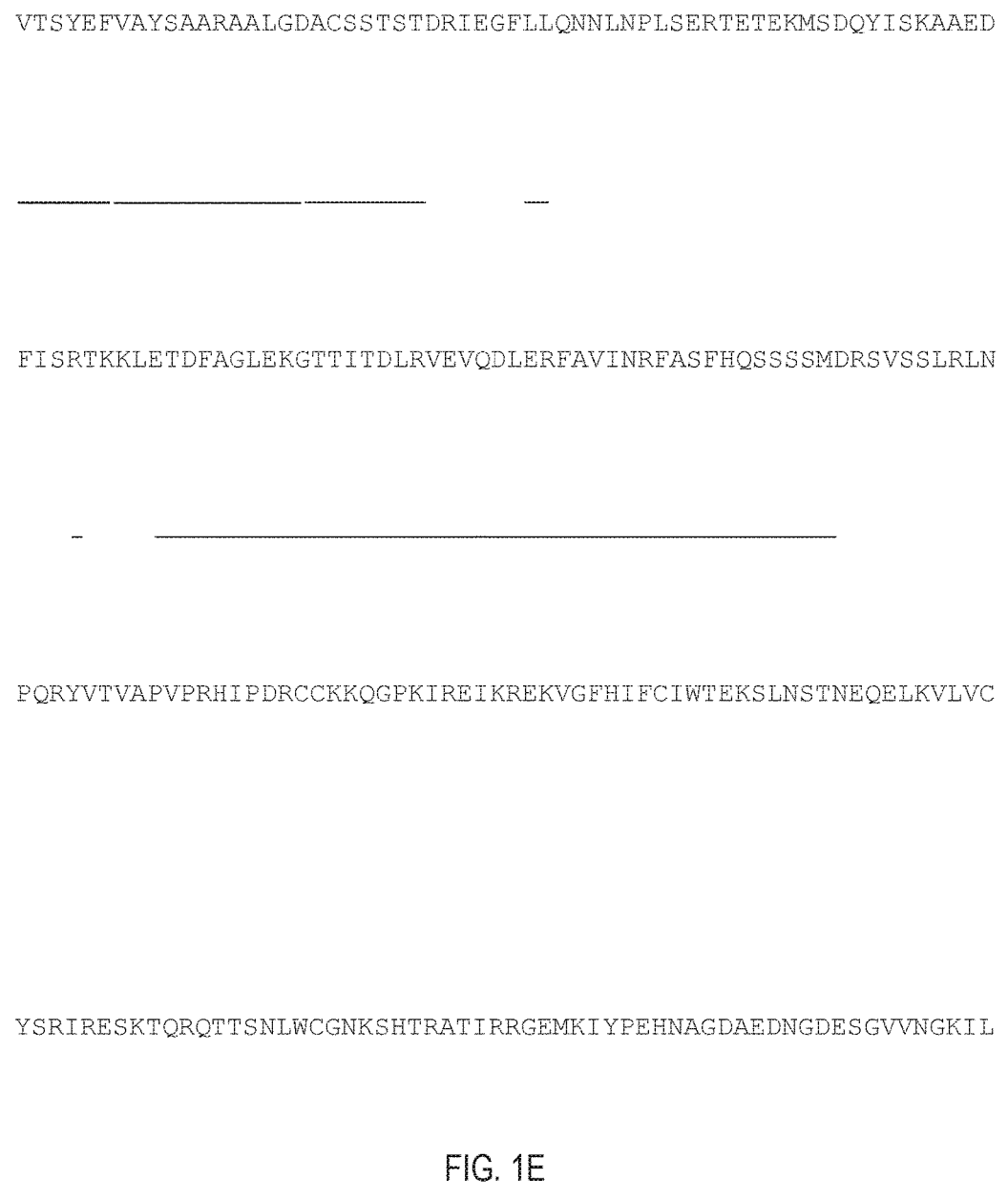

VTSYEFVAYSAARAALGDACSSTSTDRIEGFLLQNNLNPLSERTETEKMSDQYISKAAED

FISRTKKLETDFAGLEKGTTITDLRVEVQDLERFAVINRFASFHQSSSSMDRSVSSLRLN

PQRYVTVAPVPRHIPDRCCKKQGPKIREIKREKVGFHIFCIWTEKSLNSTNEQELKVLVC

YSRIRESKTQRQTTSNLWCGNKSHTRATIRRGEMKIYPEHNAGDAEDNGDESGVVNGKIL

FIG. 1E

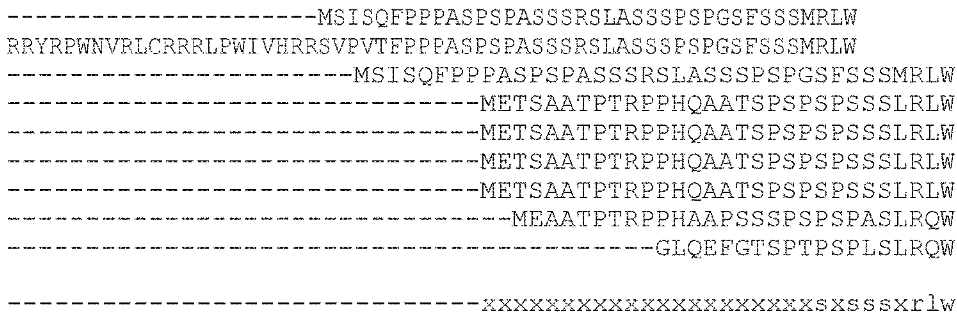

```
----------------------MSISQFPPPASPSPASSSRSLASSSPSPGSFSSSMRLW
RRYRPWNVRLCRRRLPWIVHRRSVPVTFPPPASPSPASSSRSLASSSPSPGSFSSSMRLW
-----------------------------MSISQFPPPASPSPASSSRSLASSSPSPGSFSSSMRLW
-------------------------------------METSAATPTRPPHQAATSPSPSPSSSLRLW
-------------------------------------METSAATPTRPPHQAATSPSPSPSSSLRLW
-------------------------------------METSAATPTRPPHQAATSPSPSPSSSLRLW
-------------------------------------METSAATPTRPPHQAATSPSPSPSSSLRLW
---------------------------------------MEAATPTRPPHAAPSSSPSPSPASLRQW
------------------------------------------------GLQEFGTSPTPSPLSLRQW

-------------------------------------xxxxxxxxxxxxxxxxxxxxxsxsssxrlw
```

```
RPAAQRNLRNQWSNLSNCRQQWIVACSAGRSHATLLVNSYLSQKYMPMMELGVLSDMFDI
RPAAQRNLRNQWSNLSNCRQQWIVACSAGRSHATLLVNSYLSQKYMPMMELGVLSDMFDI
RPAAQRNLRNQWSNLSNCRQQWIVACSAGRSHATLLVNSYLSQKYMPMMELGVLSDMFDI
RPAAQRNMRNQWSHLSAAKEQWLAAVADGRAHASALVNVHLSCRNMPTMDLGVLKDMPGI
RPAAQHNMRNQWSHLSAAKEQWLAAVADGRAHASALVNVHLSCRNMPTMDLGVLKDMPGI
RPAAQRNMRNQWSHLSAAKEQWLAAVADGRAHASALVNVHLSCRNMPTMDLGVLKDMPGI
RPAAQRNMRNQWSHLSAAKEQWLAAVADGRAHASALVNVHLSCRNMPTMDLGVLKDMXGI
RPAAQRNLRNQWSRLLAAKAR-----------------------YMPGMDLGVLKDMPGI
RPAAQRNLRNQWSRLLAAKTQWLDAAASGRSHAAXLVNAYLSRSYMPGMDLGVLKDIPRI


rpaaqrnxrnqwsxlsxxxxqwxxaxxxgrxhaxxlvnxxlsxxxmpxmxlgvlxdrnxxi
```

```
DKKALKKLFTQQSSYRIKLLSSYKEMVAVVVEMVNASRSLRCYTKLSTG-SLIQFSGTKE
DKKALKKLFTQQSSYRIKLLSSYKEMVAVVVEMVNASRSLRCYTKLSTG-SLIQFSGTKE
DKKALKKLFTQQSSYRIKLLSSYKEMVAVVVEMVNASRSLRCYTKLSTG-SLIQFSGTKE
RDKANSKLALREEQYSGMLLSAYKEMVRQLSYLVEASHSMRRFSKAAPNCPITQFSDRQD
RDKANSKLALREEQYSGMLLSAYKEMVRQLSYLVEASHSMRRFSKAAPNCPITQFSDRQD
RDKANSKLALREEQYSGMLLSAYKEMVRQLSYLVEASHSMRCFSKAAPNCSITQFSDRQD
RDKANSKLALREEQYSGMLLSAYKEMVRQLSYLVEASHSMRRFSKAAPNCPITQFSDRQD
REKASGKLARREEQCQSMLLSAYREMVLATAELVRASHSMRCFSKVAANSPLIRFTERQD
RDRASAKLXTRRCNAREMLLSAYKEMVCAMSDLVKASHAMRCFSKVSSGSPLVRFTDRQD

-------------------------------LQVGIVSDMINVSRSMKCFFKGSNNSSLLHFSYNSA
xxkaxxklxxxxxxyxxxllsxykemVxxxxxxvxaSxsmrcfxKxxxxxxxxqFsxxxx
```

```
DSNDAGDCGGIPVFNFWNVSAFEKMAEELVEMFKREVMLK---RLLIMELISLSTEVPQP
DSNDAGDCGGIPVFNFWNVSAFEKMAEELVEMFKREVMLK---RLLIMEL    SLSTEVPQP
DSNDAGDCGGIPFGTCHVEMIPEKMAEELVEMFKREVMLK---RLLIMELISLSTEVPQP
NLNDSGDGGGAPVFKWFSVLEFESLAQELVQMFVSEQKLK-RLLLLEFLSIALKEGVELQ
NLNDSGDGGGAPVFKWFSVLEFESLAQELVQMFVSEQKLK-RLLLLEFLSIALXEGVELQ
NLNDSGDGGGAPVFKWFSVLEFESLAQELVQMFVSEQKLKXRLLLLEFLSIALKEGVELQ
NLNDSGDGGGAPVFKWFSVLEFESLAQELVQMFVSEQKLK-RLLLLEFLSIALKEGVELQ
DMNDSGDGGGSPVFKWFSVLEFENLAQELVDMF-ISELQLKRLLVLELLSVTFKEGVQHD
DLNDLGDGGGAPVHRWVSMLEFENLAKELVEMFXVSELRLKRLIVLDLLSINLKEG--AD
DQSDSGDGGGIPAFTFYSITSHEKFAX-----FSMELCLK---RLLVLEFMSISYDTSAV
xxnDxGDgGGxPvfxxxsvxxfExxAxelvxmFxxexxlk-xxxlLxxxxixlxxxvxxx
```

FIG. 1F

```
INNSWSDELYHGEFDHLTKCSLYSMEVAKPVLPRVKDYNIGSSSISHTNQPTAEILQIYL
INNSWSDELYHGEFDHLTKCSLYSMEVAKPVLPRVKDYNIGSSSISHTNQPTAEILQIYL
INNSWSDELYHGEFDHLTKCSLYSMEVAKPVLPRVKDYNIGSSSISHTNQPTAEILQIYL
TSLNWGDELYDGESNKLQSIGLQSGDAYSPPENWCAERLGSQR---PGNLPLHEVLQVYL
TSLNWGDELYD-------------------------ERLGSQR---PGNLPLHEVLQVYL
TSLNWGDELYDGESNKLQSIGLQSGDAYSPPENWCAERLGSQR---PGNLPLHEVLQVYL
TSLNWGDELYDGESNKLQSIGLQSGDAYSPPENWCAERLGSQR---PGNLPLHEVLQVYL
ASLEWSNELFDGEFNEFQSIGLLSGDSYALPKNWSAGVSKAWQ---PDQTPSHEVLQVYL
PSLEWSDELYDGEFNEFQRIGLGSGDSFPLPENWKADVLQARR---PGHTPSHEVLQVYL
KQLHWSTQLYDDEFKDLRDCNLYCVVTHGPVPPRLRDGKSGIDALRFDNQPNPEVLQVYL

xxlxWxdeLydgexxxlxxxxlxsxxxxxpxxxxxxxxxxxxxxxxxnxPxxEvLQvYL

TTWLAEVNIDTHRVDEILALVGEEIRVTF-*
TTWLAEVNIDTHRVDEILALVGEEIRVTF-*
TTWLAEVNIDTHRVDEILALVGEEIRVTF-*
TTWHANMNINRSRIDEIFELVEEEMKIKLS*       TTWHANMNINX-
EIDEIFELVEEEMKIKLS*
TTWHANMNINRSRIGEIFELVEEEMKIKLS*
TTWHANMNINRSRIDEIFELVEEEMKIKLS*
TSWLANVNIKTSRIDEIFELVGEEMQIKLS*
TSWLANVNIKTSRIDEIFELVEEEMQIKLR*
TTWLAEVNMSLPSMIAMKFIL---------*
TtWxAxxNixxxrxdeixxlvxeexxxxxx*
```

FIG. 1G

Consensus sequence as in SEQ ID NO: 10032 of SEQ ID NO: 151 and its homologs

```
SEQ ID NO
151
5495
6475
9700
2063      ----------------------MGSEAAAARPVVVTVNGERYEAVGVDPSTTLLEFLRTRT
10020     ----------------------MGSEAAAARPVVVTVNGERYEAVGVDPSTTLLEFLRTRT
2024
2060      ---------------------MGSEAAAAARAVVVAVNGERYEAVGVDPSTTLLEFLRTRT
7076      ---------------------------MGEAAAVVAVNGERYEAVGVDPSMTLLEFLRTRT
2606
3946      MDSPPPPREEVVVFAVNSERFELRRDGGDPGESLLEFLRSRTRFTGAKLGCGEGKATPQP
4 96      -------------------------------------MSDCNSGGGERRPNARATDAPP
Consensus ----------------------- xxxxxxxxxxxxxxxxxxxxxxxxxxxxxxxxxxxxxxx
(SEQ ID NO:10032)

PVRGPKLGCGEGGCGACVVVVSKYDAVADEVTEFSASSCLTLLGSLHHCAVTTSEGIGNS
PVRGPKLGCGEGGCGACVVVVSKYDAVADEVTEFSASSCLTLLGSLHHCAVTTSEGIGNS

PVRGPKLGCGEGGCGACVVVVSKYDAVADEVTEFSASSCLTLLGSLHHCAVTTSEGIGNS
PFRGPKLGCGEGGCGACAVVVSKYDAAADEVTSFSASSCLTLLGSLHHCAVTTSEGIGNS

TALPPPRLLCFRGCGACVVVVSAYDAEADEVAHAAVSSCLTLARGLHHRAVTTTEGLGSS
VRAPSGGAFRCRGCGACVILIAKYNPKTDEVTEFNASSCLTLLYSIHFCSIITTEGLGNT
xxxxxxxxxxxxxxxxxxxxxxxxxxxxxxxxxxxxxxxxxxxxxxxxxxxxxxxxxxxxx

RDGFHAVQRRLSGFHASQCGFCTPGMCMSIYSALAKADRCSSRPSPPP----GFSKLTAA
RDGFHAVQRRLSGFHASQCGFCTPGMCMSIYSALAKADRCSSRPSPPP----GFSKLTAA

RDGFHAVQRRLSGFHASQCGFCTPGMCMSIYSALAKADKASGRPAPPT----GFSKITAA
RDGFHPVQRRLAGFHASQCGFCTPGMCVSIFSALANADRAASAAPPPPPTPPGFSRLTAA

RRGLHALHERLAGFHASQCGFCTPGVCMSLAGALAAAE---GNGKKAASAAEGFSRLTAA
KDGFHAIQKRMSGFHASQCGFCTPGMCMSIFSSLVNAD---KSKKPDP--PKGFSKLSVS
xxxxxxxxxxxxxxxxxxxxxxxxxxxxxxxxxxxxxxxxxxxxxx ----- xxxxxxxx

EAEKAVSGNLCRCTGYRPIVDACKSFAADVDLEDLGLNAFWKKGADOERADVGKLPAYSG
EAEKAVSGNLCRCTGYRPIVDACKSFAADVDLEDLGLNAFWKKGADDERADVGKLPAYSG
```

FIG. 2A

```
EAEKAVSGNLCRCTGYRPIVDACKSFAADVDLEDLGLNAFWKKGVDDEHADINKLPAYSG
DAERAVSGNLCRCTGYRPILDACKSFAADVDLEDLGLNSFWKK---GERADITKLPAYSC

EAERAVAGNLCRCTGYRPIADACKSFAADVDLEDLGLNCFWNKGDATASVSKLPPYKERS
EAERSFSGNMCRCTGYRPIVDACKSFASDVDLEDLGLNIFWKKGDKHPDPTKLP---SYT
xxxxxxxxxxxxxxxxxxxxxxxxxxxxxxxxxxxxxxxxxxxxxxxxxxxxxxxx


GAAVCTFPEFLKSEIRSSMGQANGGAPAVAVTGDGWFHPKSVEEFHRLFDSNLFDERSVK
GAAVCTFPEFLKSEIRSSMGQANGGAPAVAVTGDGWFHPKSVEEFHRLFDSNLFDERSVK

GAAVCTFPEFLKSEIRSSMGQANGDTSAVVVTGDGWFHPKSVEEFHRLFDSNLFDERSVK
TADVATFPEFLKSEIRSSG----GAPAVAVTGDGCWFHPRSIEEFHRLFECNLFDEMSVK

IAAFPEFLKDEIRSSLGIDHSISSASMVGSVSSWYQPKNVEEYYKLIGSLSSSSDKSRTK
LGGGICTFPDFLKSEIKSSIDFNDASISSPREGWYCPKNIKQYYKLVN---SGLFSESSVK
xxxxxxxxxxxxxxxxxxxxxxxxxxxxxxxxxxxxxxxxxxxxxxxxxxxxxxxx


IVASNTGSGVYKDQDLHDKYINISQILELSAINRSSKGVEIGAVVSIS------KAIEIL
IVASNTGSGVYKDQDLHDKYINISQILELSAINRSSKGVEIGAVVSIS------KAIEIL

IVASNTGSGVYKDQDLHDKYINISQIPELSAINRSSKGVEIGAVVSIS------QAIDIL
IVASNTGSGVYKDQDLHDKYINISQIPELSAINRSSNGIEIGAAVSIS------KAIEIL

VVVGNTSSGVYRDAELYDRYIDLRAIPELNSVSKDVKGVGIGAAMSISQVIEILRGEGNS
VVVGNTSTGVYKDQDLYDKYIDIAGIPELSAIVRKDKGIEIGAATSISRTIEILNQESES
xxxxxxxxxxxxxxxxxxxxxxxxxxxxxxxxxxxxxxxxxxxxx-----xxxxxx


SDGG---AVFRKIADHLSKVASSFVQNTATIGGNIIMAQRLSFPSDIATVLLAAGSTVTI
SDGG---AVFRKIADHLSKVASSFVQNTAAIGGNIIMAQRLSFPSDIATVLLAAGSTVTI

SDGG---AVFRKIADHLSKVASPFVRNTATIGGNIIMAQRLSFSSDIATVLLAAGSTVTI
RSDGGDAVVFRKIAYHLGKVASPFVRNTATIGGNIIMAQRMSFPSDIATVLLAAGSTVTI

YKD----VVFCKIADHMEKVASQFVRNMASLGGNLIMAQRDEFASDIATVLLAAGSSLCI
TSSPNGSVVFRKLAEHMSKVASPFVRNTASIGGNIILAHKYPFRSDIATILLGAAATVNL
xxxx---xxxxxxxxxxxxxxxxxxxxxxxxxxxxxxxxxxxxxxxxxxxxxxxxxx
```

FIG. 2B

```
QVAAKR-MCITLEEFLKQPPCDSRTLLVSIS----------------IPDWGSDDGITFE
QVAAKR-MCITLEEFLKQPPCDSRTLLVSIS----------------IPDWGSDDGITFE

QVAAKR-MCITLEEFLKQPPCDSRTLLVSIS----------------IPDWGSDDGITFQ
QQVASKRMCLTLEEFLKQPPCDSRTLLISIS----------------IPDWCSYDGITFE

QVSSERMNVTLERFLDMAPCDCKTLLLRIYIPHCTPSGISSSSESVNKTGDKPASSVLFE
QVSSKTLHVTLEQFLEQPPLGHNTLLLSIFIPHWAS-------------DCKKEHTLVFE
xxxxxx-xxxxxxxxxxxxxxxxxxxxxxxx ------------- xxxxxxxxxxxxx


SFRAAPRPLGNAVSYVNSAFLARSSVDGSSGSHLIEDVCLAFGAFGAEHAIRAREVEEFL
SFRAAPRPLGNAVSYVNSAFLARSSVDGSSGSHLIEDVCLAFGAFGAEHAIRAREVEEFL

TFRAAPRPLGNAVSYVNSAFLARSSVDGSSGSHLIEDVCLAFGPFGAKHAIRAREVEKFL
TFRAAPRPFGNAVSYVNSAFLARSSLDAASGSHLIEDVRLAFGAFGSEHAIRASKVEEFL

TYRASPRPIGNAVSYLNSAFLAKLSSDETSGNCILEKLCLAFGAYGTQHAVRATNVESLL
TYRAAPRPLGNAVSYVNSAFLGHVSLDKSSGDNILSNLHLAFGAYGTEHAIRARKVEEYL
xxxxxxxxxxxxxxxxxxxxxxxxxxxxxxxxxxxxxxxxxxxxxxxxxxxxxxxxxxxx


KGKLVSAPVILEAVRLLKGVVSPAEGTTHPEYRVSLAVSYLFRFLTSLAN----------
KGKLVSAPVILEAVRLLKGVVSPAEGTTHPEYRVSLAVSYLFRFLTSLAN----------

KGKLVSAPVILEAVRLLKGVVSPAEGTTHPEYRVSLAVSYLFKFLSSLTN----------
KGKLVSASVILEAVRLLKGVVSPAEGTTHPEYRVSLAVSYLFRFLSSLAN----------

VGKPITASLLLEACTVLKKTIVPGEGTRHAAYRSSLAVAFLFSFLYPITKGTFKPVEAVH
TGKILSASVVLEAIRLLRETIVPVEGTTHPEYRVSVAVGFLFSFLSPLCKGVIEPGKTLS
xxxxxxxxxxxxxxxxxxxxxxxxxxxxxxxxxxxxxxxxxxxxxxxxxx----------


--GLDEPENANVPNGSCTNGTANGSANSSPEKHSNVDSSDLPIKSRQEMVFSDEYKPVGK
--GLDEPENANVPNGSCTNGTANGSANSSPEKHSNVDSSDLPIKSRQEMVFSDEYKPVGK

--GLDEPENANVPNGSFTNGTANGIVDSSPEKHSNVDSSYLPIKSRQEMVFSDEYRPIGK
--GLDDKPEN---ANNVPNGSCTTNGTTNGSAESTVDSFDLPIKSRQEMVFSDEYKPVGK

LNGHIISDNNGNMNRGPDTHVDVSPKEINNVKSDLHGNDRILESSKQVIEISEDYLPVGL
ISEDLVHTDNVHN---------------------------MPLSSRRETLSGDEYKPVGD
--xxxxxxxxxxxxxxxxxxxxxxxxxxxxxxxxxxxxxxxxxxxxxxxxxxxxxxxxxx
```

FIG. 2C

```
PIEKTGAELQASGEAVYVDDIPAPKDCLYGAFIYSTHPHAHIKDINFRSSLASQKVITVI
PIEKTGAELQASGEAVYVDDIPAPKDCLYGAFIYSTHPHAHIKDINFRSSLASQKVITVI

PIEKTGAELQASGEAVYVDDISAPKDCLYGAFIYSTHPHAHIKGVNFRSSLASQKVITVI
PIKKVGAELQASGEAVYVDDIPAPKDCLYGAFIYSTHPHAHIKGVNFRSSLASQKVITVI

PAKKVGAELQASGEAIYVDDIPSPKDCLHGAFVYSTKPLAHVKSIELNPSLEQLKTVAIV
PIKKYKVELQASGEAIYVDDIPAPKNCLYGEFIYSTQPLANVKSIKFKPSLASKKILTVV
xxxxxxxxxxxxxxxxxxxxxxxxxxxxxxxxxxxxxxxxxxxxxxxxxxxxxxxxxxxx

TAKDIPTGGENIGSCFPMLGDEALFVHPVSEFAGQNIGVVIAETQKYAYMAAKQAVIEYS
TAKDIPTGGENIGSCFPMLGDEALFVHPVSEFAGQNIGVVIAETQKYAYMAAKQAVIEYS

TLKDIPTNGKNIGSCSPMLGDEALFVDPVSEFAGQNIGVVIAETQKYAYMAAKQSVIEYS
TAKDIPTGGENVGSCFPMLGDEALFADPVAEFAGQNIGVVIAETQKYAYMAARQAVIEYN

TAKDIPKGGSNVGANTIFGPE-PLFGDPLTQWAGEPLGIVVAETQKTANIAASRALVDYS
SAKDIPTGGRNIGSTFLFGDEEPLFGDPIAEFAGQALGVVIAETQRYADMAAKQAVVEYT
xxxxxxxxxxxxxxxxxxxxxxxxxxxxxxxxxxxxxxxxxxxxxxxxxxxxxxxxxxxx

TENLQPPILTIEDAVQHNSYFPVPPFLAPTPIGDFNQAMSEADHKIIDGEVKLESQYYFY
TENLQPPILTIEDAVQHNSYFPVPPFLAPTPIGDFNQAMSEADHKIIDGEVKLESQYYFY

TENLQPPILTVEDAVQHNSYFQVPPFLAPTPIGEFNQAMSEADHKIIDGEVKLESQYYFY
TENLQPPILTVEDAVQHNSYFQVPPFLQPKPIGDFNQAMSEADHKIIDGEVKLGSQYYFY

MENLDAPILSIEEAVRSSSYFEILPFLLPQKIGDFSKGMEEADQKIYSTEVNLHSQYYFY
TDGLKAPILTVEQAVQNNSYFQVPPERAPKQVGDFSKGMAEADHKIMSEEVKLASQYYFY
xxxxxxxxxxxxxxxxxxxxxxxxxxxxxxxxxxxxxxxxxxxxxxxxxxxxxxxxxxxx

METQTALAIPDEDNCITLYVSAQLPEITQNTVARCLGIPYHNVRIITRRVGGGFGGKAMK
METQTALAIPDEDNCITLYVSAQLPEITQNTVARCLGIPYHNVRIITRRVGGGFGGKAMK

METQTALAIPDEDNCITLYVSAQLPEITQNTVARCLGIPYHNVRIITRRVGGGFGGKAMK
METQTALAFPDEDNCITVYCSAQMPEVTQDIVARCLGVPFHNVRIITRRVGGGFGGKAMK

METQTALAIPEEDNCMVVYSSSQCPEVAQETIAKCLGLPCHNVRVITRRVGGGFGGKAVR
METQTALAIPDEDNTMTVYSSSQFPELAQNVISKCLGIPFNNVRVITRRAGGGFGGKAVR
xxxxxxxxxxxxxxxxxxxxxxxxxxxxxxxxxxxxxxxxxxxxxxxxxxxxxxxxxxxx
```

FIG. 2D

```
AIHVAAACAVAAFKLRRPVRMYLDRKTDMIMAGGRHPMKVKYSVGFKSDGKITGLHFDLG
AIHVAAACAVAAFKLRRPVRMYLDRKTDMIMAGGRHPMKVKYSVGFKSDGKITGLHFDLG

AIHVATACAVAAFKLRRPVRMYLDRKTDMIMAGGRHPMKVKYSVGFKSDGKITGLHVDLR
ATHVATACAVAAFKLRRPVRMYLDRKTDMIMAGGRHPMKAKYSVGFKSDGKITALHLDLK

SLPVATACALSAFKLQRPVRIYLDRKTDMIMTGGRHPMKIRYSVGFKSDGNITALHIELL
SLHIATAAALCAHTLRRPVRMYLNRNTDMIMVGGRHPMKARYSVGFKSDGKITALHLDLL
xxxxxxxxxxxxxxxxxxxxxxxxxxxxxxxxxxxxxxxxxxxxxxxxxxxxxxxxxxxx
```

```
------------------------------------VTILNKFVQKSRLVPVRNSRDIVDPR
MNGGISPDCSPVLPVAIVGALKKYNWGALSFDIKVCKTNVSSKSAMRAPGDAQGSFIAEA
MNGGISPDCSPVLPVAIVGALKKYNWGALSFDIKVCKTNVSSKSAMRAPGDAQGSFIAEA

INCGISPDCSPALPVAIVGALKKYNWGALSFDIKLCKTNVSSKSAMRAPGDAQGSFIAEA
INAGISPEFSPAIPYAIVGALKKYSWGALAFDIKVCKTNVSSKSAMRAPGDAQGSFIAEA

VNAGITQDVSPVIPHNFIEALKKYNWGAFSYDARICKTNIATRSAMRGPGEVQGSYVAEA
INAGISADASPVIPGTIISGLKKYNWGALSFDVKLCKTNNTSKSVMRAPGDTQGSFIAEA
xxxxxxxxxxxxxxxxxxxxxxxxxxxxxxxxxxxxxxxxxxxxxxxxxxxxxxxxxxxx
```

```
IREHVASALGADTNAVRRKNLHSVESLTKFYGDAAG---DAPTYSLIDIFDKLASSPEYR
IVEHIASTLSVDTNAIRRKNLHDFESLKVFYGNSAG---DPSTYSLVTIFDKLASSPEYQ
IVEHIASTLSVDTNAIRRKNLHDFESLKVFYGNSAG---DPSTYSLVTIFDKLASSPEYQ

IVEHIASTLSVDTNAIRRKNLHDFESLKVFYGNSAG---DPSTYSLVTIFDKLASSPEYQ
IVEHVASTLSVATNTIRRKNLHDLESLKVFFGDSAAGEASTSSYSLVIIFDRLASTPEYQ

IIEHVAAVLSTDVNLVRQRNLHTVESLSLYHS---ECMEDALGYTLPSICNQLITSANYQ
IIEHVAAILSLDANTVRQKNFHTYDSLVLFYP---DSAGESSTYTLHSIFDRLASTSRYL
xxxxxxxxxxxxxxxxxxxxxxxxxxxxxxxxxx---xxxxxxxxxxxxxxxxxxxxxxx
```

```
SRAEAVERFNGGSRWKKRGISCVPITYEVALRPTPGKVSILNDGSIAVEVGGVELGQGLY
QRAAMVEHFNAGNRWKKRGISCVPITYDVRLRPTPGKVSIMNDGSIAVEVGGVEIGQGLW
QRAAMVEHFNAGNRWKKRGISCVPITYDVRLRPTPGKVSIMNDGSIAVEVGGVEIGQGLW

QRAAVVEHFNAGSRWKKRGISCVPITYDVRLRPSPGKVSIMNDGSIAVEVGGVEIGQGLW
RRAAMVEQFNGSSRWKKRGISCVPITYSVTLRPSPGKVSILNDGSIAVEVGGVEIGQGLW
```

FIG. 2E

```
HQLEMIRSFNKSNRWKKRGLSVVPIVHKFASRPTPGKVSILNDGSVAVEVGGIELGQGLW
QRVESIKKFNSTNKWRKRGISSVPLIFKVEPRPAPGRVSVLNDGSIVVEVGGVELGQGLW
xxxxxxxxxxxxxxxxxxxxxxxxxxxxxxxxxxxxxxxxxxxxxxxxxxxxxxxxxxxx

TKVKQMTAFGLRELCPDADG-LLDKVRVIQADTLSLIQGSFTGGSTTSESSCEAVRQSCT
TKVKQMTAFALGQLCDDGGEGLIDKVRVIQADTLSMIQGGFTGGSTTSETSCEAVRKSCA
TKVKQMTAFALGQLCDDGGEGLIDKVRVIQADTLSMIQGGFTGGSTTSETSCEAVRKSCA

TKVKQMTAFALGQLCDDGGEGLLDKVRVIQADTLSMIQGGFTGGSTTSETSCEAVRKSCA
TKVKQMTAFALGQLCDDGGEGLLDNVRVIQADTLSMIQGGWTAGSTTSETSCEAVRKSCA

TKVKQMAAFGLGQLWTDRRQELLERVRIIQADTLSVIQGGWTTGSTTSESSCEAVHRACN
TKVQQMTAFALGQLWPKGCEGLLDRIRVLQSDTLNLIQGGLTAGSTTSESSCAATLQACN
xxxxxxxxxxxxxxxxxxxxxxxxxxxxxxxxxxxxxxxxxxxxxxxxxxxxxxxxxxxx

VLFERLKPIKDSLEAGPGAAAPWSALIAQAKMASVNLSAHAYWKPGPAFRKIHPPTGAAV
ALVERLKPIKEKAGTPPWKSLIAQASMASVKLTEHAYWTPDPTFTSYLN------YGAAI
ALVERLKPIKEKAGTPPWKSLIAQASMASVKLTEHAYWTPDPTFTSYLN------YGAAI

ALVERLKPIKEKAGTLPWKSLIAQASMASVKLTEHAYWTPDPTFTSYLN------YGAAI
ALVERLKPIKEKAGTLPWKSFIAQASMASVKLTEHAYWTPDPTFTSYMN------YGAAT

ILVDRLKPLKEQLQEK--QGTVSWDELISQAKMVGVDLSAKELYVPG-ASGSYLNYGAAA
MLIERLKPVMERLQLQ--SDTVSWDTLISQASQENINLSASAYWVPEQDSNFYLNYGAGT
xxxxxxxxxxxxxxxxxxxxxxxxxxxxxxxxxxxxxxxxxxxxxxxxx     xxxxx

-------------------------------------SAFIQGVXFFTNEDYATNSDGLV
----------TGATTIMRSDLVYDCGQSLNPAVDLGQVEGAFVQGVGFFTNEDYATNADGLV
SEVEIDVLTGATTIMRSDLVYDCGQSLNPAVDLGQVEGAFVQGVGFFTNEDYATNADGLV
SEVEVDVLTGETTILRSDLVYDCGQSLNPAVDLGQVEGAFVQGIGFFTNEEYTTNSDGLV
SEVEVDVLTGETTILRSDLVYDCGQSLNPAVDLGQVEGAFVQGIGFFTNEEYTTNSDGLV

SEVEVDVLTGETTILRSDLVYDCGQSLNPAVDLGQVEGAFVQGIGFFTNEEYTTNSDGLV
SEVEVDVLTGATTILRSDLVYDCGQSLNPAVDLGQVEGAFVQGVGFFTNEEYATNADGLV
---------------QTDILYDSGKSLNPAVDLGQIEGAFVQGLGFFMLEEYITDSEGLR
SEVEIDLLTGATTILRSDLIYDCGRSLNPAVDLGQVEGAFVQGIGYFMNEEYVTNSDGLL
SEVEVDLLTGAITIIRSDLIYDCGKSLNPAVDLGQIEGSFIQGIGFFIYEEHQTNSDGLV
xxxxxxxxxxxxxxxxdxxydxgxslnpavdlgqxegafxqgxgffxxexyxtnxdglx

------------------------------------------------------MREAIR
IHDGTWTYKIPTVDTIPKQFNVELINSAHDQKRVLSSKASGEPPLLLASSVHCAMREAIR
VHDGTWTYKIPTVDTIPKQFNVELISSARENKRVLSSKASGEPPLLLAASVHCAMREAIR
VNDGTWTYKIPTVDTIPKQFNVELISSARDKKRVLSSKASGEPPLLLAASVHCAMREAIR
INDGTWTYKIPTVDTIPKQFNVELINSARDHKRVLSSKASGEPPLLLASSVHCAMREAIR
INDGTWTYKIPTVDTIPKQFNVELINSARDHKRVLSSKASGEPPLLLASSVHCAMREAIR
--------------------------------ARDHKGVLSSKGSGKPPLLLGLSVHCPIREAIR
```

FIG. 2F

```
INDGTWTYKIPTVDTIPKQFNVELINSARDHKRVLSSKASGEPPLLLASSVHCAMREAIR
IHDGTWTYKIPTVDTIPKQFNVELINTARHHSRVLSSKASGEPPLLLASSVHCAMREAIR
LTDSTWTYKIPTVDTIPRQFNVEILNSGRHEKRVLSSKASGEPPLLLAASVHCATREAVK
VSDGTWTYKIPTVDTIPKQFNVKLLNSGFHKKRVLSSKASGEPPLLLAASVHCATREAIR
ISNSTWDYKIPSVDTIPKQFNAEVLNTGYHKHRVLSSKASGEPAVVLGASVHCAVREAIR
xxdxtwtykiptvdtipkqfnvexxxxxxxxkrvlsskasgeppllllaxsvhcaxREAir

AARKEFSVCTGP---ANSAITFQMDVPATMPVVKELCGLDVVERYLESVSAASPTNTAKA
AARKEFSVCTGP---ANSTITFQMDVPATMPIIKELCGLDVVERYLESMSAASPTATAQA
AARTDFSVNS--------PLTFQMDVPATMADVKELCGLDVVERHLQSLSSAAEVPTPVA
AARTDFSVNS--------PLTFQMDVPATMADVKELCGLDVVERHLQSLSSAAEVPTPVA
AARKEFAGAGG------SPLTFQMDVPATMPIVKELCGLDVVERYLESFAAKA-------
AARKEFAGAGG------SPLTFQMDVPATMPIVKELCGLDVVERYLESFAAKA-------
AARKEFPGAGG------FPLTFQMDVPATMPIVKELCGLDVVEKYFESFAAKA-------
AARKEFAGAGG------SSLTFQMDVPATMPIVKELCGLDVVERDLESFAAKA-------
AARREFAAVGGGTGGSDQVTSFQMDVPATMPAVKELCGLDVVERYLESFSATTA------
EARKQLRMWKG---VNDSELMFQLPVPATMPVVKELCGLDIVESYLEWPPSVN-------
AAREEYHCSR----SGSSPPFFDLEVPAIMPTVKELCGLDNVEKYLESICSK--------
AARIEFAGNNG---SGSSLLTFQLDVPAPMTVVKELCGLDIVEKYLEDLSNRGAASGN--
aARxefxxxxg---xxxxxxtFqmdVPAtMpxvKELCGLDvVExylesxxxxxxxxxxx
```

FIG. 2G

TRANSGENIC PLANTS WITH ENHANCED AGRONOMIC TRAITS

CROSS REFERENCE TO RELATED APPLICATIONS

This application is a continuation of U.S. application Ser. No. 11/311,940, filed Dec. 19, 2005, which claims benefit under 35 USC §119(e) of U.S. provisional application Ser. No. 60/638,099, filed Dec. 21, 2004, and U.S. provisional application Ser. No. 60/660,320, filed Mar. 10, 2005, both of which herein incorporated by reference.

INCORPORATION OF SEQUENCE LISTING

Two copies of the sequence listing (Copy 1 and Copy 2) and a computer readable form (CRF) of the sequence listing, all on CD-ROMs, each containing the text of the file named "3126011US2.txt", which is 34,689,024 bytes (measured in MS-WINDOWS) and was created on Sep. 5, 2014, are herein incorporated by reference.

INCORPORATION OF COMPUTER PROGRAM LISTING

Two copies of the Computer Program Listing (Copy 1 and Copy 2) containing folders hmmer-2.3.2 and 67pfamDir, all on CD-Rs, are incorporated herein by reference in their entirety. Folder hmmer-2.3.2 contains the source code and other associated files for implementing the HMMer software for Pfam analysis. Folder 67pfamDir contains 67 Pfam Hidden Markov Models. Both folders were created on the CD-R on Sep. 8, 2014, having a total size of 10,981,339 bytes (measured in MS-WINDOWS).

FIELD OF THE INVENTION

Disclosed herein are inventions in the field of plant genetics and developmental biology. More specifically, the present inventions provide plant cells with recombinant DNA for providing an enhanced trait in a transgenic plant, plants comprising such cells, seed and pollen derived from such plants, methods of making and using such cells, plants, seeds and pollen.

BACKGROUND OF THE INVENTION

Transgenic plants with improved agronomic traits such as yield, environmental stress tolerance, pest resistance, herbicide tolerance, improved seed compositions, and the like are desired by both farmers and consumers. Although considerable efforts in plant breeding have provided significant gains in desired traits, the ability to introduce specific DNA into plant genomes provides further opportunities for generation of plants with improved and/or unique traits. Merely introducing recombinant DNA into a plant genome doesn't always produce a transgenic plant with an enhanced agronomic trait. Methods to select individual transgenic events from a population are required to identify those transgenic events that are characterized by the enhanced agronomic trait.

SUMMARY OF THE INVENTION

This invention employs recombinant DNA for expression of proteins that are useful for imparting enhanced agronomic traits to the transgenic plants. Recombinant DNA in this invention is provided in a construct comprising a promoter that is functional in plant cells and that is operably linked to DNA that encodes a protein having at least one amino acid domain in a sequence that exceeds the Pfam gathering cutoff for amino acid sequence alignment with a protein domain family identified by a Pfam name in the group of Pfam names as identified in Table 28. In more specific embodiments of the invention the protein expressed in plant cells has an amino acid sequence with at least 90% identity to a consensus amino acid sequence in the group of consensus amino acid sequences consisting of the consensus amino acid sequence constructed for SEQ ID NO:84 and homologs thereof listed in Table 2 through the consensus amino acid sequence constructed for SEQ ID NO:166 and homologs thereof listed in Table 2. In even more specific embodiments of the invention the protein expressed in plant cells is a protein selected from the group of proteins identified in Table 1.

Other aspects of the invention are specifically directed to transgenic plant cells comprising the recombinant DNA of the invention, transgenic plants comprising a plurality of such plant cells, progeny transgenic seed and transgenic pollen from such plants. Such plant cells are selected from a population of transgenic plants regenerated from plant cells transformed with recombinant DNA and that express the protein by screening transgenic plants in the population for an enhanced trait as compared to control plants that do not have said recombinant DNA, where the enhanced trait is selected from group of enhanced traits consisting of enhanced water use efficiency, enhanced cold tolerance, increased yield, enhanced nitrogen use efficiency, enhanced seed protein and enhanced seed oil.

In yet another aspect of the invention the plant cells, plants, seeds and pollen further comprise DNA expressing a protein that provides tolerance from exposure to an herbicide applied at levels that are lethal to a wild type of said plant cell. Such tolerance is especially useful not only as a advantageous trait in such plants but is also useful in a selection step in the methods of the invention. In aspects of the invention the agent of such herbicide is a glyphosate, dicamba, or glufosinate compound.

Yet other aspects of the invention provide transgenic plants which are homozygous for the recombinant DNA and transgenic seed of the invention from corn, soybean, cotton, canola, alfalfa, wheat or rice plants. In other important embodiments for practice of various aspects of the invention in *Argentina* the recombinant DNA is provided in plant cells derived from corn lines that that are and maintain resistance to the Mal de Rio Cuarto virus or the *Puccina sorghi* fungus or both.

This invention also provides methods for manufacturing non-natural, transgenic seed that can be used to produce a crop of transgenic plants with an enhanced trait resulting from expression of stably-integrated, recombinant DNA for expressing a protein having at least one domain of amino acids in a sequence that exceeds the Pfam gathering cutoff for amino acid sequence alignment with a protein domain family identified by a Pfam name in the group of Pfam names identified in Table 28. More specifically the method comprises (a) screening a population of plants for an enhanced trait and a recombinant DNA, where individual plants in the population can exhibit the trait at a level less than, essentially the same as or greater than the level that the trait is exhibited in control plants which do not express the recombinant DNA, (b) selecting from the population one or more plants that exhibit the trait at a level greater than the level that said trait is exhibited in control plants, (c) verifying that the recombinant DNA is stably integrated in said selected plants, (d) analyzing tissue of a selected plant to determine the production of a protein having the function of a protein encoded by nucleotides in a sequence of one of SEQ ID NO:1-83; and (e) collecting seed from a selected plant. In one aspect of the invention the plants in the population further comprise DNA expressing a protein that provides tolerance to exposure to an herbicide applied at levels that are lethal to wild type plant cells and the selecting is effected by treating the population with the herbicide, e.g. a glyphosate, dicamba, or glufosinate compound. In another aspect of the invention the plants are selected by identifying plants with the enhanced trait. The methods are especially useful for manufacturing corn, soybean, cotton, alfalfa, wheat or rice seed.

Another aspect of the invention provides a method of producing hybrid corn seed comprising acquiring hybrid corn seed from a herbicide tolerant corn plant which also has stably-integrated, recombinant DNA comprising a promoter that is (a) functional in plant cells and (b) is operably linked to DNA that encodes a protein having at least one domain of amino acids in a sequence that exceeds the Pfam gathering cutoff for amino acid sequence alignment with a protein domain family identified by a Pfam name in the group of Pfam names identified in Table 28. The methods further comprise producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

Another aspect of the invention provides a method of selecting a plant comprising plant cells of the invention by using an immunoreactive antibody to detect the presence of protein expressed by recombinant-DNA in seed or plant tissue. Yet another aspect of the invention provides anti-counterfeit milled seed having, as an indication of origin, a plant cells of this invention.

Still other aspects of this invention relate to transgenic plants with enhanced water use efficiency or enhanced nitrogen use efficiency. For instance, this invention provides methods of growing a corn, cotton or soybean crop without irrigation water comprising planting seed having plant cells of the invention which are selected for enhanced water use efficiency. Alternatively methods comprise applying reduced irrigation water, e.g. providing up to 300 millimeters of ground water during the production of a corn crop. This invention also provides methods of growing a corn, cotton or soybean crop without added nitrogen fertilizer comprising planting seed having plant cells of the invention which are selected for enhanced nitrogen use efficiency.

BRIEF DESCRIPTION OF THE DRAWINGS

FIGS. 1A-1G and 2A-2G are alignments of amino acid sequences.

DETAILED DESCRIPTION OF THE INVENTION

Figure 1C:

As used herein a "plant cell" means a plant cell that is transformed with stably-integrated, non-natural, recombinant DNA, e.g. by *Agrobacterium*-mediated transformation or by baombardment using microparticles coated with recombinant DNA or other means. A plant cell of this invention can be an originally-transformed plant cell that exists as a microorganism or as a progeny plant cell that is regenerated into differentiated tissue, e.g. into a transgenic plant with stably-integrated, non-natural recombinant DNA, or seed or pollen derived from a progeny transgenic plant.

As used herein a "transgenic plant" means a plant whose genome has been altered by the stable integration of recombinant DNA. A transgenic plant includes a plant regenerated from an originally-transformed plant cell and progeny transgenic plants from later generations or crosses of a transformed plant.

As used herein "recombinant DNA" means DNA which has been a genetically engineered and constructed outside of a cell including DNA containing naturally occurring DNA or cDNA or synthetic DNA.

As used herein "consensus sequence" means an artificial sequence of amino acids in a conserved region of an alignment of amino acid sequences of homologous proteins, e.g. as determined by a CLUSTALW alignment of amino acid sequence of homolog proteins.

As used herein "homolog" means a protein in a group of proteins that perform the same biological function, e.g. proteins that belong to the same Pfam protein family and that provide a common enhanced trait in transgenic plants of this invention. Homologs are expressed by homologous genes. Homologous genes include naturally occurring alleles and artificially-created variants. Degeneracy of the genetic code provides the possibility to substitute at least one base of the protein encoding sequence of a gene with a different base without causing the amino acid sequence of the polypeptide produced from the gene to be changed. Hence, a polynucleotide useful in the present invention may have any base sequence that has been changed from SEQ ID NO:1 through SEQ ID NO:83 by substitution in accordance with degeneracy of the genetic code. Homologs are proteins that, when optimally aligned, have at least 60% identity, more preferably about 70% or higher, more preferably at least 80% and even more preferably at least 90% identity over the full length of a protein identified as being associated with imparting an enhanced trait when expressed in plant cells. Homologs include proteins with an amino acid sequence that has at least 90% identity to a consensus amino acid sequence of proteins and homologs disclosed herein.

Homologs are be identified by comparison of amino acid sequence, e.g. manually or by use of a computer-based tool using known homology-based search algorithms such as those commonly known and referred to as BLAST, FASTA, and Smith-Waterman. A local sequence alignment program, e.g. BLAST, can be used to search a database of sequences to find similar sequences, and the summary Expectation value (E-value) used to measure the sequence base similarity. As a protein hit with the best E-value for a particular organism may not necessarily be an ortholog or the only ortholog, a reciprocal query is used in the present invention to filter hit sequences with significant E-values for ortholog identification. The reciprocal query entails search of the significant hits against a database of amino acid sequences from the base organism that are similar to the sequence of the query protein. A hit is a likely ortholog, when the reciprocal query's best hit is the query protein itself or a protein encoded by a duplicated gene after speciation. A further aspect of the invention comprises functional homolog proteins that differ in one or more amino acids from those of disclosed protein as the result of conservative amino acid substitutions, for example substitutions are among: acidic (negatively charged) amino acids such as aspartic acid and glutamic acid; basic (positively charged) amino acids such as arginine, histidine, and lysine; neutral polar amino acids such as glycine, serine, threonine, cysteine, tyrosine, asparagine, and glutamine; neutral nonpolar (hydrophobic) amino acids such as alanine, leucine, isoleucine, valine, proline, phenylalanine, tryptophan, and methionine; amino acids having aliphatic side chains such as glycine, alanine, valine, leucine, and isoleucine; amino acids having aliphatic-hydroxyl side chains such as serine and threonine; amino acids having amide-containing side chains such as asparagine and glutamine; amino acids having aromatic side chains such as phenylalanine, tyrosine, and tryptophan; amino acids having basic side chains such as lysine, arginine, and histidine; amino acids having sulfur-containing side chains such as cysteine and methionine; naturally conservative amino acids such as valine-leucine, valine-isoleucine, phenylalanine-tyrosine, lysine-arginine, alanine-valine, aspartic acid-glutamic acid, and asparagine-glutamine. A further aspect of the homologs encoded by DNA useful in the transgenic plants of the invention are those proteins that differ from a disclosed protein as the result of deletion or insertion of one or more amino acids in a native sequence.

As used herein, "percent identity" means the extent to which two optimally aligned DNA or protein segments are invariant throughout a window of alignment of components, for example nucleotide sequence or amino acid sequence. An "identity fraction" for aligned segments of a test sequence and a reference sequence is the number of identical components that are shared by sequences of the two aligned segments divided by the total number of sequence components in the reference segment over a window of alignment which is the smaller of the full test sequence or the full reference sequence. "Percent identity" ("% identity") is the identity fraction times 100.

As used herein "Pfam" refers to a large collection of multiple sequence alignments and hidden Markov models covering many common protein families, e.g. Pfam version 18.0 (August 2005) contains alignments and models for 7973 protein families and is based on the Swissprot 47.0 and SP-TrEMBL 30.0 protein sequence databases. See S. R. Eddy, "Profile Hidden Markov Models", *Bioinformatics* 14:755-763, 1998. Pfam is currently maintained and updated by a Pfam Consortium. The alignments represent some evolutionary conserved structure that has implications for the protein's function. Profile hidden Markov models (profile HMMs) built from the Pfam alignments are useful for automatically recognizing that a new protein belongs to an existing protein family even if the homology by alignment appears to be low. Once one DNA is identified as encoding a protein which imparts an enhanced trait when expressed in transgenic plants, other DNA encoding proteins in the same protein family are identified by querying the amino acid sequence of protein encoded by candidate DNA against the Hidden Markov Model which characterizes the Pfam domain using HMMER software, a current version of which is provided in the appended computer listing. Candidate proteins meeting the gathering cutoff for the alignment of a particular Pfam are in the protein family and have cognate DNA that is useful in constructing recombinant DNA for the use in the plant cells of this invention. Hidden Markov Model databases for use with HMMER software in identifying DNA expressing protein in a common Pfam for recombinant DNA in the plant cells of this invention are also included in the appended computer listing. The HMMER software and Pfam databases are version 18.0 and were used to identify known domains in the proteins corresponding to amino acid sequence of SEQ ID NO:84 through SEQ ID NO:166. All DNA encoding proteins that have scores higher than the gathering cutoff disclosed in Table 27 by Pfam analysis disclosed herein can be used in recombinant DNA of the plant cells of this invention, e.g. for selecting transgenic plants having enhanced agronomic traits. The relevant Pfams for use in this invention, as more specifically disclosed below, are AAA, AP2, Aldo ket red, Alpha-amylase, Aminotran 1 2, Ank, ArfGap, Asn synthase, BRO1, CBFD NFYB HMF, Catalase, CorA, Cpn60 TCP1, Cystatin, DNA photolyase, DSPc, DUF1685, DUF296, Di19, E2F TDP, FAD binding 7, FA desaturase, FBPase, GAF, GATA, GATase 2, Glyco hydro 1, Glyoxalase, Got1, HATPase c, HSF DNA-bind, HSP20, HisKA, Homeobox, Hpt, Isoamylase N, K-box, Lactamase B, Metallophos, MtN3 slv, NAF, NAM, NIF, Oxidored FMN, PAS, PDZ, PRA1, Peptidase C15, Peptidase S10, Peptidase S41, Phytochrome, Peinase, Pkinase Tyr, Pyridoxal deC, RIO1, RRM 1, RTC, RTC insert, Ras, Response reg, SPC25, SPX, SRF-TF, Synaptobrevin, UPF0057, zf-C2H2, and zf-C3HC4, the databases for which are included in the appended computer listing.

As used herein "promoter" means regulatory DNA for initializing transcription. A "plant promoter" is a promoter capable of initiating transcription in plant cells whether or not its origin is a plant cell, e.g. is it well known that *Agrobacterium* promoters are functional in plant cells. Thus, plant promoters include promoter DNA obtained from plants, plant viruses and bacteria such as *Agrobacterium* and *Bradyrhizobium* bacteria. Examples of promoters under developmental control include promoters that preferentially initiate transcription in certain tissues, such as leaves, roots, or seeds. Such promoters are referred to as "tissue preferred". Promoters that initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions, or certain chemicals, or the presence of light. Tissue specific, tissue preferred, cell type specific, and inducible promoters constitute the class of "non-constitutive" promoters. A "constitutive" promoter is a promoter which is active under most conditions.

As used herein "operably linked" means the association of two or more DNA fragments in a DNA construct so that the function of one, e.g. protein-encoding DNA, is controlled by the other, e.g. a promoter.

As used herein "expressed" means produced, e.g. a protein is expressed in a plant cell when its cognate DNA is transcribed to mRNA that is translated to the protein.

As used herein a "control plant" means a plant that does not contain the recombinant DNA that expressed a protein that impart an enhanced trait. A control plant is to identify and select a transgenic plant that has an enhance trait. A suitable control plant can be a non-transgenic plant of the parental line used to generate a transgenic plant, i.e. devoid of recombinant DNA. A suitable control plant may in some cases be a progeny of a hemizygous transgenic plant line that is does not contain the recombinant DNA, known as a negative sergeant.

As used herein an "enhanced trait" means a characteristic of a transgenic plant that includes, but is not limited to, an enhance agronomic trait characterized by enhanced plant morphology, physiology, growth and development, yield, nutritional enhancement, disease or pest resistance, or environmental or chemical tolerance. In more specific aspects of this invention enhanced trait is selected from group of enhanced traits consisting of enhanced water use efficiency, enhanced cold tolerance, increased yield, enhanced nitrogen use efficiency, enhanced seed protein and enhanced seed oil. In an important aspect of the invention the enhanced trait is enhanced yield including increased yield under non-stress conditions and increased yield under environmental stress conditions. Stress conditions may include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, pod number, pod position on the plant, number of intemodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also affected by efficiency of germination (including germination in stressed conditions), growth rate (including growth rate in stressed conditions), ear number, seed number per ear, seed size, composition of seed (starch, oil, protein) and characteristics of seed fill.

Increased yield of a transgenic plant of the present invention can be measured in a number of ways, including test weight, seed number per plant, seed weight, seed number per unit area (i.e. seeds, or weight of seeds, per acre), bushels per acre, tonnes per acre, tons per acre, kilo per hectare. For example, maize yield may be measured as production of shelled corn kernels per unit of production area, for example in bushels per acre or metric tons per hectare, often reported on a moisture adjusted basis, for example at 15.5 percent moisture. Increased yield may result from improved utilization of key biochemical compounds, such as nitrogen, phosphorous and carbohydrate, or from improved responses to environmental stresses, such as cold, heat, drought, salt, and attack by pests or pathogens. Recombinant DNA used in this invention can also be used to provide plants having improved growth and development, and ultimately increased yield, as the result of modified expression of plant growth regulators or modification of cell cycle or photosynthesis pathways. Also of interest is the generation of transgenic plants that demonstrate enhanced yield with respect to a seed component that may or may not correspond to an increase in overall plant yield. Such properties include enhancements in seed oil, seed molecules such as tocopherol, protein and starch, or oil particular oil components as may be manifest by an alterations in the ratios of seed components.

A subset of the nucleic molecules of this invention includes fragments of the disclosed recombinant DNA consisting of oligonucleotides of at least 15, preferably at least 16 or 17, more preferably at least 18 or 19, and even more preferably at least 20 or more, consecutive nucleotides. Such oligonucleotides are fragments of the larger molecules having a sequence selected from the group consisting of SEQ ID NO:1 through SEQ ID NO:83, and find use, for example as probes and primers for detection of the polynucleotides of the present invention.

In some embodiments of the present invention, a dominant negative mutant of a native gene is generated to achieve the desired effect. As used herein, "dominant negative mutant" means a mutant gene whose gene product adversely affects the normal, wild-type gene product within the same cell, usually by dimerizing (combining) with it. In cases of polymeric molecules, such as collagen, dominant negative mutations are often more deleterious than mutations causing the production of no gene product (null mutations or null alleles). SEQ ID NO: 6 and SEQ ID NO: 7 are constructed to encode agl11 protein with K-box deleted and MADs 3 protein with MAD box deleted, respectively. MADS box proteins similar to AGL11 can be considered as having three functional domains. There is an N-terminal DNA-binding domain (the MADS box), a more distal dimerization domain (the K-box) and a C-terminal domain that is usually involved in interactions with other proteins. In plants the region between the MADS box and the K-box has been shown to be important for DNA binding in some proteins and is often referred to as the I-box (Fan et al., 1997). Several different classes of dominant negative constructs are considered. Deletion or inactivation of the DNA-binding domain can create proteins that are able to dimerize with their native full length counterparts as well as other natural dimerization partners. Likewise, removal of the C-terminal domain can allow dimerization with both the native protein and it's natural dimerization partners. In both cases these types of constructs disable both the target protein and any other protein capable of interacting with the K-box.

In other embodiments of the invention a constitutively active mutant is constructed to achieve the desired effect. SEQ ID NO:3 encodes only the kinase domain from a calcium-dependent protein kinase (CDPK). CDPK1 has a domain structure similar to other calcium-dependant protein kinases in which the protein kinase domain is separated from four efhand domains by 42 amino acid "spacer" region. Calcium-dependant protein kinases are thought to be activated by a calcium-induced conformational change that results in movement of an autoinhibitory domain away from the protein kinase active site (Yokokura et al., 1995). Thus, constitutively active proteins can be made by over expressing the protein kinase domain alone.

DNA constructs are assembled using methods well known to persons of ordinary skill in the art and typically comprise a promoter operably linked to DNA, the expression of which provides the enhanced agronomic trait. Other construct components may include additional regulatory elements, such as 5' leasders and introns for enhancing transcription, 3' untranslated regions (such as polyadenylation signals and sites), DNA for transit or signal peptides.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens*, caulimovirus promoters such as the cauliflower mosaic virus. For instance, see U.S. Pat. Nos. 5,858,742 and 5,322,938, which disclose versions of the constitutive promoter derived from cauliflower mosaic virus (CaMV35S), U.S. Pat. No. 5,641,876, which discloses a rice actin promoter, U.S. Patent Application Publication 2002/0192813A1, which discloses 5', 3' and intron elements useful in the design of effective plant expression vectors, U.S. patent application Ser. No. 09/757,089, which discloses a maize chloroplast aldolase promoter, U.S. patent application Ser. No. 08/706,946, which discloses a rice glutelin promoter, U.S. patent application Ser. No. 09/757,089, which discloses a maize aldolase (FDA) promoter, and U.S. patent application Ser. No. 60/310,370, which discloses a maize nicotianamine synthase promoter, all of which are incorporated herein by reference.

These and numerous other promoters that function in plant cells are known to those skilled in the art and available for use in recombinant polynucleotides of the present invention to provide for expression of desired genes in transgenic plant cells.

In some aspects of the invention, sufficient expression in plant seed tissues is desired to effect improvements in seed composition. Exemplary promoters for use for seed composition modification include promoters from seed genes such as napin (U.S. Pat. No. 5,420,034), zein Z27 and glutelin1 (Russell et al. (1997) *Transgenic Res.* 6(2):157-166), and peroxiredoxin antioxidant (Per1) (Stacy et al. (1996) *Plant Mol Biol.* 31(6):1205-1216), maize L3 oleosin (U.S. Pat. No. 6,433,252), globulin 1 (Belanger et al (1991) Genetics 129:863-872).

In other aspects of the invention, preferential expression in plant green tissues is desired. Promoters of interest for such uses include those from genes such as *Arabidopsis thaliana* ribulose-1,5-bisphosphate carboxylase (Rubisco) small subunit (Fischhoff et al. (1992) *Plant Mol Biol.* 20:81-93), aldolase and pyruvate orthophosphate dikinase (PPDK) (Taniguchi et al. (2000) *Plant Cell Physiol.* 41(1): 42-48).

Furthermore, the promoters may be altered to contain multiple "enhancer sequences" to assist in elevating gene expression. Such enhancers are known in the art. By including an enhancer sequence with such constructs, the expression of the selected protein may be enhanced. These enhancers often are found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene.

In other aspects of the invention, sufficient expression in plant seed tissues is desired to effect improvements in seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al. (1997) *Transgenic Res.* 6(2):157-166), globulin 1 (Belanger et al (1991) Genetics 129:863-872), glutelin 1 (Russell (1997) supra), and peroxiredoxin antioxidant (Per1) (Stacy et al. (1996) *Plant Mol Biol.* 31(6):1205-1216).

Recombinant DNA constructs prepared in accordance with the invention will also generally include a 3' element that typically contains a polyadenylation signal and site. Well-known 3' elements include those from *Agrobacterium tumefaciens* genes such as nos 3', tml 3', tmr 3', tms 3', ocs 3', tr7 3', for example disclosed in U.S. Pat. No. 6,090,627, incorporated herein by reference; 3' elements from plant genes such as wheat (*Triticum aesevitum*) heat shock protein 17 (Hsp17 3'), a wheat ubiquitin gene, a wheat fructose-1, 6-biphosphatase gene, a rice glutelin gene a rice lactate dehydrogenase gene and a rice beta-tubulin gene, all of which are disclosed in U.S. published patent application 2002/0192813 A1, incorporated herein by reference; and the pea (*Pisum sativum*) ribulose biphosphate carboxylase gene (rbs 3), and 3' elements from the genes within the host plant.

Constructs and vectors may also include a transit peptide for targeting of a gene target to a plant organelle, particularly to a chloroplast, leucoplast or other plastid organelle. For descriptions of the use of chloroplast transit peptides see U.S. Pat. No. 5,188,642 and U.S. Pat. No. 5,728,925, incorporated herein by reference. For description of the transit peptide region of an *Arabidopsis* EPSPS gene useful in the present invention, see Klee, H. J. et al (MGG (1987) 210:437-442).

Transgenic plants comprising or derived from plant cells of this invention transformed with recombinant DNA can be further enhanced with stacked traits, e.g. a crop plant having an enhanced trait resulting from expression of DNA disclosed herein in combination with herbicide and/or pest resistance traits. For example, genes of the current invention can be stacked with other traits of agronomic interest, such as a trait providing herbicide resistance, or insect resistance, such as using a gene from *Bacillus thuringensis* to provide resistance against lepidopteran, coliopteran, homopteran, hemiopteran, and other insects. Herbicides for which transgenic plant tolerance has been demonstrated and the method of the present invention can be applied include, but are not limited to, glyphosate, dicamba, glufosinate, sulfonylurea, bromoxynil and norflurazon herbicides. Polynucleotide molecules encoding proteins involved in herbicide tolerance are well-known in the art and include, but are not limited to, a polynucleotide molecule encoding 5-enolpyruvylshikimate-3-phosphate synthase (EPSPS) disclosed in U.S. Pat. Nos. 5,094,945; 5,627,061; 5,633,435 and 6,040,497 for imparting glyphosate tolerance; polynucleotide molecules encoding a glyphosate oxidoreductase (GOX) disclosed in U.S. Pat. No. 5,463,175 and a glyphosate-N-acetyl transferase (GAT) disclosed in U.S. Patent Application publication 2003/0083480 A1 also for imparting glyphosate tolerance; dicamba monooxygenase disclosed in U.S. Patent Application publication 2003/0135879 A1 for imparting dicamba tolerance; a polynucleotide molecule encoding bromoxynil nitrilase (Bin) disclosed in U.S. Pat. No. 4,810,648 for imparting bromoxynil tolerance; a polynucleotide molecule encoding phytoene desaturase (crtl) described in Misawa et al, (1993) *Plant J.* 4:833-840 and Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:2188-2193 for imparting tolerance to sulfonylurea herbicides; polynucleotide molecules known as bar genes disclosed in DeBlock, et al. (1987) *EMBO J.* 6:2513-2519 for imparting glufosinate and bialaphos tolerance; polynucleotide molecules disclosed in U.S. Patent Application Publication 2003/010609 A1 for imparting N-amino methyl phosphonic acid tolerance; polynucleotide molecules disclosed in U.S. Pat. No. 6,107,549 for impartinig pyridine herbicide resistance; molecules and methods for imparting tolerance to multiple herbicides such as glyphosate, atrazine, ALS inhibitors, isoxoflutole and glufosinate herbicides are disclosed in U.S. Pat. No. 6,376,754 and U.S. Patent Application Publication 2002/0112260, all of said U.S. patents and Patent Application Publications are incorporated herein by reference. Molecules and methods for imparting insect/nematode/virus resistance is disclosed in U.S. Pat. Nos. 5,250,515; 5,880,275; 6,506,599; 5,986,175 and U.S. Patent Application Publication 2003/0150017 A1, all of which are incorporated herein by reference.

In particular embodiments, the inventors contemplate the use of antibodies, either monoclonal or polyclonal which bind to the proteins disclosed herein. Means for preparing and characterizing antibodies are well known in the art (See, e.g., Antibodies: A Laboratory Manual, Cold Spring Harbor Laboratory, 1988; incorporated herein by reference). The methods for generating monoclonal antibodies (mAbs) generally begin along the same lines as those for preparing polyclonal antibodies. Briefly, a polyclonal antibody is prepared by immunizing an animal with an immunogenic composition in accordance with the present invention and collecting antisera from that immunized animal. A wide range of animal species can be used for the production of antisera. Typically the animal used for production of anti-antisera is a rabbit, a mouse, a rat, a hamster, a guinea pig or a goat. Because of the relatively large blood volume of rabbits, a rabbit is a preferred choice for production of polyclonal antibodies.

As is well known in the art, a given composition may vary in its immunogenicity. It is often necessary therefore to boost the host immune system, as may be achieved by coupling a peptide or polypeptide immunogen to a carrier. Exemplary and preferred carriers are keyhole limpet hemocyanin (KLH) and bovine serum albumin (BSA). Other albumins such as ovalbumin, mouse serum albumin or rabbit serum albumin can also be used as carriers. Means for conjugating a polypeptide to a carrier protein are well known in the art and include using glutaraldehyde, m-maleimidobencoyl-N-hydroxysuccinimide ester, carbodiimide and bis-biazotized benzidine.

As is also well known in the art, the immunogenicity of a particular immunogen composition can be enhanced by the use of non-specific stimulators of the immune response, known as adjuvants. Exemplary and preferred adjuvants include complete Freund's adjuvant (a non-specific stimulator of the immune response containing killed *Mycobacterium tuberculosis*), incomplete Freund's adjuvants and aluminum hydroxide adjuvant.

The amount of immunogen composition used in the production of polyclonal antibodies varies upon the nature of the immunogen as well as the animal used for immunization. A variety of routes can be used to administer the immunogen (subcutaneous, intramuscular, intradermal, intravenous and intraperitoneal). The production of polyclonal antibodies may be monitored by sampling blood of the immunized animal at various points following immunization. A second, booster, injection may also be given. The process of boosting and titering is repeated until a suitable titer is achieved. When a desired level of immunogenicity is obtained, the immunized animal can be bled and the serum isolated and stored, and/or the animal can be used to generate mAbs.

mAbs may be readily prepared through use of well-known techniques, such as those exemplified in U.S. Pat. No. 4,196,265, incorporated herein by reference. Typically, this technique involves immunizing a suitable animal with a selected immunogen composition, e.g., a purified or partially purified antifungal protein, polypeptide or peptide. The immunizing composition is administered in a manner effective to stimulate antibody producing cells. Rodents such as mice and rats are preferred animals, however, the use of rabbit, sheep, or frog cells is also possible. The use of rats may provide certain advantages (Goding, 1986, pp. 60-61), but mice are preferred, with the BALB/c mouse being most preferred as this is most routinely used and generally gives a higher percentage of stable fusions.

Following immunization, somatic cells with the potential for producing antibodies, specifically B lymphocytes (B cells), are selected for use in the mAb generating protocol. These cells may be obtained from biopsied spleens, tonsils or lymph nodes, or from a peripheral blood sample. Spleen cells and peripheral blood cells are preferred, the former because they are a rich source of antibody-producing cells that are in the dividing plasmablast stage, and the latter because peripheral blood is easily accessible. Often, a panel of animals will have been immunized and the spleen of animal with the highest antibody titer will be removed and the spleen lymphocytes obtained by homogenizing the spleen with a syringe. Typically, a spleen from an immunized mouse contains approximately $5\times10^7$ to $2\times10^8$ lymphocytes.

The antibody-producing B lymphocytes from the immunized animal are then fused with cells of an immortal myeloma cell, generally one of the same species as the animal that was immunized. Myeloma cell lines suited for use in hybridoma-producing fusion procedures preferably are non-antibody-producing, have high fusion efficiency, and enzyme deficiencies that render them incapable of growing in certain selective media which support the growth of only the desired fused cells (hybridomas).

Any one of a number of myeloma cells may be used, as are known to those of skill in the art (Goding, 1986, pp. 65-66; Campbell, 1984, pp. 75-83). For example, where the immunized animal is a mouse, one may use P3-X63/Ag8, X63-Ag8.653, NSI/1.Ag 41, Sp210-Ag14, FO, NSO/U, MPC-11, MPC11-X45-GTG 1.7 and S194/5XX0 Bul; for rats, one may use R210.RCY3, Y3-Ag 1.2.3, IR983F and 4B210; and U-266, GM1500-GRG2, LICR-LON-HMy2 and UC729-6 are all useful in connection with human cell fusions.

One preferred murine myeloma cell is the NS-1 myeloma cell line (also termed P3-NS-1-Ag4-1), which is readily available from the NIGMS Human Genetic Mutant Cell Repository by requesting cell line repository number GM3573. Another mouse myeloma cell line that may be used is the 8-azaguanine-resistant mouse murine myeloma SP2/0 non-producer cell line.

Methods for generating hybrids of antibody-producing spleen or lymph node cells and myeloma cells usually comprise mixing somatic cells with myeloma cells in a 2:1 ratio, though the ratio may vary from about 20:1 to about 1:1, respectively, in the presence of an agent or agents (chemical or electrical) that promote the fusion of cell membranes. Fusion methods using Spend virus have been described (Kohler and Milstein, 1975; 1976), and those using polyethylene glycol (PEG), such as 37% (v/v) PEG, (Gefter et al., 1977). The use of electrically induced fusion methods is also appropriate (Goding, 1986, pp. 71-74).

Fusion procedures usually produce viable hybrids at low frequencies, about $1\times10^{-6}$ to $1\times10^{-8}$. However, this does not pose a problem, as the viable, fused hybrids are differentiated from the parental, unfused cells (particularly the unfused myeloma cells that would normally continue to divide indefinitely) by culturing in a selective medium. The selective medium is generally one that contains an agent that blocks the de novo synthesis of nucleotides in the tissue culture media. Exemplary and preferred agents are aminopterin, methotrexate, and azaserine. Aminopterin and methotrexate block de novo synthesis of both purines and pyrimidines, whereas azasenne blocks only purine synthesis. Where aminopterin or methotrexate is used, the media is supplemented with hypoxanthine and thymidine as a source of nucleotides (HAT medium). Where azaserine is used, the media is supplemented with hypoxanthine.

The preferred selection medium is HAT. Only cells capable of operating nucleotide salvage pathways are able to survive in HAT medium. The myeloma cells are defective in key enzymes of the salvage pathway, e.g., hypoxanthine phosphoribosyl transferase (HPRT), and they cannot survive. The B-cells can operate this pathway, but they have a limited life span in culture and generally die within about two weeks. Therefore, the only cells that can survive in the selective media are those hybrids formed from myeloma and B-cells.

This culturing provides a population of hybridomas from which specific hybridomas are selected. Typically, selection of hybridomas is performed by culturing the cells by single-clone dilution in microtiter plates, followed by testing the individual clonal supernatants (after about two to three weeks) for the desired reactivity. The assay should be sensitive, simple and rapid, such as radioimmunoassays, enzyme immunoassays, cytotoxicity assays, plaque assays, dot immunobinding assays, and the like.

The selected hybridomas would then be serially diluted and cloned into individual antibody-producing cell lines, which clones can then be propagated indefinitely to provide mAbs. The cell lines may be exploited for mAb production in two basic ways. A sample of the hybridoma can be injected (often into the peritoneal cavity) into a histocompatible animal of the type that was used to provide the somatic and myeloma cells for the original fusion. The injected animal develops tumors secreting the specific monoclonal antibody produced by the fused cell hybrid. The body fluids of the animal, such as serum or ascites fluid, can then be tapped to provide mAbs in high concentration. The individual cell lines could also be cultured in vitro, where the mAbs are naturally secreted into the culture medium from which they can be readily obtained in high concentrations. mAbs produced by either means may be further purified, if desired, using filtration, centrifugation and various chromatographic methods such as HPLC or affinity chromatography.

Plant Cell Transformation Methods

Numerous methods for transforming plant cells with recombinant DNA are known in the art and may be used in the present invention. Two commonly used methods for plant transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn) and U.S. Pat. No. 6,153,812 (wheat) and *Agrobacterium*-mediated transformation is described in U.S. Pat. No. 5,159,135 (cotton); U.S. Pat. No. 5,824,877 (soybean); U.S. Pat. No. 5,591,616 (corn); and U.S. Pat. No. 6,384,301 (soybean), all of which are incorporated herein by reference. For *Agrobacterium tumefaciens* based plant transformation system, additional elements present on transformation constructs will include T-DNA left and right border sequences to facilitate incorporation of the recombinant polynucleotide into the plant genome.

In general it is useful to introduce recombinant DNA randomly, i.e. at a non-specific location, in the genome of a target plant line. In special cases it may be useful to target recombinant DNA insertion in order to achieve site-specific integration, for example to replace an existing gene in the genome, to use an existing promoter in the plant genome, or to insert a recombinant polynucleotide at a predetermined site known to be active for gene expression. Several site specific recombination systems exist which are known to function implants include cre-lox as disclosed in U.S. Pat. No. 4,959,317 and FLP-FRT as disclosed in U.S. Pat. No. 5,527,695, both incorporated herein by reference.

Transformation methods of this invention are preferably practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos and gametic cells such as microspores, pollen, sperm and egg cells. It is contemplated that any cell from which a fertile plant may be regenerated is useful as a recipient cell. Callus may be initiated from tissue sources including, but not limited to, immature embryos, seedling apical meristems, microspores and the like. Cells capable of proliferating as callus are also recipient cells for genetic transformation. Practical transformation methods and materials for making transgenic plants of this invention, for example various media and recipient target cells, transformation of immature embryo cells and subsequent regeneration of fertile transgenic plants are disclosed in U.S. Pat. Nos. 6,194,636 and 6,232,526, which are incorporated herein by reference.

The seeds of transgenic plants can be harvested from fertile transgenic plants and be used to grow progeny generations of transformed plants of this invention including hybrid plants line for selection of plants having an enhanced trait. In addition to direct transformation of a plant with a recombinant DNA, transgenic plants can be prepared by crossing a first plant having a recombinant DNA with a second plant lacking the DNA. For example, recombinant DNA can be introduced into first plant line that is amenable to transformation to produce a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line In the practice of transformation DNA is typically introduced into only a small percentage of target plant cells in any one transformation experiment. Marker genes are used to provide an efficient system for identification of those cells that are stably transformed by receiving and integrating a transgenic DNA construct into their genomes. Preferred marker genes provide selective markers which confer resistance to a selective agent, such as an antibiotic or herbicide. Any of the herbicides to which plants of this invention may be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells may be tested further to confirm stable integration of the exogenous DNA. Commonly used selective marker genes include those conferring resistance to antibiotics such as kanamycin and paromomycin (nptII), hygromycin B (aph IV) and gentamycin (aac3 and aacC4) or resistance to herbicides such as glufosinate (bar or pat) and glyphosate (aroA or EPSPS). Examples of such selectable are illustrated in U.S. Pat. Nos. 5,550,318; 5,633,435; 5,780,708 and 6,118,047, all of which are incorporated herein by reference. Selectable markers which provide an ability to visually identify transformants can also be employed, for example, a gene expressing a colored or fluorescent protein such as a luciferase or green fluorescent protein (GFP) or a gene expressing a beta-glucuronidase or uidA gene (GUS) for which various chromogenic substrates are known.

Plant cells that survive exposure to the selective agent, or plant cells that have been scored positive in a screening assay, may be cultured in regeneration media and allowed to mature into plants. Developing plantlets regenerated from transformed plant cells can be transferred to plant growth mix, and hardened off, for example, in an environmentally controlled chamber at about 85% relative humidity, 600 ppm $CO_2$, and 25-250 microeinsteins $m^{-2}$ $s^{-1}$ of light, prior to transfer to a greenhouse or growth chamber for maturation. Plants are regenerated from about 6 weeks to 10 months after a transformant is identified, depending on the initial tissue. Plants may be pollinated using conventional plant breeding methods known to those of skill in the art and seed produced, for example self-pollination is commonly used with transgenic corn. The regenerated transformed plant or its progeny seed or plants can be tested for expression of the recombinant DNA and selected for the presence of enhanced agronomic trait.

Transgenic Plants and Seeds

Transgenic plants derived from the plant cells of this invention are grown to generate transgenic plants having an enhanced trait as compared to a control plant and produce transgenic seed and haploid pollen of this invention. Such plants with enhanced traits are identified by selection of transformed plants or progeny seed for the enhanced trait. For efficiency a selection method is designed to evaluate multiple transgenic plants (events) comprising the recombinant DNA, for example multiple plants from 2 to 20 or more transgenic events. Transgenic plants grown from transgenic seed provided herein demonstrate improved agronomic traits that contribute to increased yield or other trait that provides increased plant value, including, for example, improved seed quality. Of particular interest are plants having enhanced water use efficiency, enhanced cold tolerance, increased yield, enhanced nitrogen use efficiency, enhanced seed protein and enhanced seed oil.

Table 1 provides a list of protein encoding DNA ("genes") that are useful as recombinant DNA for production of transgenic plants with enhanced agronomic trait, the elements of Table 1 are described by reference to:

"PEP SEQ" which identifies an amino acid sequence from SEQ ID NO:84 to 166.

"NUC SEQ" which identifies a DNA sequence from SEQ ID NO:1 to 83.

"Base Vector" which identifies a base plasmid used for transformation of the recombinant DNA.

"PROTEIN NAME" which is a common name for protein encoded by the recombinant DNA.

"Enhanced trait" which identifies an enhanced trait which is imparted by the expression of the protein in a transgenic crop plant.

"Plasmid ID" which identifies an arbitrary name for the plant transformation plasmid comprising recombinant DNA for expressing the recombinant DNA in plant cells.

TABLE 1

| PEP SEQ ID NO | NUC SEQ ID NO | Base Vector | PROTEIN NAME | Enhanced trait(s) | Plasmid ID |
|---|---|---|---|---|---|
| 84 | 1 | pMON65154 | lactoylglutathione lyase | Enhanced seed protein | pMON69462 |
| 85 | 2 | pMON72472 | rab7c | Enhanced cold tolerance | pMON69456 |
| 86 | 3 | pMON65154 | CDPK kinase domain | Enhanced water use efficiency | pMON67754 |
| 87 | 4 | pMON72472 | SCOF-1 | Enhanced water use efficiency and enhanced cold tolerance | pMON72494 |
| 88 | 5 | pMON72472 | *Synechococcus* sp. PCC 6301 Delta9 desaturase | Increased yield, enhanced cold tolerance and enhanced water use efficiency | pMON68399 |
| 89 | 6 | pMON72472 | *Arabidopsis* agl11 delta K-box | Improved cold tolerance | pMON73765 |
| 90 | 7 | pMON72472 | rice MADS3 delta MADS-box - L37528 | Enhanced cold tolerance | pMON73829 |
| 91 | 8 | pMON72472 | corn MADS box protein 110 | Enhanced nitrogen use efficiency and enhance cold tolerance | pMON73816 |
| 92 | 9 | pMON72472 | *Arabidopsis* homeodomain transcription factor- | Enhanced cold tolerance | pMON75305 |
| 93 | 10 | pMON72472 | *Arabidopsis* AP2 domain transcription factor | Enhanced cold tolerance | pMON75306 |
| 94 | 11 | pMON72472 | *Arabidopsis* GATA domain transcription factor | Enhanced cold tolerance | pMON75309 |
| 95 | 12 | pMON72472 | *Arabidopsis* AT-hook domain transcription factor- | Enhanced cold tolerance | pMON75312 |
| 96 | 13 | pMON72472 | rice DETI-like - BAB16336 | Enhanced nitrogen use efficiency and enhanced cold tolerance | pMON80270 |

TABLE 1-continued

| PEP SEQ ID NO | NUC SEQ ID NO | Base Vector | PROTEIN NAME | Enhanced trait(s) | Plasmid ID |
|---|---|---|---|---|---|
| 97 | 14 | pMON72472 | soybean G482-like 1 | Enhanced water use efficiency | pMON76342 |
| 98 | 15 | pMON72472 | *Arabidopsis* hypothetical protein [NM_114802] | Enhanced cold tolerance | pMON79174 |
| 99 | 16 | pMON72472 | corn hypothetical protein | Enhanced cold tolerance | pMON79413 |
| 100 | 17 | pMON72472 | soy Pra2-like protein 2 | Enhanced nitrogen use efficiency | pMON75511 |
| 101 | 18 | pMON72472 | *Agrobacterium* cryptochrome-like protein - AE008050 | Enhanced cold tolerance | pMON75515 |
| 102 | 19 | pMON72472 | rice SNF1-like protein 9[OsPK4] - AB011967 | Enhanced nitrogen use efficiency, enhanced water use efficiency, increased yield | pMON80542 |
| 103 | 20 | pMON72472 | corn SNF1-like protein 3 | Enhanced water use efficiency and enhanced nitrogen use efficiency | pMON78949 |
| 104 | 21 | pMON72472 | corn SNF1-like protein 8 | Enhanced cold tolerance and enhanced water use efficiency | pMON78936 |
| 105 | 22 | pMON72472 | Corn Rubisco Activase 2 | Increased yield, enhanced cold tolerance and enhanced nitrogen use efficiency | pMON75524 |
| 106 | 23 | pMON72472 | NLI Interacting Isoform T1- | Enhanced cold tolerance and increased yield | pMON79163 |
| 107 | 24 | pMON72472 | maize synaptobrevin-related sequnece 1 - | Enhanced cold tolerance condition and increased yield | pMON75533 |
| 108 | 25 | pMON72472 | maize magnesium transporter mrs2-1-like 1 sequence | Enhanced nitrogen use efficiency and increased yield | pMON79709 |
| 109 | 26 | pMON72472 | Corn Protein similar to nodulin MtN3 protein | Enhanced water use efficiency | pMON79422 |
| 110 | 27 | pMON72472 | Corn glyoxalase II isozyme | Enhanced cold tolerance | pMON79425 |
| 111 | 28 | pMON72472 | Corn RNA 3-TERMINAL PHOSPHATE CYCLASE-LIKE PROTEIN | Enhanced cold tolerance | pMON79718 |
| 112 | 29 | pMON72472 | rice Di19 like sequence | Enhanced cold tolerance | pMON79447 |
| 113 | 30 | pMON72472 | soybean MAP kinase 6 like 2 sequence | Enhanced cold tolerance | pMON78232 |
| 114 | 31 | pMON72472 | *Ralstonia metallidurans* glutamate decarboxylase | Enhanced cold tolerance, and enhanced nitrogen use efficiency | pMON75980 |
| 115 | 32 | pMON72472 | rice HSF5 like sequence | Enhanced water use efficiency | pMON80489 |
| 116 | 33 | pMON72472 | soybean hsp17.4 like 1 sequence | Enhanced cold tolerance and enhanced water use efficiency | pMON79697 |
| 117 | 34 | pMON72472 | Corn putative pyrrolidone carboxyl peptidase | Enhanced water use efficiency | pMON78237 |
| 118 | 35 | pMON72472 | *Arabidopsis* E2F | Enhanced cold tolerance enhanced nitrogen use efficiency | pMON80461 |
| 119 | 36 | pMON72472 | *Arabidopsis* protein phosphatase 1A | Enhanced cold tolerance | pMON78235 |
| 120 | 37 | pMON72472 | *Arabidopsis* CtpA | Enhanced cold tolerance, and enhanced water use efficiency | pMON80452 |
| 121 | 38 | pMON74532 | *Arabidopsis* CtpA | Increased yield | |
| 122 | 39 | pMON72472 | Corn protein similar to *Arabidopsis* Probable microsomal signal peptidase | Enhanced cold tolerance | pMON80500 |
| 123 | 40 | pMON72472 | [*Oryza sativa*] putative aldose reductase | Enhanced nitrogen use efficiency | pMON80850 |
| 124 | 41 | pMON72472 | *Zea Mays* Kinase II (similar to Yeast 1KS1 & At MRK1) | Increased seed protein | pMON78949 |

TABLE 1-continued

| PEP SEQ ID NO | NUC SEQ ID NO | Base Vector | PROTEIN NAME | Enhanced trait(s) | Plasmid ID |
|---|---|---|---|---|---|
| 125 | 42 | pMON72472 | Fructose-1-6-bisphosphatase | Increased yield | pMON81853 |
| 126 | 43 | pMON72472 | soy G1928 like 1 | Increased seed protein | pMON83769 |
| 127 | 44 | pMON74532 | *Synechocystis* sp. 6803 Hik19 | Increased yield | pMON78911 |
| 128 | 45 | pMON72472 | *Synechocystis* sp. 6803 Hik19 | Increased yield | |
| 129 | 46 | pMON72472 | *Arabidopsis* NAC domain transcription factor | Increased yield | pMON73787 |
| 130 | 47 | pMON72472 | yeast alanine aminotransferase 1 - AAB67593 | Increased yield and enhanced nitrogen use efficiency | pMON77895 |
| 131 | 48 | pMON72472 | soybean catalase-like 1 | Increased yield | pMON79152 |
| 132 | 49 | pMON72472 | corn ALG-2 interacting protein | Increased yield | pMON80921 |
| 133 | 50 | pMON72472 | Putative Serine Carboxypeptidase- | Increased yield | pMON75505 |
| 134 | 51 | pMON72472 | Putative Ankyrin Like Protein- | Increased yield | pMON80925 |
| 135 | 52 | pMON72472 | Putative Kinase Like Protein- | Increased yield | pMON78942 |
| 136 | 53 | pMON72472 | Putative Protein- | Increased yield | pMON79164 |
| 137 | 54 | pMON72472 | yeast YPR145W/asn1 - U40829 | Increased yield | pMON79653 |
| 138 | 55 | pMON72472 | rice AtHSP17.6A like 1 sequence | Increased yield | pMON81228 |
| 139 | 56 | pMON72472 | yeast YDL123w | Increased yield | pMON79430 |
| 140 | 57 | pMON72472 | rice 12-oxophytodienoate reductase like 1 sequence | Increased yield | pMON7973l |
| 141 | 58 | pMON72472 | soybean MAP kinase 6 like 3 sequence | Increased yield | pMON78229 |
| 142 | 59 | pMON72472 | *Arabidopsis* GAD1 | Increased yield | pMON79696 |
| 143 | 60 | pMON74532 | *Arabidopsis* GAD1 | | |
| 144 | 61 | pMON72472 | soybean hsp17.4 like 4 sequence | Increased yield | pMON78240 |
| 145 | 62 | pMON72472 | maize hsp60 like 4 sequence | Increased yield | pMON80283 |
| 146 | 63 | pMON72472 | soy dsPTP 1 | Increased yield | pMON80866 |
| 147 | 64 | pMON72472 | Yeast GLC3 Glycogen branching enzyme | Increased yield | pMON80292 |
| 148 | 65 | pMON72472 | *Arabidopsis* unknown protein | Increased yield | pMON82223 |
| 149 | 66 | pMON72472 | beta-D-glucosidase | Increased yield | pMON83553 |
| 150 | 67 | pMON72472 | unknown protein 1 | Increased yield | pMON81857 |
| 151 | 68 | pMON72472 | aldehyde oxidase | Increased yield | pMON82218 |
| 152 | 69 | pMON72472 | corn hypothetical protein | Improved growth under cold stress | pMON78227 |
| 153 | 70 | pMON72472 | corn hypothetical protein | Improved growth under cold stress | pMON78904 |
| 154 | 71 | pMON72472 | *Arabidopsis* cysteine proteinase inhibitor | Increased yield | pMON78920 |
| 155 | 72 | pMON82053 | *Arabidopsis* cysteine proteinase inhibitor | Increased yield | pMON92646 |
| 156 | 73 | pMON72472 | *Arabidopsis* hypothetical protein | Improved growth under cold stress | pMON78922 |
| 157 | 74 | pMON72472 | yeast SNF1 - A26030 | Improved growth under low nitrogen, drought, and/or cold stresses | pMON78948 |
| 158 | 75 | pMON72472 | soy SNF1-like protein 1 | Increased yield | pMON79660 |
| 159 | 76 | pMON72472 | soy SNF-like protein 2 | Enhanced nitrogen use efficiency, enhanced water use efficiency, increased yield | pMON78931 |
| 160 | 77 | pMON72472 | soy G1760 | Increased yield and enhanced water use efficiency | pMON82645 |
| 160 | 77 | | Soy G1760 | Increased yield | pMON74470 |
| 161 | 78 | pMON72472 | Rice Glyoxalase II | Increased yield | pMON79665 |
| 162 | 79 | pMON72472 | corn OsPK7-like | Enhanced nitrogen use efficiency, enhanced water use efficiency, increased yield | pMON82629 |

TABLE 1-continued

| PEP SEQ ID NO | NUC SEQ ID NO | Base Vector | PROTEIN NAME | Enhanced trait(s) | Plasmid ID |
|---|---|---|---|---|---|
| 163 | 80 | pMON74532 | rice phyA with *Arabidopsis* phyC intron I | Increased yield | pMON81344 |
| 164 | 81 | pMON82060 | rice G975 like1 | Improved growth under cold stress | |
| 165 | 82 | | Corn Phytochrome A | Increased yield | pMON74916 |
| 166 | 83 | | *Arabidopsis* G1760 | Increased yield | pMON73957 |

Selection Methods for Transgenic Plants with Enhanced Agronomic Trait

Within a population of transgenic plants regenerated from plant cells transformed with the recombinant DNA many plants that survive to fertile transgenic plants that produce seeds and progeny plants will not exhibit an enhanced agronomic trait. Selection from the population is necessary to identify one or more transgenic plant cells that can provide plants with the enhanced trait. Transgenic plants having enhanced traits are selected from populations of plants regenerated or derived from plant cells transformed as described herein by evaluating the plants in a variety of assays to detect an enhanced trait, e.g. enhanced water use efficiency, enhanced cold tolerance, increased yield, enhanced nitrogen use efficiency, enhanced seed protein and enhanced seed oil. These assays also may take many forms including, but not limited to, direct screening for the trait in a greenhouse or field trial or by screening for a surrogate trait. Such analyses can be directed to detecting changes in the chemical composition, biomass, physiological properties, morphology of the plant. Changes in chemical compositions such as nutritional composition of grain can be detected by analysis of the seed composition and content of protein, free amino acids, oil, free fatty acids, starch or tocopherols. Changes in biomass characteristics can be made on greenhouse or field grown plants and can include plant height, stem diameter, root and shoot dry weights; and, for corn plants, ear length and diameter. Changes in physiological properties can be identified by evaluating responses to stress conditions, for example assays using imposed stress conditions such as water deficit, nitrogen deficiency, cold growing conditions, pathogen or insect attack or light deficiency, or increased plant density. Changes in morphology can be measured by visual observation of tendency of a transformed plant with an enhanced agronomic trait to also appear to be a normal plant as compared to changes toward bushy, taller, thicker, narrower leaves, striped leaves, knotted trait, chlorosis, albino, anthocyanin production, or altered tassels, ears or roots. Other selection properties include days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barreness/prolificacy, green snap, and pest resistance. In addition, phenotypic characteristics of harvested grain may be evaluated, including number of kernels per row on the ear, number of rows of kernels on the ear, kernel abortion, kernel weight, kernel size, kernel density and physical grain quality. Although the plant cells and methods of this invention can be applied to any plant cell, plant, seed or pollen, e.g. any fruit, vegetable, grass, tree or ornamental plant, the various aspects of the invention are preferably applied to corn, soybean, cotton, canola, alfalfa, wheat and rice plants. In many cases the invention is applied to corn plants that are inherently resistant to disease from the Mal de Rio Cuarto virus or the *Puccina sorghi* fungus or both.

The following examples are included to demonstrate aspects of the invention, those of skill in the art should, in light of the present disclosure, appreciate that many changes can be made in the specific aspects which are disclosed and still obtain a like or similar results without departing from the spirit and scope of the invention.

EXAMPLE 1

Plant Expression Constructs

A. Plant Expression Constructs for Corn Transformation

This example illustrates the construction of plasmids for transferring recombinant DNA into plant cells which can be regenerated into transgenic plants of this invention. Primers for PCR amplification of protein coding nucleotides of recombinant DNA were designed at or near the start and stop codons of the coding sequence, in order to eliminate most of the 5' and 3' untranslated regions. Each recombinant DNA coding for a protein identified in Table 1 was amplified by PCR prior to insertion into the insertion site of one of the base vectors as referenced in Table 1.

A base plant transformation vector pMON65154 was fabricated for use in preparing recombinant DNA for transformation into corn tissue using GATEWAY™ Destination plant expression vector systems (available from Invitrogen Life Technologies, Carlsbad, Calif.). With reference to the elements described in Table 3 below and SEQ ID NO:10024, pMON65154 comprises a selectable marker expression cassette and a template recombinant DNA expression cassette. The marker expression cassette comprises a CaMV 35S promoter operably linked to a gene encoding neomycin phosphotransferase II (nptII) followed by a 3' region of an *Agrobacterium tumefaciens* nopaline synthase gene (nos). The template recombinant DNA expression cassette is positioned tail to tail with the marker expression cassette. The template recombinant DNA expression cassette comprises 5' regulatory DNA including a rice actin 1 promoter, exon and intron, followed by a GATEWAY™ insertion site for recombinant DNA, followed by a 3' region of a potato proteinase inhibitor II (pinII) gene. Once recombinant DNA has been inserted into the insertion site, the plasmid is useful for plant transformation, for example by microprojectile bombardment.

TABLE 3

| FUNCTION | ELEMENT | REFERENCE |
|---|---|---|
| Plant gene of interest expression cassette | Rice actin 1 promoter | U.S. Pat. No. 5,641,876 |
| | Rice actin 1 exon 1, intron 1 enhancer | U.S. Pat. No. 5,641,876 |
| Gene of interest insertion site | AttR1 | GATEWAY ™ Cloning Technology Instruction Manual |
| | CmR gene | GATEWAY ™ Cloning Technology Instruction Manual |
| | ccdA, ccdB genes | GATEWAY ™ Cloning Technology Instruction Manual |
| | attR2 | GATEWAY ™ Cloning Technology Instruction Manual |
| Plant gene of interest expression cassette | Potato pinII 3' region | An et al. (1989) Plant Cell 1: 115-122 |
| Plant selectable marker expression cassette | CaMV 35S promoter | U.S. Pat. No. 5,858,742 |
| | nptII selectable marker | U.S. Pat. No. 5,858,742 |
| | nos 3' region | U.S. Pat. No. 5,858,742 |
| Maintenance in *E. coli* | ColE1 origin of replication | |
| | F1 origin of replication | |
| | Bla ampicillin resistance | |

A similar base vector plasmid pMON72472 (SEQ ID NO: 10025) was constructed for use in *Agrobacterium*-mediated methods of plant transformation similar to pMON65154 except (a) the 5' regulatory DNA in the template recombinant DNA expression cassette was a rice actin promoter and a rice actin intron, (b) left and right T-DNA border sequences from *Agrobacterium* are added with the right border sequence is located 5' to the rice actin 1 promoter and the left border sequence is located 3' to the 35S promoter and (c) DNA is added to facilitate replication of the plasmid in both *E. coli* and *Agrobacterium tumefaciens*. The DNA added to the plasmid outside of the T-DNA border sequences includes an oriV wide host range origin of DNA replication functional in *Agrobacterium*, a pBR322 origin of replication functional in *E. coli*, and a spectinomycin/streptomycin resistance gene for selection in both *E. coli* and *Agrobacterium.*

Another base vector pMON82060 (SEQ ID NO: 10026), illustrated in Table 4, was assembled using the technology known in the art.

TABLE 4

| function | name | Annotation | Coordinates of SEQ ID NO: 10026 |
|---|---|---|---|
| Agro transformation | B-AGRtu.right border | Agro right border sequence, essential for transfer of T-DNA. | 5235-5591 |
| Gene of interest plant expression cassette | P-Os.Act1 | Promoter from the rice actin gene act1. | 5609-7009 |
| | L-Os.Act1 | Leader (first exon) from the rice actin 1 gene. | |
| | I-Os.Act1 | First intron and flanking UTR exon sequences from the rice actin 1 gene | |
| | T-St.Pis4 | The 3' non-translated region of the potato proteinase inhibitor II gene which functions to direct polyadenylation of the mRNA | 7084-8026 |
| Plant selectable marker expression cassette | P-CaMV.35S | CaMV 35S promoter | 8075-8398 |
| | L-CaMV.35S | 5' UTR from the 35S RNA of CaMV | |
| | CR-Ec.nptII-Tn5 | nptII selectable marker that confers resistance to neomycin and kanamycin | 8432-9226 |
| | T-AGRtu.nos | A 3' non-translated region of the nopaline synthase gene of *Agrobacterium tumefaciens* Ti plasmid which functions to direct polyadenylation of the mRNA. | 9255-9507 |
| Agro transformation | B-AGRtu.left border | Agro left border sequence, essential for transfer of T-DNA.. | 39-480 |
| Maintenance in *E. coli* | OR-Ec.oriV-RK2 | The vegetative origin of replication from plasmid RK2. | 567-963 |
| | CR-Ec.rop | Coding region for represser of primer from the ColE1 plasmid. Expression of this gene product interferes with primer binding at the origin of replication, keeping plasmid copy number low. | 2472-2663 |
| | OR-Ec.ori-ColE1 | The minimal origin of replication from the *E. coli* plasmid ColE1. | 3091-3679 |
| | P-Ec.aadA-SPC/STR | promoter for Tn7 adenylyltransferase (AAD(3")) | 4210-4251 |
| | CR-Ec.aadA-SPC/STR | Coding region for Tn7 adenylyltransferase (AAD(3")) conferring spectinomycin and streptomycin resistance. | 4252-5040 |
| | T-Ec.aadA-SPC/STR | 3' UTR from the Tn7 adenylyltransferase (AAD(3")) gene of *E. coli*. | 5041-5098 |

B. Plant Expression Vector for Soybean Transformation

Plasmids for use in transformation of soybean were also prepared. Elements of an exemplary common expression vector plasmid pMON74532 (SEQ ID NO:10027) are shown in Table 5 below.

TABLE 5

| Function | Element | Reference |
|---|---|---|
| Agro transformation | B-ARGtu.right border | Depicker, A. et al (1982) Mol Appl Genet 1: 561-573 |
| Antibiotic resistance | CR-Ec.aadA-SPC/STR | |
| Represser of primers from the ColE1 plasmid | CR-Ec.rop | |
| Origin of replication | OR-Ec.oriV-RK2 | |
| Agro transformation | B-ARGtu.left border | Barker, R. F. et al (1983) Plant Mol Biol 2: 335-350 |
| Plant selectable marker expression cassette | Promoter with intron and 5'UTR of *Arabidopsis* act 7 gene (AtAct7) | McDowell et al. (1996) Plant Physiol. |
| | 5' UTR of *Arabidopsis* act 7 gene | 111: 699-711. |
| | Intron in 5'UTR of AtAct7 | |
| | Transit peptide region of *Arabidopsis* EPSPS | Klee, H. J. et al (1987) MGG 210: 437-442 |
| | Synthetic CP4 coding region with dicot preferred codon usage | |
| | A 3' UTR of the nopaline synthase gene of *Agrobacterium tumefaciens* Ti plasmid | U.S. Pat No. 5,858,742 |
| Plant gene of interest expression cassette | Promoter for 35S RNA from CaMV containing a duplication of the −90 to −350 region | U.S. Pat No. 5,322,938 |
| | Gene of interest insertion site | |
| | Cotton E6 3' end | GenBank accession U30508 |

Another base vector pMON82053 (SEQ ID NO: 10028), illustrated in Table 6, was assembled using the technology known in the art.

TABLE 6

| Function | Name | Annotation | Coordinates of SEQ ID NO: 10028 |
|---|---|---|---|
| Agro transforamtion | B-AGRtu.left border | Agro left border sequence, essential for transfer of T-DNA. | 6144-6585 |
| Plant selectable marker expression cassette | P-At.Act7 | Promoter from the *arabidopsis* actin 7 gene | 6624-7861 |
| | L-At.Act7 | 5'UTR of *Arabidopsis* Act7 gene | |
| | I-At.Act7 | Intron from the *Arabidopsis* actin7 gene | |
| | TS-At.ShkG-CTP2 | Transit peptide region of *Arabidopsis* EPSPS | 7864-8091 |
| | CR-AGRtu.aroA-CP4.nno_At | Synthetic CP4 coding region with dicot preferred codon usage. | 8092-9459 |
| | T-AGRtu.nos | A 3' non-translated region of the nopaline synthase gene of *Agrobacterium tumefaciens* Ti plasmid which functions to direct polyadenylation of the mRNA. | 9466-9718 |
| Gene of interest expression cassette | P-CaMV.35S-enh | Promoter for 35S RNA from CaMV containing a duplication of the −90 to −350 region. | 1-613 |
| | T-Gb.E6-3b | 3' untranslated region from the fiber protein E6 gene of sea-island cotton; | 688-1002 |
| Agro transformation | B-AGRtu.right border | Agro right border sequence, essential for transfer of T-DNA. | 1033-1389 |
| Maintenance in *E. coli* | OR-Ec.oriV-RK2 | The vegetative origin of replication from plasmid RK2. | 5661-6057 |
| | CR-Ec.rop | Coding region for represser of primer from the ColE1 plasmid. Expression of this gene product interferes with primer binding at the origin of replication, keeping plasmid copy number low. | 3961-4152 |

TABLE 6-continued

| Function | Name | Annotation | Coordinates of SEQ ID NO: 10028 |
|---|---|---|---|
| | OR-Ec.ori-ColE1 | The minimal origin of replication from the *E. coli* plasmid ColE1. | 2945-3533 |
| | P-Ec.aadA-SPC/STR | romoter for Tn7 adenylyltransferase (AAD(3")) | 2373-2414 |
| | CR-Ec.aadA-SPC/STR | Coding region for Tn7 adenylyltransferase (AAD(3")) conferring spectinomycin and streptomycin resistance. | 1584-2372 |
| | T-Ec.aadA-SPC/STR | 3' UTR from the Tn7 adenylyltransferase (AAD(3"))gene of *E. coli*. | 1526-1583 |

Protein coding segments of recombinant DNA are amplified by PCR prior to insertion into vectors at the insertion site. Primers for PCR amplification are designed at or near the start and stop codons of the coding sequence, in order to eliminate most of the 5' and 3' untranslated regions.

EXAMPLE 2

Corn Transformation

This example illustrates plant cell transformation methods useful in producing transgenic corn plant cells, plants, seeds and pollen of this invention and the production and identification of transgenic corn plants and seed with an enhanced trait, i.e. enhanced water use efficiency, enhanced cold tolerance, increased yield, enhanced nitrogen use efficiency, enhanced seed protein and enhanced seed oil. Plasmid vectors were prepared by cloning DNA identified in Table 1 in the identified base vectors for use in corn transformation of corn plant cells to produce transgenic corn plants and progeny plants, seed and pollen.

For *Agrobacterium*-mediated transformation of corn embryo cells corn plants of a readily transformable line (designated LH59) is grown in the greenhouse and ears harvested when the embryos are 1.5 to 2.0 mm in length. Ears are surface sterilized by spraying or soaking the ears in 80% ethanol, followed by air drying. Immature embryos are isolated from individual kernels on surface sterilized ears. Prior to inoculation of maize cells, *Agrobacterium* cells are grown overnight at room temperature. Immature maize embryo cells are inoculated with *Agrobacterium* shortly after excision, and incubated at room temperature with *Agrobacterium* for 5-20 minutes. Immature embryo plant cells are then co-cultured with *Agrobacterium* for 1 to 3 days at 23° C. in the dark. Co-cultured embryos are transferred to selection media and cultured for approximately two weeks to allow embryogenic callus to develop. Embryogenic callus is transferred to culture medium containing 100 mg/L paromomycin and subcultured at about two week intervals. Transformed plant cells are recovered 6 to 8 weeks after initiation of selection.

For *Agrobacterium*-mediated transformation of maize callus immature embryos are cultured for approximately 8-21 days after excision to allow callus to develop. Callus is then incubated for about 30 minutes at room temperature with the *Agrobacterium* suspension, followed by removal of the liquid by aspiration. The callus and *Agrobacterium* are co-cultured without selection for 3-6 days followed by selection on paromomycin for approximately 6 weeks, with biweekly transfers to fresh media, and paromomycin resistant callus identified as containing the recombinant DNA in an expression cassette.

For transformation by microprojectile bombardment immature maize embryos are isolated and cultured 3-4 days prior to bombardment. Prior to microprojectile bombardment, a suspension of gold particles is prepared onto which the desired recombinant DNA expression cassettes are precipitated. DNA is introduced into maize cells as described in U.S. Pat. Nos. 5,550,318 and 6,399,861 using the electric discharge particle acceleration gene delivery device. Following microprojectile bombardment, tissue is cultured in the dark at 27 degrees C. Additional transformation methods and materials for making transgenic plants of this invention, for example, various media and recipient target cells, transformation of immature embryos and subsequence regeneration of fertile transgenic plants are disclosed in U.S. Pat. Nos. 6,194,636 and 6,232,526 and U.S. patent application Ser. No. 09/757,089, which are incorporated herein by reference.

To regenerate transgenic corn plants a callus of transgenic plant cells resulting from transformation is placed on media to initiate shoot development in plantlets which are transferred to potting soil for initial growth in a growth chamber at 26 degrees C. followed by a mist bench before transplanting to 5 inch pots where plants are grown to maturity. The regenerated plants are self fertilized and seed is harvested for use in one or more methods to select seed, seedlings or progeny second generation transgenic plants (R2 plants) or hybrids, e.g. by selecting transgenic plants exhibiting an enhanced trait as compared to a control plant.

Transgenic corn plant cells were transformed with recombinant DNA from each of the genes identified in Table 1. Progeny transgenic plants and seed of the transformed plant cells were screened for enhanced water use efficiency, enhanced cold tolerance, increased yield, enhanced nitrogen use efficiency, enhanced seed protein and enhanced seed oil as reported in Example 5.

EXAMPLE 3

Soybean Transformation

This example illustrates plant transformation useful in producing the transgenic soybean plants of this invention and the production and identification of transgenic seed for transgenic soybean having enhanced water use efficiency, enhanced cold tolerance, increased yield, enhanced nitrogen use efficiency, enhanced seed protein and enhanced seed oil.

For *Agrobacterium* mediated transformation, soybean seeds are germinated overnight and the meristem explants excised. The meristems and the explants are placed in a wounding vessel. Soybean explants and induced *Agrobacterium* cells from a strain containing plasmid DNA with the gene of interest cassette and a plant selectable marker cassette are mixed no later than 14 hours from the time of initiation of seed germination and wounded using sonication. Following wounding, explants are placed in co-culture for 2-5 days at which point they are transferred to selection media for 6-8 weeks to allow selection and growth of transgenic shoots. Trait positive shoots are harvested approximately 6-8 weeks and placed into selective rooting media for 2-3 weeks. Shoots producing roots are transferred to the greenhouse and potted in soil. Shoots that remain healthy on selection, but do not produce roots are transferred to non-selective rooting media for an additional two weeks. Roots from any shoots that produce roots off selection are tested for expression of the plant selectable marker before they are transferred to the greenhouse and potted in soil. Additionally, a DNA construct can be transferred into the genome of a soybean cell by particle bombardment and the cell regenerated into a fertile soybean plant as described in U.S. Pat. No. 5,015,580, herein incorporated by reference.

Transgenic soybean plant cells were transformed with recombinant DNA from each of the genes identified in Table 1. Progeny transgenic plants and seed of the transformed plant cells were screened for enhanced water use efficiency, enhanced cold tolerance, increased yield, enhanced nitrogen use efficiency, enhanced seed protein and enhanced seed oil as reported in Example 5.

EXAMPLE 4

Homolog Identification

This example illustrates the identification of homologs of proteins encoded by the DNA identified in Table 1 which is used to provide transgenic seed and plants having enhanced agronomic traits. From the sequence of the homologs, homologous DNA sequence can be identified for preparing additional transgenic seeds and plants of this invention with enhanced agronomic traits.

An "All Protein Database" was constructed of known protein sequences using a proprietary sequence database and the National Center for Biotechnology Information (NCBI) non-redundant amino acid database (nr.aa). For each organism from which a polynucleotide sequence provided herein was obtained, an "Organism Protein Database" was constructed of known protein sequences of the organism; it is a subset of the All Protein Database based on the NCBI taxonomy ID for the organism.

The All Protein Database was queried using amino acid sequences provided herein as SEQ ID NO:84 through SEQ ID NO:166 using NCBI "blastp" program with E-value cutoff of 1e-8. Up to 1000 top hits were kept, and separated by organism names. For each organism other than that of the query sequence, a list was kept for hits from the query organism itself with a more significant E-value than the best hit of the organism. The list contains likely duplicated genes of the polynucleotides provided herein, and is referred to as the Core List. Another list was kept for all the hits from each organism, sorted by E-value, and referred to as the Hit List.

The Organism Protein Database was queried using polypeptide sequences provided herein as SEQ ID NO:84 through SEQ ID NO:166 using NCBI "blastp" program with E-value cutoff of 1e-4. Up to 1000 top hits were kept. A BLAST searchable database was constructed based on these hits, and is referred to as "SubDB". SubDB was queried with each sequence in the Hit List using NCBI "blastp" program with E-value cutoff of 1e-8. The hit with the best E-value was compared with the Core List from the corresponding organism. The hit is deemed a likely ortholog if it belongs to the Core List, otherwise it is deemed not a likely ortholog and there is no further search of sequences in the Hit List for the same organism. Homologs from a large number of distinct organisms were identified and are reported by amino acid sequences of SEQ ID NO: 167 through SEQ ID NO: 10023. These relationship of proteins of SEQ ID NO:84 through 166 and homologs of SEQ ID NO:167 through 10023 is identified in Table 2. The source organism for each homolog is found in the Sequence Listing.

TABLE 2

| PEP SEQ ID NO: | homolog SEQ ID NOs |
|---|---|
| 84: | 4274 4007 7537 1472 2465 1788 1873 8538 2486 2101 2090 3705 |
| | 513 7264 6280 4902 2624 8820 1614 5907 8247 2717 4147 5559 |
| | 1631 7278 6566 6687 2116 9018 192 2002 5150 322 6314 6458 |
| | 6281 1285 7292 4226 4543 2496 9903 1478 554 5383 7751 2484 |
| | 4954 7695 5821 6271 3339 443 8542 1561 2321 5876 6877 3452 |
| | 2879 3497 2097 4257 7449 7281 3708 4513 2001 4425 9319 4133 |
| | 6686 2146 9698 1036 2026 1292 5566 181 6951 9794 2439 2621 |
| | 5202 878 8081 1392 1950 9999 4392 2121 7824 2367 5102 6717 |
| | 1541 9444 7051 529 4096 602 8266 |
| 85: | 1163 3954 9565 5913 8096 1310 3871 3019 2926 1456 2770 4461 |
| | 2570 5099 7946 3700 9665 1600 7270 7312 6531 9978 8803 8920 |
| | 4917 6067 6352 6902 2025 2516 4213 9446 8483 5404 2213 4311 |
| | 3724 9926 9599 3835 727 8396 190 3701 7478 706 4038 7149 |
| | 5413 1538 8094 9467 7385 7520 7275 3299 3658 |
| 86: | 2511 2513 7067 7055 5647 9608 9399 4420 9867 4564 2527 7769 |
| | 2323 347 6509 2052 5258 4504 5363 3847 329 7133 1751 3243 |
| | 8135 4767 5558 2719 6177 6161 6180 1606 3066 514 7725 4747 |
| | 2868 3953 3995 9218 8245 1471 1050 4602 9788 5705 1043 |
| 87: | 7338 2565 1372 619 8819 7803 7216 9263 8478 7286 2051 8010 |
| | 4629 2569 8521 7659 6081 6080 2727 1944 5731 7616 8198 8166 |
| | 6312 9586 2010 7801 4694 4265 3928 9925 1675 6099 5725 1040 |
| | 5933 270 4135 6356 8593 7015 3351 9045 5105 9655 3874 5951 |
| | 2184 7921 9476 3408 7095 1214 9077 3211 7050 7106 4788 3534 |
| | 3093 7715 |
| 88: | 9004 8450 3918 3721 516 8506 8664 3458 6365 2464 1564 4322 |
| | 7760 3673 7547 2603 8146 1755 7919 4542 436 2278 4913 2453 |
| | 9651 2319 3659 678 4640 3600 4171 1156 1807 5765 6619 2992 |
| | 354 8233 2386 9454 9453 8837 1238 6971 7874 6538 8258 1371 |

TABLE 2-continued

| PEP SEQ ID NO: | homolog SEQ ID NOs |
|---|---|
| | 1609 3120 3437 8825 7158 5623 1313 7335 6137 3691 8239 415 |
| | 7580 5147 8818 6282 4612 543 6639 9686 7662 7683 7682 7664 |
| | 5278 5260 8016 2558 2566 2530 9515 5921 8962 3892 7174 6793 |
| | 6936 6938 8284 5225 9323 2932 4932 5328 6697 6602 5109 9625 |
| | 1876 7435 7758 1719 662 6913 4095 5563 4919 8188 6804 360 |
| | 9790 7742 7745 2584 8776 8004 862 6690 8757 5193 6618 9595 |
| | 225 4815 5192 1055 4061 4017 9781 9955 8231 1254 5944 4087 |
| | 8234 319 1180 4631 9258 6546 699 3498 866 588 189 4577 |
| | 1244 5332 3952 9818 2700 9827 6958 7167 3762 9259 3504 4434 |
| | 4968 3204 8580 1077 5275 9915 1474 9160 1653 2701 1637 5350 |
| | 5299 1843 4178 10018 7040 2894 2821 5624 680 9370 7560 4573 |
| | 2144 6813 6722 3689 6721 3373 8902 6656 8928 8462 1336 9106 |
| | 6956 220 3196 221 6118 4162 7171 9683 3870 4094 8343 8342 |
| | 213 904 6335 8822 2482 3806 1766 2692 9038 384 9008 9007 |
| | 3843 2040 7982 9001 9002 4781 606 4807 4852 5595 1509 1018 |
| | 8100 8751 6816 9347 8346 |
| 89: | 9376 7987 7994 8028 8008 9732 7256 7258 6605 6606 7280 3139 |
| | 9607 7439 6711 9237 9236 6585 1956 1982 1979 7291 7290 1200 |
| | 8901 7293 7295 7315 7297 7279 6624 6601 6622 6584 6583 6387 |
| | 7341 9612 264 284 3163 7321 7324 3947 6330 6620 6600 6598 |
| | 6675 9922 4296 3753 4899 6243 4253 4128 8555 2069 9831 3105 |
| | 6073 6074 6075 7571 9157 3157 7568 8071 7565 5977 4467 7244 |
| | 1849 7820 7235 3250 6000 1058 6372 9381 7369 4775 4109 609 |
| | 9998 9373 6579 6559 6561 206 8729 1166 4317 1863 5710 381 |
| | 2162 4270 6680 6925 752 2268 4086 394 378 3059 6262 9338 |
| | 2659 8145 6646 9005 4294 6457 6451 8075 8093 3747 3558 7476 |
| | 7475 7317 1709 6558 3764 3280 6580 1845 |
| 90: | 446 4338 4342 9732 4169 7256 7258 7260 6605 6606 7280 9607 |
| | 3131 3148 6585 4388 3940 177 7243 7291 7290 1200 1231 1207 |
| | 6265 7295 7293 7315 7297 7279 7792 7788 6624 6601 6622 6583 |
| | 6584 6891 7253 7277 7262 7272 7271 7324 7321 6598 6620 6600 |
| | 9922 7623 6675 9831 2069 3105 6073 6075 6074 7571 9157 7107 |
| | 7110 7108 7109 7244 1849 7235 3250 176 179 3357 1058 6798 |
| | 5204 9410 1816 5206 6794 1553 6056 6795 6372 9585 9587 7819 |
| | 383 510 175 2068 2865 2823 450 9643 1555 1636 3418 2608 |
| | 701 6147 6165 1470 6578 9307 4775 3206 4245 7525 8255 2331 |
| | 9277 9305 9278 9274 6559 6579 6561 8729 7851 2561 7850 2208 |
| | 1166 9701 670 6640 8134 5364 3904 6039 1320 6481 5993 3541 |
| | 207 8345 8326 4696 7508 1266 2160 2162 1270 3958 4250 6887 |
| | 3932 4270 5104 6680 8202 6925 1088 8251 1466 8249 9677 3579 |
| | 7756 2119 4273 1011 245 3713 9490 5245 4735 2153 854 4214 |
| | 5025 6660 5001 4086 4099 4077 7241 7237 3059 6262 2659 820 |
| | 6646 9005 4294 6457 6451 2869 2767 7746 1732 1738 1734 1740 |
| | 1617 6714 8105 7317 7318 1709 1731 6558 7716 7971 7968 1210 |
| | 1248 925 6580 1247 1273 1274 3369 2586 3664 |
| 91: | 7402 7398 3583 3592 4729 6500 6496 2752 215 7280 3139 3136 |
| | 7439 7440 7424 9236 9237 3124 3128 3938 177 1956 1982 1979 |
| | 7291 7290 4868 6436 7355 7315 7297 7279 794 7341 7272 7262 |
| | 290 304 289 291 288 7324 7321 3947 6330 6661 6658 4296 |
| | 3753 8555 1943 8457 3157 7565 7568 7088 5977 4467 3998 3185 |
| | 3181 3152 3155 7534 7516 7244 1847 7442 7468 6000 8494 375 |
| | 1057 9773 6372 7369 957 2685 3508 3586 3087 8866 5749 1377 |
| | 2317 723 4586 2111 4703 4413 3687 8541 9052 1793 6037 2164 |
| | 2626 6824 5207 3238 7618 9974 9973 1815 1813 206 4540 2230 |
| | 6716 5597 2206 2232 2200 5599 1187 3435 9672 9040 9039 2881 |
| | 7223 2377 2292 7024 6395 4348 4880 744 8064 5301 8492 8447 |
| | 4312 4317 8472 1863 7956 6694 8324 7358 381 5710 3028 2182 |
| | 7020 3016 531 5699 9003 7798 7421 2299 787 1905 3641 1934 |
| | 1893 1889 7496 5036 7100 3584 3055 2018 2043 2042 7345 1084 |
| | 1086 8473 8350 4908 4934 8469 8477 8098 8215 6937 8496 4319 |
| | 8499 8500 1741 5722 1844 1930 2265 2272 605 4099 4086 5667 |
| | 7379 7378 6262 9338 4236 9976 9969 9972 819 9011 9012 4937 |
| | 4956 2236 6461 5469 8073 6550 3501 2047 2133 7747 6304 1321 |
| | 7230 5154 5153 7376 7373 7476 7490 6862 7512 7475 7562 7538 |
| | 7536 7559 212 200 2238 3159 8122 1753 435 442 2337 3280 |
| | 3274 8476 5502 6810 2934 4335 3380 8421 1125 1368 |
| 92: | 4117 4611 3810 2575 6435 3730 689 8501 7519 5065 7840 1174 |
| | 8079 3550 8678 8411 9895 1790 4481 2401 2373 1224 |
| 93: | 3314 5148 1284 2180 7766 9728 8528 6328 7621 9726 1134 7569 |
| | 7567 5040 7727 8537 7497 8041 1784 8956 8953 3029 5087 7642 |
| | 2764 1736 6023 8126 164 8296 4997 6279 3822 9989 6339 5750 |
| | 4196 2427 7030 8232 2440 5671 7115 6494 3608 |
| 94: | 370 4530 5496 2209 8764 5878 2102 3133 4500 |
| 95: | 7835 7905 4016 3657 6757 2948 2947 3710 3091 4869 8309 6256 |
| | 3302 1832 7091 9509 2972 4439 667 3396 7147 |
| 96: | 7080 6259 8950 8331 6582 1510 8054 801 3389 4111 2614 4255 |
| | 5795 2476 10023 6565 3866 1300 6088 7775 6346 9576 8029 6701 |
| | 1803 4281 816 2806 396 2594 3089 |
| 97: | 6736 292 4996 5983 8898 6886 8845 1312 9032 1586 9964 9971 |
| | 6476 455 357 6653 3756 4574 3311 920 3295 3443 9601 6906 |
| | 5214 5215 5216 5217 7960 7945 7009 8847 4936 6359 5296 6571 |

TABLE 2-continued

| PEP SEQ ID NO: | homolog SEQ ID NOs |
| --- | --- |
| | 2233 3288 8736 5420 4531 9662 4891 7545 7948 7980 2201 9853 |
| | 8153 4861 8591 1746 7233 8693 3252 8690 709 5069 9505 |
| 98: | 9658 9420 3779 6609 3006 2471 3567 4983 434 3565 10008 8348 |
| | 5728 8033 8302 5426 8854 6705 4160 4243 9780 9744 8244 4469 |
| | 317 152 522 6171 3571 3894 8512 2442 9642 6255 3980 3725 |
| 99: | 9060 9635 3511 3575 1890 1852 7041 4217 2648 156 2833 8456 |
| | 7232 8503 5709 8742 6107 9824 9121 1142 886 9105 8210 2910 |
| 100: | 9526 1911 5622 9279 2726 1935 4608 7672 9536 4429 260 4235 |
| | 356 5588 4995 2426 5771 4203 1942 6086 3697 2322 9359 1534 |
| | 9550 1034 8012 7732 7017 1448 |
| 101: | 4840 6812 777 7939 1059 6995 5721 4881 5741 9047 566 3050 |
| | 8123 2590 8060 4040 6354 2078 2081 3304 2079 3305 2734 1841 |
| | 9901 9621 1060 6385 3676 2300 1773 9674 4263 7267 9920 7962 |
| | 1042 6416 8813 2382 4599 5670 3931 4207 2985 400 5678 2687 |
| | 7693 5971 2534 4262 9246 1286 9506 3796 9450 271 6880 5182 |
| | 6830 3290 2631 572 3716 9890 9594 9073 7979 8835 7060 503 |
| | 4838 6333 2562 8179 3698 4825 8783 2604 673 2632 5822 3084 |
| | 9095 9913 3912 9850 7102 7121 4583 5132 3859 3618 4979 1024 |
| | 4655 9239 1027 3466 8177 1137 6704 1902 3898 6320 3990 8921 |
| | 9789 7780 1867 720 7797 8984 8792 6677 2787 6486 4974 7096 |
| | 6414 1120 4261 4688 9633 7118 1304 7906 4639 8137 6317 6512 |
| | 5194 7524 3719 8879 5892 6719 10015 2432 5524 5347 4620 7838 |
| | 2349 3742 3336 8156 4407 751 9048 1574 8745 9064 5982 3677 |
| | 3335 8828 2296 6016 2954 2083 7531 750 6967 8907 4754 7306 |
| | 9325 8831 8687 6604 8124 953 5357 6150 4106 7305 448 7370 |
| | 2848 4299 6468 9430 4333 9395 6953 5311 6493 5514 1883 2876 |
| | 4693 645 4187 4174 955 2372 7506 9290 4134 4176 2986 9835 |
| | 4353 3004 4350 4916 2653 9517 5416 2953 2619 8038 8443 5903 |
| | 8092 4082 5327 1767 1761 1781 1763 9578 9787 3277 4719 7767 |
| | 4559 3285 7164 1444 6028 2320 6608 1684 1706 1687 1710 7111 |
| | 7099 5737 6814 6811 386 1976 9411 7973 2663 5521 9734 8257 |
| | 5695 2667 1484 5781 1479 2298 9281 9280 9689 502 6909 4165 |
| | 426 2941 8935 9201 1089 5055 7239 831 1203 9814 9688 385 |
| | 7326 6723 7768 5838 2982 242 2577 3232 9055 8305 5794 7974 |
| | 6114 3340 1764 5723 5940 5567 5093 9792 1635 7645 4958 6863 |
| | 2987 9330 3245 9438 4298 534 3316 5125 6755 4873 1065 6730 |
| | 6904 3603 5948 6903 9042 2384 3197 1325 9053 5820 971 3970 |
| | 7014 4645 2517 5757 7712 3115 3116 3113 6008 3494 9096 9270 |
| | 8942 5369 3727 5382 6563 7718 4888 3393 9383 834 |
| 102: | 4624 1430 1961 1964 5156 999 3374 6267 4084 9627 4383 1556 |
| | 1098 783 6842 7112 7177 7189 4841 9547 456 3255 2850 8504 |
| | 1846 9224 7752 1367 8373 3039 6783 3653 4153 6429 9457 8323 |
| | 4252 6669 202 162 8940 1117 956 5660 7829 5669 4893 5253 |
| | 9367 6594 4400 6788 |
| 103: | 4624 9456 5156 999 6267 3374 4084 5394 6413 7397 8169 6610 |
| | 9718 7876 4383 1098 1556 783 7112 3279 6197 9663 6252 7970 |
| | 7356 4596 1390 5051 5754 7566 980 5947 6353 2721 2365 3317 |
| | 2005 5483 8362 7498 6681 1616 4872 1367 6742 1167 8605 7077 |
| | 3202 8267 3674 8623 7344 6893 869 8068 1122 1124 3653 4153 |
| | 6429 9457 8101 8228 1091 8323 5427 3242 9678 7829 5669 6594 |
| | 4893 157 2141 2249 205 7148 4801 1348 5789 371 9957 3281 |
| | 2933 6102 9219 4400 7744 |
| 104: | 4624 9456 5156 999 6267 4084 5394 6413 7397 8169 9718 6610 |
| | 7876 1098 4383 1556 783 5129 3279 6197 7970 4596 7356 1390 |
| | 5051 5754 7566 5947 980 6353 2721 2365 3317 7189 7177 456 |
| | 1367 6742 1167 3202 7077 8605 8623 8267 3368 7344 6893 3674 |
| | 6783 8068 9341 3935 4153 6429 9457 8101 3987 9140 3035 238 |
| | 8323 5427 3242 7829 5669 6594 4893 157 2141 205 2249 7148 |
| | 4801 4054 1348 5789 9493 8525 371 9957 3281 2933 6102 9219 |
| | 4400 6788 9027 |
| 105: | 7812 882 3025 2739 5708 3306 1560 7612 5164 8369 4656 9015 |
| | 2778 2824 4488 9482 4490 7160 1576 8990 3445 9496 1081 8581 |
| | 8589 9860 6511 559 8419 7407 6212 6227 9129 4498 7269 8072 |
| | 9605 1531 7089 1967 8562 9391 1385 7893 1070 3042 8370 8206 |
| | 1811 5662 5196 4406 4389 5144 4681 4683 4661 7698 3800 6641 |
| | 7414 4547 9756 5711 5714 4033 4037 4039 4035 948 |
| 106: | 9402 8595 2366 8382 1968 3420 6998 1544 1165 8998 1193 5810 |
| | 8051 1252 8171 |
| 107: | 1291 7911 2740 6326 1417 8943 7052 3303 9661 5223 7511 5891 |
| | 5111 6321 4259 4424 4358 9191 2891 8424 8353 2521 6427 1960 |
| | 355 5300 5739 2460 3831 6920 9695 6754 4501 2964 4399 7640 |
| | 8431 7924 3977 1557 2027 3409 1651 8086 9083 8265 313 1774 |
| | 2339 1155 8549 234 6176 5862 3417 4736 6612 2434 |
| 108: | 3765 171 1106 382 6195 8056 5268 5113 472 8844 4982 666 |
| | 8778 6706 7739 2918 9074 3017 4218 9363 9914 5967 7796 9712 |
| | 5449 5635 9520 |
| 109: | 1826 2705 9393 2425 1213 7660 9089 9054 4327 3778 303 4458 |
| | 9486 6741 5431 6169 3381 1431 930 1853 2573 4821 8454 5435 |
| | 1573 |
| 110: | 5969 7138 7828 3577 489 5529 6737 9681 6534 1722 8881 4557 |
| | 8810 4325 7209 9670 5063 2588 3570 2468 3921 9958 9301 5466 |
| | 3869 3523 1591 5729 9783 2404 7123 10012 1898 2921 1361 2199 |

TABLE 2-continued

| PEP SEQ ID NO: | homolog SEQ ID NOs |
|---|---|
| | 6079 4823 6562 3582 4198 2988 1673 9091 6045 745 7254 4887 |
| | 977 564 9761 790 3944 608 1196 5222 966 8036 326 1477 |
| | 2535 9234 1206 4824 2506 5853 1778 6765 919 8702 4812 5353 |
| | 1322 3733 5817 3053 4591 5238 4483 786 852 3201 1588 7489 |
| | 5700 2914 5503 2660 2500 2582 8351 2766 9436 4685 9940 4443 |
| | 8414 1785 1349 417 5680 3107 1447 4089 3425 2643 8291 7197 |
| | 5541 6047 4613 2239 7734 4497 881 7549 2390 7637 6418 5266 |
| | 5855 5325 7607 3119 859 3220 1382 4268 240 5654 3739 8059 |
| | 4397 806 301 2748 4529 838 9166 769 7471 8997 2099 1829 |
| | 3560 8685 3440 4648 6234 642 8422 3978 1239 3217 755 3790 |
| | 2682 1051 5269 8390 6076 676 6647 1805 8971 7955 788 2675 |
| | 161 8217 9631 9610 2898 569 3240 6155 3722 2713 9746 5523 |
| | 6768 5103 4879 6805 6194 5775 7593 7966 1217 1068 592 5777 |
| | 2301 9364 7176 1747 7810 |
| 111: | 1848 7581 8716 1381 3763 9600 464 830 1454 2697 1946 3371 |
| | 3331 5569 5388 8095 1812 8144 5798 9118 4416 2526 6791 6506 |
| | 2295 1757 521 807 6077 9190 8758 1157 2605 5928 4987 256 |
| | 8104 3453 5802 9866 374 6761 |
| 112: | 3041 1135 1343 4097 5330 4575 1412 1253 |
| 113: | 7726 7410 8023 8039 8037 3318 7855 3370 1661 7688 5627 4943 |
| | 8955 8914 4862 1500 344 3426 5227 3502 293 9110 3083 2887 |
| | 9766 1619 6856 2546 6874 6190 6923 5100 4621 9470 8754 9389 |
| | 6376 6441 4422 9154 345 457 6292 571 1061 3909 4751 2793 |
| | 5101 4673 4878 3491 6065 7011 7632 5390 4909 8328 5391 6022 |
| | 9063 1804 3189 3803 880 2123 2931 6650 7789 2392 3478 2204 |
| | 1188 1993 6419 5463 1704 1718 4102 6349 4776 8793 1919 7221 |
| | 1154 8756 3192 1603 8648 1347 1692 9684 3073 3212 8125 1563 |
| | 5012 2143 2731 10006 5240 4915 7389 1729 7639 6319 844 2263 |
| | 6343 891 3352 590 593 578 591 8035 6049 6731 7592 1145 |
| | 7686 9079 4699 5323 4303 1000 579 340 9696 539 7817 7814 |
| | 352 6724 1917 3594 8858 8853 8855 1866 2559 5673 |
| 114: | 9538 6322 7202 4360 8216 2187 2190 2706 8864 7631 4191 753 |
| | 4188 3875 4002 8728 5819 8780 4946 5823 5429 9409 4797 1914 |
| | 9292 4470 1705 8384 2457 7603 5603 8655 376 7135 3249 3241 |
| | 5239 1064 1066 7518 6038 6924 3213 3207 5845 2936 6683 5372 |
| | 10011 9763 9153 4074 4666 7043 8312 4569 1296 3499 3846 5324 |
| | 5997 7365 3321 2810 4489 5162 9846 1282 8791 5848 5696 6367 |
| | 5854 3923 6828 9284 2736 6767 4015 4001 7119 7128 6819 6637 |
| | 6746 5893 8436 3198 954 9398 4215 6750 1094 429 6157 7446 |
| | 5377 6108 7283 2695 597 5092 227 5082 143 142 4345 4731 |

TABLE 2-continued

| PEP SEQ ID NO: | homolog SEQ ID NOs |
|---|---|
| | 5584 4024 1933 9022 1446 8586 6315 9886 8896 1441 3322 2485 |
| | 9887 1859 4473 4598 1725 1723 1711 1727 4684 1789 3375 2128 |
| | 1830 7859 7156 4538 461 5632 4722 4804 449 7646 4227 5060 |
| | 4568 5604 6193 2360 3728 5736 1183 4672 3037 9327 688 466 |
| | 1275 1707 2012 6397 463 3789 2075 6517 6083 2533 2036 726 |
| | 6533 899 8318 6219 508 312 5191 1874 4144 704 762 1810 |
| | 4409 6251 5115 4914 526 3447 1665 9116 2732 5462 7997 1995 |
| | 8681 1540 3384 9404 2304 4761 3200 9823 622 1354 5145 9265 |
| | 1685 8769 8873 8475 1862 5428 3807 1585 1457 9535 7023 7207 |
| | 8840 3150 7215 4107 3879 4554 1912 9215 1955 2217 4314 6198 |
| | 6851 7248 3714 1842 6726 3068 1234 1314 8417 5801 6952 7120 |
| | 2118 643 7187 7053 7671 9298 4633 4795 2872 634 6275 3390 |
| | 5246 |
| 115: | 6527 5534 7630 1822 3812 8830 7349 8173 8230 6454 823 5742 |
| | 7635 2370 6734 3441 7401 1825 7723 1776 8502 4376 9849 8505 |
| | 9918 1246 5086 9880 5477 1168 6035 263 6347 7450 4783 8460 |
| | 3576 1626 1550 6648 3860 6467 9774 1264 5066 3347 9869 4031 |
| | 1128 9691 6162 7227 3529 3184 3182 6301 6712 |
| 116: | 6340 2512 9223 8511 1411 9838 4614 2313 8017 3726 7853 4136 |
| | 7242 5908 4839 3629 2463 8002 685 2572 5679 9641 5049 6231 |
| | 3777 9346 570 2598 5766 4493 1856 3171 633 3079 3519 6914 |
| | 6119 4782 9549 944 6394 1818 3916 7353 2995 5902 2095 747 |
| | 9917 9933 4752 4734 4779 493 3829 5900 7925 2928 2157 1988 |
| | 7313 4921 4689 9543 1857 4528 407 9514 9214 3665 3506 2973 |
| | 3045 4875 6374 6390 4895 6392 6393 8200 4551 6433 5790 2532 |
| | 6707 8937 4894 7719 7722 6196 4546 7019 6334 5718 2693 8868 |
| | 8337 7624 8084 5368 1792 1809 5308 5291 3604 2470 4720 1363 |
| | 2244 6555 1691 5954 5228 5208 5224 3448 5362 9613 5230 7162 |
| | 8616 2935 5756 4391 4390 4378 9775 1461 914 4939 6668 2178 |
| | 4494 4491 4492 4447 4446 4398 4401 4423 3968 4462 6837 7793 |
| | 8451 922 9304 4070 7852 1526 1527 2223 387 246 1554 8977 |
| | 6547 3865 1386 684 8322 252 248 249 4690 2214 7084 6873 |
| | 328 9533 8682 4926 4698 7268 2344 9907 6963 6033 7577 297 |
| | 5424 3515 8897 9306 2854 9203 7342 949 6487 8468 2389 9019 |
| | 6360 377 9321 7871 1683 1290 4183 3397 3219 4855 4853 7564 |
| | 8066 2391 2364 2341 2308 2336 2359 2312 2355 2291 8674 8676 |
| | 2309 2334 2338 2293 6361 5880 4164 2896 8031 6630 5425 7499 |
| | 1442 |

TABLE 2-continued

| PEP SEQ ID NO: | homolog SEQ ID NOs |
|---|---|
| 117: | 3877 5727 4241 1513 5672 903 2629 7240 1570 3522 6209 6399 |
| | 7453 4618 848 9822 1978 8047 7126 9241 3754 6401 6838 8863 |
| | 8632 7454 5580 8522 7895 |
| 118: | 3495 5400 9889 6676 3537 2811 5961 7327 7081 3672 180 3487 |
| | 729 9474 1384 3951 5271 717 7942 6235 5455 4990 9372 1754 |
| | 1073 6133 7304 7521 |
| 119: | 9634 7978 4066 4065 2009 5886 5171 8727 7846 9806 2815 4941 |
| | 1225 8445 4436 2407 3775 5616 4453 5778 6515 6090 4925 4646 |
| | 5370 6739 7765 4381 8172 1108 1839 7443 330 7806 7804 1251 |
| | 7085 1192 1195 8607 6203 9771 698 8705 5590 5598 5592 5596 |
| | 3601 9117 2765 3559 343 7898 8931 3693 3692 1611 1610 365 |
| | 5981 1171 764 5611 5444 5881 8797 7530 2017 8983 2997 2930 |
| | 6738 5270 1786 9245 3759 1888 4980 6122 5354 3372 9297 5120 |
| 120: | 9228 4471 4904 8878 2071 9785 822 6100 8130 8957 6961 1787 |
| | 9828 6974 5058 6048 2058 1334 8704 4992 625 3328 4222 2494 |
| | 8453 5397 4969 4450 4318 2859 1370 1074 323 8974 4426 6663 |
| | 5231 4130 5715 6857 4963 5687 5392 8795 5871 8912 6299 1801 |
| | 2634 2636 1802 3896 9268 8278 3174 7026 7220 8074 8650 9102 |
| | 9287 7583 7097 8408 7371 7667 195 5536 2730 3535 2115 4088 |
| | 1078 5734 6232 6400 5785 9041 5946 5806 533 6762 5167 3509 |
| | 7720 6425 1775 5393 9808 2671 5316 1712 9504 4010 5818 4041 |
| | 4667 2542 3854 9371 235 4204 6216 4774 1599 2661 3975 8489 |
| | 1947 6860 3465 9213 3323 6144 9350 1311 6868 1029 5543 7654 |
| | 5689 9138 4901 3646 4370 5447 3568 9049 191 9432 7500 3216 |
| | 1937 1287 2215 3057 4331 2431 3662 2335 4680 9924 9464 9069 |
| | 2446 1136 9899 6634 3821 7491 5743 3818 5952 7694 5008 7044 |
| | 427 2844 993 3332 3542 9555 7509 2655 9733 5930 9935 2885 |
| | 3456 4859 5366 9953 703 1152 8430 4437 7699 8295 1423 695 |
| | 8683 1317 3715 6834 613 3411 1147 6674 3578 9109 2999 7881 |
| | 8241 6528 3430 2831 9772 7685 4897 7480 601 7250 9392 2656 |
| | 8567 4984 3736 9512 9647 5430 4593 748 6576 8827 3346 9892 |
| | 4300 3364 7086 6670 4459 7543 3063 3463 5232 5575 9624 1514 |
| | 1882 4732 5860 3475 5168 6684 6581 6437 8357 2423 4876 2589 |
| | 4866 4870 2803 6735 8307 4675 4142 798 2816 5545 867 2253 |
| | 5522 3595 2944 1158 840 7251 6225 8152 6818 7384 8440 8966 |
| | 5155 6030 7494 5408 8341 7914 7909 1602 8527 9112 2828 2829 |
| | 5360 4922 4427 459 9254 1278 7587 10010 5614 5712 6699 1041 |
| | 6085 1953 5422 1038 1533 8211 5116 4737 7492 9123 1237 3782 |
| | 5218 8775 8058 7078 9592 1095 9142 325 368 4520 6553 5378 |
| | 6134 8299 1309 2520 7542 9412 7800 6452 5355 3976 9725 7636 |
| | 7309 525 9834 4503 5283 870 5203 |
| 121: | 9228 4471 4904 8878 2071 9785 822 6100 8130 8957 6961 1787 |
| | 9828 6974 5058 6048 2058 1334 8704 4992 625 3328 4222 2494 |
| | 8453 5397 4969 4450 4318 2859 1370 1074 323 8974 4426 6663 |
| | 5231 4130 5715 6857 4963 5687 5392 8795 5871 8912 6299 1801 |
| | 2634 2636 1802 3896 9268 8278 3174 7026 7220 8074 8650 9102 |
| | 9287 7583 7097 8408 7371 7667 195 5536 2730 3535 2115 4088 |
| | 1078 5734 6232 6400 5785 9041 5946 5806 533 6762 5167 3509 |
| | 7720 6425 1775 5393 9808 2671 5316 1712 9504 4010 5818 4041 |
| | 4667 2542 3854 9371 235 4204 6216 4774 1599 2661 3975 8489 |
| | 1947 6860 3465 9213 3323 6144 9350 1311 6868 1029 5543 7654 |
| | 5689 9138 4901 3646 4370 5447 3568 9049 191 9432 7500 3216 |
| | 1937 1287 2215 3057 4331 2431 3662 2335 4680 9924 9464 9069 |
| | 2446 1136 9899 6634 3821 7491 5743 3818 5952 7694 5008 7044 |
| | 427 2844 993 3332 3542 9555 7509 2655 9733 5930 9935 2885 |
| | 3456 4859 5366 9953 703 1152 8430 4437 7699 8295 1423 695 |
| | 8683 1317 3715 6834 613 3411 1147 6674 3578 9109 2999 7881 |
| | 8241 6528 3430 2831 9772 7685 4897 7480 601 7250 9392 2656 |
| | 8567 4984 3736 9512 9647 5430 4593 748 6576 8827 3346 9892 |
| | 4300 3364 7086 6670 4459 7543 3063 3463 5232 5575 9624 1514 |
| | 1882 4732 5860 3475 5168 6684 6581 6437 8357 2423 4876 2589 |
| | 4866 4870 2803 6735 8307 4675 4142 798 2816 5545 867 2253 |
| | 5522 3595 2944 1158 840 7251 6225 8152 6818 7384 8440 8966 |
| | 5155 6030 7494 5408 8341 7914 7909 1602 8527 9112 2828 2829 |
| | 5360 4922 4427 459 9254 1278 7587 10010 5614 5712 6699 1041 |
| | 6085 1953 5422 1038 1533 8211 5116 4737 7492 9123 1237 3782 |
| | 5218 8775 8058 7078 9592 1095 9142 325 368 4520 6553 5378 |
| | 6134 8299 1309 2520 7542 9412 7800 6452 5355 3976 9725 7636 |
| | 7309 525 9834 4503 5283 870 5203 |
| 122: | 5149 8274 1269 5690 5410 6173 3556 3468 4438 1208 5663 545 |
| | 7791 167 8526 3554 3890 5517 2633 5799 7332 3855 |
| 123: | 6613 2955 6069 4371 9778 2358 6094 6089 6526 8516 5547 6071 |
| | 3313 6112 4034 2957 2978 5525 5509 5531 5528 5561 5607 5578 |
| | 5565 5581 5579 5526 5533 8275 9649 3706 6832 6350 5088 1150 |
| | 1439 5916 5281 2689 4704 6036 7641 3679 9051 6455 6836 861 |
| | 3525 9267 551 1047 9231 6871 6525 6523 3862 6179 7206 2549 |
| | 3992 178 3349 2003 9082 2354 3011 3013 6910 9731 555 1033 |
| | 8344 6990 7131 5177 8976 9092 1601 1598 1608 8048 8418 3451 |
| | 7002 4523 8340 5474 2917 7702 4505 7759 6992 6991 4145 9590 |

TABLE 2-continued

| PEP SEQ ID NO: | homolog SEQ ID NOs |
| --- | --- |
| | 9714 3423 9656 7573 3644 350 6892 6889 403 423 9597 10004 |
| | 8938 1952 9076 2084 3308 849 8160 1899 2114 8649 3702 4565 |
| | 6473 4071 5833 2038 3309 9303 3587 3472 9061 6685 194 646 |
| | 6121 5506 2376 9559 2417 3376 3360 1834 9759 2899 2901 6629 |
| | 5631 7670 8613 2962 9803 2743 2363 6848 9146 8108 8882 1697 |
| | 9779 3960 9830 4022 7740 4346 4615 3012 2583 803 5888 8151 |
| | 1450 8428 6588 5909 3963 6185 5814 1539 274 3076 10003 10005 |
| | 1221 1737 4288 6470 8686 2601 6469 5276 2937 6200 5380 172 |
| | 7523 9242 1590 266 973 7743 1032 9357 5552 9716 3259 6628 |
| | 3263 4120 3258 2581 3260 4555 5197 1295 7028 5131 9343 8641 |
| | 5953 2790 4533 3684 6756 8425 7620 9044 4484 4442 6589 7205 |
| | 2544 5999 5110 7690 3707 6257 8989 5519 4451 9747 4199 8386 |
| | 3597 3792 4276 797 2990 3048 5601 359 7576 1657 3740 8176 |
| | 9455 612 694 7192 9414 7194 254 581 2378 2380 1235 7600 |
| | 1272 3830 6792 5403 3464 3261 6428 8573 8600 9589 5505 5333 |
| | 2150 9945 536 8952 6290 8741 9349 7929 6110 6101 6554 6551 |
| | 7005 6556 2195 2194 9934 6053 5550 6091 6097 1294 4304 6796 |
| | 5401 3015 3974 9921 2789 8083 8082 6710 8905 7514 576 3319 |
| | 5564 4590 9666 515 6745 5138 5139 2130 2645 6228 3562 8634 |
| | 9178 6536 4361 3337 9699 8491 7757 4905 3257 7611 6743 9014 |
| | 3439 6120 1783 1850 8136 4851 661 800 6654 2866 1759 7551 |
| | 2690 4141 6430 654 527 7495 5412 8061 2455 8022 4435 4155 |
| | 1201 7714 5423 7689 7485 7469 7473 7463 7348 5512 575 5548 |
| | 7021 6070 5585 9708 3749 |
| 124: | 7858 8376 2905 7510 6066 7834 594 9979 7103 3214 2892 4020 |
| 125: | 1965 1299 9851 8509 7263 1130 8178 2737 8180 3769 8759 9805 |
| | 1981 9059 8530 1473 9765 4269 4292 1925 7809 4290 9845 314 |
| | 7374 231 4410 7211 4323 7033 6382 6485 4356 7873 9342 5560 |
| | 5071 3031 305 8559 247 1595 5021 4580 1249 8659 3872 6504 |
| | 5803 5906 8242 4525 8657 8070 598 5089 283 2903 2720 7170 |
| | 2274 8111 2729 7063 1409 2646 5774 5385 2760 5834 8876 7082 |
| | 3856 4842 5034 1645 7857 1744 9722 3900 2635 3326 6930 444 |
| | 5800 4668 3489 3366 3363 6548 1067 6568 3580 9755 462 1517 |
| | 3282 5254 7231 5879 5640 9730 8264 6866 8271 8219 8982 8518 |
| | 7330 5152 6006 362 6587 3857 8189 1021 4928 6146 7366 1017 |
| | 4985 6287 269 9285 8103 6140 8900 8461 8042 7513 1530 8908 |
| | 9187 7436 5320 7656 1494 1750 9428 8182 5863 1567 4944 9088 |
| | 4138 3394 3493 2812 5989 8558 2028 7289 1771 1452 9932 5027 |
| | 5309 2398 5097 8009 201 2519 8192 5965 8374 8356 6799 7965 |
| | 6539 3530 4701 563 8194 7382 410 5432 2428 265 5697 6229 |
| | 331 2681 8269 4012 7866 7729 1913 2904 4157 3917 |
| 126: | 5740 333 3685 6489 6369 4339 7931 3455 392 7908 5602 1268 |
| | 5664 6024 5557 2057 1003 8161 4098 8684 6875 9916 6781 936 |
| | 9710 7735 5417 7273 887 5812 |
| 127: | 5856 1578 7377 3621 5827 3671 2110 9481 4233 1104 8163 9262 |
| | 4971 2839 3787 5613 3078 2259 8139 5793 3459 5929 2801 2151 |
| | 8722 3469 2286 3100 5637 6002 1085 7774 3391 1250 5804 1639 |
| | 512 660 4885 7730 3038 9471 9992 825 7282 9937 2080 2108 |
| | 8747 7188 1529 5986 8046 6381 1331 2403 209 1777 8557 1506 |
| | 2579 8482 3343 2553 565 3342 3401 6464 5117 8449 3528 7042 |
| | 1092 4056 4605 3546 5074 4182 6213 3686 8439 7265 9894 2923 |
| | 4307 3005 7934 287 3138 6664 6013 4832 4468 3283 6236 9800 |
| | 7555 7668 2445 8349 8224 8032 6172 7963 7938 7860 7910 7940 |
| | 7907 7451 8523 7548 8917 4291 4210 5628 7633 8801 2658 5498 |
| | 6844 9034 992 6878 638 5185 3614 3001 2430 5371 2297 3099 |
| | 3329 2769 5307 818 5470 1002 3141 1414 9309 8679 8656 5433 |
| | 8459 4544 7977 2596 4036 6311 8615 7375 4284 7400 2159 1895 |
| | 6521 4711 1896 2666 9809 1537 3569 6829 6890 8347 5244 2023 |
| | 9596 210 8696 3632 3636 7413 7411 3341 5996 9252 6570 6106 |
| | 2550 827 9397 7998 5434 6501 421 6820 4792 8862 2587 1686 |
| | 5844 8143 2650 9719 2952 7764 7310 7350 4419 7343 4953 2281 |
| | 6922 998 732 4907 3656 3861 7773 1362 540 9872 4889 4717 |
| | 5358 4967 3442 9026 1186 1545 3768 3848 397 1733 7778 3230 |
| | 3231 2907 5201 4679 4662 2132 7944 9893 9351 9176 7697 4264 |
| | 4814 2142 7990 9856 9426 9361 4582 1406 2310 8164 8601 8738 |
| | 3162 3793 5143 9494 8400 2046 2045 4978 5677 7136 2474 5014 |
| | 5007 5017 5011 5639 3867 5691 5713 4168 4184 2860 1543 9881 |
| | 2070 8772 9552 6943 577 8594 2433 2435 6495 9544 4137 1833 |
| | 9946 6276 6143 6141 5825 6671 5735 8848 7146 7144 4623 5738 |
| | 184 9876 7225 9462 9460 9465 5910 2383 4800 5870 5869 273 |
| | 9875 9873 222 9840 4786 981 3797 1770 4201 7394 3143 9906 |
| | 1220 6221 4682 4697 6465 7159 6643 3631 3660 3640 3639 3638 |
| | 3635 3154 3650 3082 9499 1198 8043 8063 9598 7101 1871 1197 |
| | 4535 6057 7181 5995 6202 934 5123 5106 5576 5128 6688 6678 |
| | 4536 952 3461 5374 6774 9942 1230 6306 3483 5047 5450 4652 |
| | 9013 4964 7678 5914 3945 5931 5883 3330 584 7843 7842 7848 |
| | 7868 7847 4173 8628 8577 8303 8804 4589 |
| 128: | 5856 1578 7377 3621 5827 3671 6513 2110 9481 4233 1104 8163 |
| | 9262 4971 2839 3787 5613 3078 2259 8139 5793 3459 5929 2801 |

TABLE 2-continued

| PEP SEQ ID NO: | homolog SEQ ID NOs |
|---|---|
| | 2151 8722 3469 2286 3100 5637 6002 1085 7774 3391 1250 5804 |
| | 1639 512 660 4885 7730 3038 9471 9992 825 7282 9937 2080 |
| | 2108 8747 7188 1529 5986 8046 6381 1331 2403 209 1777 8557 |
| | 1506 2579 8482 3343 2553 565 3342 3401 3108 8272 3784 4267 |
| | 6464 5117 8449 3528 7042 1092 4056 4605 3546 5074 4182 6213 |
| | 3686 8439 7265 9894 2923 4307 3005 7934 287 3138 6664 6013 |
| | 4832 4468 3283 6236 9800 7555 7668 2445 8349 8224 8032 6172 |
| | 2670 7963 7938 7860 7910 7940 7907 7451 8523 7548 8917 4291 |
| | 4210 5628 7633 8801 2658 5498 6844 9034 992 6878 638 5185 |
| | 3614 3001 2430 5371 2297 3099 3329 2769 5307 8420 818 5470 |
| | 1002 3141 1414 9309 8679 8656 5433 8459 4544 7977 2596 4036 |
| | 6311 8615 7375 4284 7400 2159 1895 6521 4711 1896 2666 9809 |
| | 1537 3569 6829 6890 8347 5244 2023 9596 210 8696 3632 3636 |
| | 7413 7411 3341 5996 9252 6570 6106 2550 827 9397 7998 5434 |
| | 6501 421 6820 4792 8862 2587 1686 5844 8143 2650 9719 2952 |
| | 7764 7310 7350 4419 7343 4953 2281 6922 998 732 7563 4907 |
| | 3656 3861 7773 1362 540 9872 4889 4717 5358 4967 3442 9026 |
| | 1186 1545 3768 3848 397 1733 7778 3230 3231 2907 5201 4679 |
| | 4662 2132 7944 9893 9351 9176 7697 4264 4814 2142 7990 9856 |
| | 9426 9361 4582 1406 2310 8164 8601 8738 3162 3793 5143 9494 |
| | 8400 2046 2045 4978 5677 7136 2474 5014 5007 5017 5011 5639 |
| | 3867 5691 5713 4168 4184 2860 1543 9881 2070 8772 9552 6943 |
| | 577 8594 2433 2435 6495 9544 4137 1833 9946 6276 6143 6141 |
| | 251 5336 5825 6671 5735 8848 7146 7144 4623 5738 184 9876 |
| | 7225 9462 9460 9465 5910 2383 4800 5870 5869 273 9875 9873 |
| | 222 9840 4786 981 3797 1770 4201 7394 3143 9906 1220 6221 |
| | 4682 4697 6465 5600 7159 6643 3631 3660 3640 3639 3638 3635 |
| | 3154 3650 3082 9499 1198 8043 8063 9598 7101 1871 1197 4535 |
| | 6057 7181 5995 6202 934 5123 5106 5576 5128 4166 6688 6678 |
| | 4536 952 9386 3367 3461 5374 6774 9942 1230 6306 3483 5047 |
| | 5450 4652 9013 4964 7678 5914 3945 5931 5883 3330 584 7843 |
| | 7842 7848 7868 7847 4173 8628 8577 8303 8804 4589 |
| 129: | 6283 2094 3062 2271 6254 9056 4151 3773 1819 5768 1674 7328 |
| | 5634 9770 3114 9282 6309 9704 845 5395 7738 5398 1796 5098 |
| | 1232 5972 |
| 130: | 7784 5453 9584 6859 9085 5136 9525 2342 2327 2326 8227 3072 |
| | 6540 5884 9046 3774 9221 8368 4647 6152 6616 4140 5610 267 |
| | 1654 9864 3834 9194 5858 3771 2074 3054 970 1835 1677 7614 |
| | 6954 3403 6800 1641 7395 5591 3386 9950 8611 856 1858 1520 |

TABLE 2-continued

| PEP SEQ ID NO: | homolog SEQ ID NOs |
|---|---|
| | 473 8885 6011 9711 9825 9859 3111 5119 1429 1523 3561 1945 |
| | 9938 5482 3348 2385 6226 3194 3839 9243 3008 4170 6662 1892 |
| | 2971 766 6573 409 5075 4890 9646 5026 9188 942 940 7917 |
| | 938 7915 6978 1566 4359 5107 6149 1921 9205 558 2593 9767 |
| | 3663 3485 4395 5451 1327 3271 725 793 4006 2369 465 3590 |
| | 858 4660 8466 5760 453 2677 3069 3964 3914 4301 3064 3301 |
| | 7884 2946 9593 1301 1216 9620 2994 2405 3203 6375 2147 4373 |
| | 9796 8212 4251 5659 3187 9170 2662 2694 5304 4050 4069 4047 |
| | 6861 9115 2858 481 4119 7615 7762 10016 6239 337 338 8599 |
| | 8597 929 927 924 363 7717 204 5991 3852 6318 1176 1179 |
| | 2056 2441 8533 628 2053 8174 5619 1515 5080 7386 6250 7883 |
| | 2826 5083 1164 9070 1162 1160 1438 1436 913 3235 596 3680 |
| | 4588 4570 6183 6184 8547 367 1416 380 1891 3924 5262 5013 |
| | 4687 5467 8364 7479 6919 5452 6845 2870 2993 3956 4175 1153 |
| | 7594 1878 2488 9668 3669 9251 5263 7422 8183 5174 6764 8181 |
| | 404 2913 6297 604 812 8190 9618 3480 3278 2591 5960 1324 |
| | 7168 7056 8115 5520 9207 8128 218 1127 3477 3670 3125 8175 |
| | 7877 1752 2733 1141 4208 4347 1178 1655 4864 9388 7195 1831 |
| | 7319 2809 9983 8576 8209 6211 5985 7193 7172 3476 6946 8553 |
| | 8127 336 9078 7210 7452 842 6296 7259 8099 262 7208 5730 |
| | 3224 5151 9273 3752 2509 4744 9275 8065 3772 8089 1647 761 |
| | 393 9365 3811 2436 2699 9248 2055 5846 4705 4287 1594 2863 |
| | 4479 6327 416 3939 1110 8556 8259 1688 3628 1083 9741 6541 |
| | 4025 4046 4026 815 2691 8354 2970 2976 8363 5782 6532 6520 |
| | 7608 3545 6249 10017 8969 170 7412 2402 1726 2886 6760 2893 |
| | 8941 8926 1099 8899 5043 8842 9093 9097 9094 3237 997 5732 |
| | 6302 4820 483 599 3492 485 9120 4799 5221 6286 3496 9084 |
| | 5010 8262 3704 5443 4626 583 9310 4048 8575 3981 3979 7967 |
| | 9931 8221 203 193 9874 470 4105 864 6260 2222 791 2909 |
| | 2949 8495 479 5872 216 3623 3236 9418 3607 4308 7455 3010 |
| | 9192 1583 9348 5873 796 9882 8903 2724 9328 3934 3514 7540 |
| | 6894 8289 10013 8967 7832 9868 5251 8336 6242 6691 6785 2443 |
| | 1097 7889 7093 6508 4232 2438 2247 9065 6246 6168 6186 621 |
| | 1149 9707 2641 3609 2735 7025 420 1824 7038 9975 5137 8767 |
| | 7252 6126 3695 478 4249 9959 6269 8608 5706 951 3884 316 |
| | 6858 4028 4644 7046 1823 1357 6802 7127 9616 4121 3047 7634 |
| | 1870 302 4118 2842 652 6907 9815 9812 3365 9764 4844 4849 |
| | 4847 4846 2929 6567 8044 7445 2818 8838 8841 7861 8986 5665 |
| | 8545 9143 6751 6789 9944 |

TABLE 2-continued

| PEP SEQ ID NO: | homolog SEQ ID NOs |
| --- | --- |
| 131: | 5504 7201 9080 4524 6201 3840 4320 2523 2135 7287 7299 9617 |
| | 6355 4519 632 4321 7887 8869 366 8507 2280 8201 3170 697 |
| | 696 7153 6491 8338 8389 8397 8381 8377 8380 8358 8393 8391 |
| | 8394 8313 8352 8415 8317 8334 8333 8361 8314 8315 8332 8335 |
| | 8375 5831 5829 7224 1326 8514 946 7226 2939 327 649 1493 |
| | 3809 4297 4080 2845 1795 5346 6667 309 1854 1140 7837 2545 |
| | 7199 1133 1129 1151 1115 1146 1985 1959 1957 1983 3307 8045 |
| | 3741 3761 3758 6087 9379 4826 6544 675 538 8707 5857 9832 |
| | 8154 8796 1629 5286 8321 7217 824 2711 9035 9036 3030 975 |
| | 7674 6483 7661 8936 1875 5973 4043 1380 1475 4930 2958 7261 |
| | 1499 3014 1118 4597 9776 4045 9394 1075 5052 3239 6900 4517 |
| | 7736 1105 9534 2745 1713 8191 6041 1894 9169 2207 9058 9057 |
| | 7606 9010 6901 6139 8120 7458 1100 8906 6027 419 4516 1121 |
| | 1840 5685 742 3398 4315 7584 5975 7854 6034 580 672 3555 |
| | 7613 5650 1836 8040 3428 8666 2077 1708 437 4402 3169 7183 |
| | 6217 6054 7882 665 3473 2638 2784 674 8719 5127 7087 5042 |
| | 9757 8027 395 2919 511 6695 7456 560 3549 8964 286 3470 |
| | 9697 8561 2708 6753 9472 2611 7750 7001 342 3233 3234 5990 |
| | 4867 5918 321 9956 2156 5769 6864 320 6627 7213 7184 9216 |
| | 544 4092 5302 6529 1682 1907 4691 5608 1063 7337 2808 9500 |
| | 1975 9163 2361 4923 6408 6445 7405 1974 5389 9491 3969 6957 |
| | 8378 3026 3751 5198 8427 8438 8584 8587 5030 5340 9031 5970 |
| | 3246 5935 5841 7679 391 4480 451 4813 6214 3457 8155 8236 |
| | 9366 710 8960 3718 4721 7862 3936 8627 1552 3825 1633 6948 |
| | 4863 7763 8131 5038 335 6404 1109 253 5375 991 1827 1503 |
| | 2479 2503 6313 4724 4816 6673 9553 2085 9222 9687 2686 3888 |
| | 5409 2127 5964 9572 681 3989 6809 9602 5922 9591 2756 2758 |
| | 6689 8560 1663 5987 4502 5912 8708 8737 8713 1575 6507 4057 |
| | 2862 469 1869 7285 8781 7390 1437 3602 9071 9713 2412 2922 |
| | 1209 5744 5692 1026 9522 5688 3097 9739 9900 7071 7359 7822 |
| | 4049 8760 349 690 2499 2502 2505 2498 1337 2791 5897 5606 |
| | 4991 3385 3598 9168 5609 9723 9452 5114 1422 542 9513 1289 |
| | 3327 6439 1584 8412 4773 1330 5478 8055 9066 3902 8510 1970 |
| | 3043 422 425 4014 7799 6230 2105 6258 6010 9413 8660 2628 |
| | 6270 6876 4757 1582 1581 5586 9313 2411 3471 2774 9575 4886 |
| | 4883 4884 1215 785 4052 9911 8024 9256 3819 2592 4122 4055 |
| | 2104 8273 8711 3776 4609 5894 5414 5418 5415 5642 996 5943 |
| | 6109 4051 4053 8715 8689 8709 8717 8692 8688 5287 2817 9609 |
| | 7733 9086 6128 4075 7772 6277 6273 4787 3051 8442 8712 4124 |
| | 2000 4725 1483 9000 9477 2674 278 7578 3218 1900 1350 6241 |
| | 1920 6638 5305 6621 9702 4686 7782 6159 7362 5339 1623 8116 |
| | 1283 7783 3123 3850 5188 8534 6749 6062 7680 4280 6471 5968 |
| | 5335 9529 7785 6059 4403 9104 1212 9615 6740 3591 2050 2501 |
| | 802 9315 8981 1486 9161 2203 821 6989 8360 5767 501 5220 |
| | 5243 5219 1306 2318 1308 1569 3903 7296 1023 5411 7922 10000 |
| | 8193 5033 7826 8112 1031 480 9434 8638 2548 6644 6659 926 |
| | 1281 3863 6885 5018 4324 8240 5645 1451 1428 9255 5020 4604 |
| | 4477 2089 4986 5016 4449 4981 4472 4466 7926 3449 7930 5796 |
| | 7352 8479 4487 8945 8107 3619 1039 5716 943 5762 4636 6158 |
| | 553 6272 3897 8815 1257 974 2294 2276 804 846 2807 7643 |
| | 2248 9745 506 6040 557 2227 6288 6293 4240 257 8598 6115 |
| | 7125 4527 7301 5367 5048 2504 3901 5615 6160 7427 9645 |
| 132: | 7833 5889 3007 8109 5915 2022 6345 3652 3805 4242 6959 5248 |
| | 6384 1580 8887 6294 1739 9842 6700 3666 2480 3620 7472 9016 |
| | 9795 276 1758 5135 1256 3574 7061 4918 7154 1916 2076 9159 |
| | 3416 4625 1865 1670 9896 6240 8603 8205 6782 8883 877 7470 |
| | 7190 |
| 133: | 3767 1936 390 6879 5949 8320 4341 1797 9923 5720 7626 5638 |
| | 8294 5250 5783 4649 3513 3058 519 7034 4635 7649 7684 4411 |
| | 7300 4860 7598 9786 3415 4337 4344 7610 3729 4393 7627 1303 |
| | 9821 5057 520 6928 3675 494 8993 2837 7701 2841 8011 6082 |
| | 6341 495 7302 7878 8508 7303 9857 4723 3748 5707 6773 7432 |
| | 918 3886 8446 2456 7372 1768 3467 6125 5805 4521 2163 2258 |
| | 9581 4275 4278 4277 6407 5172 4628 2564 4139 2574 |
| 134: | 9820 3178 3325 9629 4845 7949 7988 6657 1236 4592 310 4063 |
| | 1123 2925 2783 7441 3361 4193 7477 4906 2980 4000 |
| 135: | 4310 4445 1549 1551 3520 6747 1048 9936 8536 4394 3173 8330 |
| | 2117 6095 9293 4238 4200 4617 3566 9898 2444 |
| 136: | 7669 3429 8564 5459 5927 2547 8365 5562 7856 |
| 137: | 7203 1791 7073 4234 972 3070 439 9332 8118 4541 3482 648 |
| | 537 5289 5540 490 702 664 1008 6187 7074 6233 6163 4384 |
| | 8150 5035 1644 4408 6682 3350 8610 3596 230 3531 3948 898 |
| | 219 1056 4256 8367 3221 4110 4671 5460 2049 9396 2900 2969 |
| | 9748 389 9212 1864 5652 2316 3193 8423 7844 243 7890 1403 |
| | 2437 6939 332 5108 1139 3836 4791 3688 3868 5811 9804 1305 |
| | 7891 2082 8288 5255 7561 8519 5295 7387 5694 5274 9863 6912 |
| | 8622 3682 5241 8843 9768 4465 5859 1838 5905 1199 524 2161 |
| | 2578 9604 1383 9340 2346 616 1159 7597 8811 4810 945 968 |
| | 5461 5898 1202 5573 8859 3581 6206 6103 4456 3135 1772 2420 |

TABLE 2-continued

| PEP SEQ ID NO: | homolog SEQ ID NOs |
|---|---|
| | 1542 9260 6174 562 1605 1656 6955 6926 6358 441 9249 2800 |
| | 8387 3191 334 2847 6264 872 687 8724 8761 549 567 582 |
| | 507 5130 8455 3399 4068 2609 6331 5656 4441 2510 2332 3481 |
| | 4081 9524 6696 6218 4369 4945 4309 4977 405 6983 6870 7927 |
| | 4526 2262 7867 4653 2920 5839 2357 3696 2951 3527 3462 1263 |
| | 1881 5247 9669 6111 9269 6592 4622 5763 8052 4584 5303 9133 |
| | 9742 1799 5298 5348 2353 408 6603 1498 4948 1468 6569 4552 |
| | 4474 6215 9167 8635 3889 3190 6852 6001 2924 6593 1769 9650 |
| | 8304 5072 3090 6124 6966 6156 5792 7585 9548 4237 4190 6153 |
| | 7245 9753 4877 3298 3746 1328 6557 8823 8653 2152 353 424 |
| | 5626 9311 7214 4534 4537 8243 2229 1536 1559 3540 3539 2772 |
| | 294 1511 1204 9644 1227 1332 6205 8680 6524 9632 2875 1173 |
| | 7336 9927 8110 3755 9682 7367 8630 2454 3973 5134 3040 8782 |
| | 8372 199 1015 2599 6284 2131 9652 9977 4718 2747 2315 1977 |
| | 4229 5568 2490 4404 3624 3794 1205 6459 5436 5438 3000 2998 |
| | 223 1445 2176 3648 3647 614 9919 3503 1333 4230 285 6261 |
| | 2409 4607 8222 3883 8049 9508 7003 3315 8218 5212 1954 7696 |
| | 7141 6117 3021 5587 3606 7591 1054 3882 9819 548 2096 4432 |
| | 2507 2406 4146 3563 603 7104 9676 3832 5518 4567 1994 7175 |
| | 3096 6776 7786 6338 186 8520 5752 630 8740 5658 5674 2763 |
| | 8877 5701 6518 1260 8398 8918 7622 8077 2861 9735 8643 5686 |
| | 6827 5648 4664 950 1885 9164 668 528 656 6068 9043 8808 |
| | 4152 8817 4150 5780 5776 9902 5830 5073 324 5617 5625 7408 |
| | 5329 6642 318 7647 4115 |
| 138: | 8968 2512 9223 8511 3726 6931 2463 9346 570 2598 2374 2120 |
| | 6914 6119 944 6394 1818 7353 9429 747 3887 9917 9933 4752 |
| | 2216 1923 9626 493 2928 3665 4875 4912 6403 6405 6433 8937 |
| | 4874 9507 1293 1302 4892 6196 7019 2623 2620 9448 9929 3532 |
| | 198 7447 1262 9816 2942 214 5895 8132 6833 2470 6044 1360 |
| | 3864 3354 5078 3712 3622 2243 7841 7704 7058 8513 4248 5756 |
| | 1329 1650 915 3098 4511 4507 6837 7793 8451 8617 4070 7852 |
| | 4387 2840 9705 7098 9546 9283 7821 9334 1355 8515 4515 3849 |
| | 1103 4638 7596 1101 6492 7805 4585 2129 3813 3165 6012 2459 |
| | 4855 3219 4853 7564 4163 2896 6630 |
| 139: | 3997 2703 1918 5761 6918 6142 9908 5187 2508 |
| 140: | 9075 587 5843 3210 5471 8034 8884 3547 8432 5657 433 3460 |
| | 5473 789 471 3122 7813 7075 3837 3743 8256 348 3077 5593 |
| | 5832 987 3146 9721 5493 5966 5508 2938 8924 7628 2462 6274 |
| | 719 8951 9226 7284 2916 4116 8624 4496 2668 9288 1814 5032 |
| | 893 5334 3572 6043 1404 6379 5861 9837 8946 1512 2796 2246 |
| | 1405 9622 7329 4715 1148 4231 4695 5190 4903 7517 1440 3444 |
| | 9782 8850 2260 9801 3324 6632 2884 9126 3044 2991 3786 8888 |
| | 7132 3383 9017 8248 1660 7652 3827 8250 7599 5788 2798 8406 |
| | 3056 2529 8973 1049 1082 6220 6984 9090 4858 8488 484 6596 |
| | 1558 7383 8535 6808 9568 6266 168 406 1425 5748 6969 6702 |
| | 9912 3294 9324 3291 6801 9081 1476 5724 8405 372 4330 5141 |
| | 3067 7461 6014 3410 4643 4606 2961 6780 414 3074 4632 6130 |
| | 1316 1319 2004 3438 2134 9758 1126 3244 3215 7234 722 1394 |
| | 2679 7238 7007 4659 1903 7605 5015 9769 9693 6982 2630 6050 |
| | 1465 244 4085 1276 4159 5963 9264 2927 6093 8298 3359 8697 |
| | 8399 1481 4594 5950 5882 5282 6872 2524 9738 9706 6151 4349 |
| | 498 4669 9149 5901 9185 7875 169 183 6175 4512 8771 174 |
| | 6208 768 8720 1460 770 4495 4692 724 901 6744 6651 7901 |
| | 1649 7047 5090 8755 5784 5815 9826 5681 1076 7590 1185 7406 |
| | 3024 8988 7169 4476 2458 561 241 259 1191 7004 1219 6720 |
| | 5056 7916 5849 2343 2984 6652 2915 261 4127 1948 6310 8213 |
| | 7655 6289 6015 5992 713 737 9023 1906 3484 3994 4180 6042 |
| | 4627 4179 6063 1342 4478 1760 735 7308 1211 211 2016 3413 |
| | 2761 8403 9671 3223 2610 6373 2912 3345 6189 373 3613 430 |
| | 7399 7985 4778 509 3557 3379 5229 629 3927 7993 8030 7991 |
| | 505 9441 8091 635 8392 3382 9291 9299 2607 712 4192 7064 |
| | 4220 5454 5175 8836 7428 1630 2531 4634 7795 3052 1659 532 |
| | 8922 6060 8806 1643 1046 6432 530 5257 6181 5009 1144 173 |
| | 2348 7322 7083 9654 255 2956 7522 9545 9523 3395 3709 236 |
| | 4405 187 4154 2983 3573 5555 9760 7294 9331 2109 2167 1280 |
| | 4396 1044 3149 4750 4896 2106 3020 6679 6549 7288 8013 9862 |
| | 3450 1045 6386 9884 896 7380 3022 5932 492 3526 9847 7879 |
| | 5847 2718 9458 4283 4104 5361 8282 6752 1668 9638 7885 3930 |
| | 863 7550 4244 5787 2543 2906 4959 4952 418 4994 6927 5582 |
| | 4076 9962 2092 8524 3145 4431 2557 5249 8225 6443 9667 4131 |
| | 2416 8413 3643 4181 7952 9690 5499 2154 2155 2177 2061 8834 |
| | 2175 2749 523 1716 8963 3110 3009 5753 4947 9619 3694 7995 |
| | 9473 9431 1492 7403 4539 623 9195 2989 8057 1634 5530 3661 |
| | 4674 8260 6635 4058 3824 6199 5809 3436 2191 9530 9501 1972 |
| | 2813 6148 8444 1808 6021 7831 5292 3950 6999 6997 5133 6170 |
| | 5636 3521 2788 9752 9527 1910 6847 7134 4013 1102 4506 7666 |
| | 3334 5267 2644 3985 651 5046 4819 6263 9628 3518 3516 2113 |
| | 2098 7129 3412 3092 5544 6537 4415 841 1037 836 6545 9865 |

TABLE 2-continued

| PEP SEQ ID NO: | homolog SEQ ID NOs |
|---|---|
| | 9685 1632 9736 9510 6775 6136 3176 721 5911 3424 7246 5062 3402 7541 4475 7969 8925 307 8929 8910 8913 8915 5176 440 399 4558 1132 5824 8138 5406 8078 847 4706 2943 2722 9939 8129 6474 9988 9994 6797 4455 4457 4454 1607 916 9574 5091 9573 9416 6129 2974 9630 9904 8114 1131 1742 7897 5186 5618 2362 2379 468 7173 6703 2170 9387 9362 9562 1646 5807 3814 9186 6763 6268 2429 902 5140 4247 885 2652 6247 3161 3723 6096 7818 6599 2688 7827 1622 6633 8485 6498 4882 5163 5076 4563 5733 9810 |
| 141: | 7726 7410 8023 8039 8037 6113 3318 7855 3370 7688 1661 4943 5627 8955 8914 4862 1500 344 3426 5227 3502 293 9110 3083 2887 9766 6856 1619 2546 6874 6190 5100 6923 4621 9470 8754 9389 6441 6376 4422 9154 345 457 6292 571 1061 3909 4751 2793 5101 4673 4878 8732 3491 6065 7011 7632 5390 8328 6022 880 2123 2931 4044 6650 7789 2392 3478 2204 1188 4440 1993 6419 5463 1704 1718 4102 6349 398 4776 8793 1919 7221 8756 1154 3192 1603 8648 2048 1692 1347 3073 9684 3212 8125 1563 5012 2143 2731 10006 5240 4915 7389 1729 7639 6319 844 2263 6343 891 3352 590 593 578 591 8035 6049 6731 7592 1145 7686 9079 4699 5323 4303 1000 579 340 9696 539 7817 7814 352 6724 1917 8987 3594 8858 8853 8855 1866 2559 5673 7130 |
| 142: | 9538 6322 8216 2187 2190 2706 2702 8864 7631 5819 4946 5429 1914 9292 4470 1705 2457 8384 7603 8655 376 1064 7518 5845 2936 6683 9763 9153 7043 3846 5324 5162 4489 5848 6367 5696 5854 2736 9284 6767 4015 4001 7119 7128 6819 6746 6637 8436 3198 7283 2695 597 5092 4684 1789 8417 7187 643 7053 7671 4633 4795 6275 3390 5246 4731 |
| 143: | 9538 6322 7202 114 8216 2187 2190 2706 2702 8864 7631 4188 753 4191 8728 4002 3875 5819 8780 4946 5429 1914 9292 4470 1705 2457 8384 7603 8655 376 7135 1064 1066 7518 6038 6924 5845 3207 2936 6683 10011 9763 9153 7043 4569 1296 3846 5324 5997 3321 5162 4489 9846 1282 8791 5848 6367 5696 5854 6828 2736 9284 6767 4015 4001 7119 7128 6819 6746 6637 8436 3198 9398 1094 7283 2695 597 5092 227 5082 4684 1789 3375 6456 8602 2128 5736 1183 4672 6560 688 466 3789 2075 6517 726 6083 2036 2533 4914 762 5115 4409 6251 704 1810 526 1665 7997 2732 5462 7207 8475 8840 7215 1585 1862 3807 5428 1234 8417 5801 6952 7120 7187 643 7053 7671 9298 4633 4795 6275 3390 5246 4731 |

TABLE 2-continued

| PEP SEQ ID NO: | homolog SEQ ID NOs |
|---|---|
| 144: | 7151 6340 8968 2512 9223 8511 6831 1411 8429 640 9838 8939 4614 2313 8017 7853 3726 4136 7242 5908 4839 3629 5553 2463 8002 685 2572 5679 5651 9641 5049 2397 6231 3777 9346 570 2598 5766 4493 4464 1856 3171 4078 2374 633 615 3079 3519 6914 6119 4782 8753 9483 1625 9549 944 6394 1818 7353 491 9429 2995 10019 8167 5902 2890 636 9917 9933 4734 4779 493 6410 3829 1821 2762 5900 7925 2780 627 6949 2928 9995 2157 1988 7313 4921 9729 2461 4689 9543 3358 1857 4528 9514 9214 3665 3506 2973 4875 3045 6374 6390 4895 6393 6392 8200 4665 3446 4551 1111 6433 5790 2532 6707 8937 4894 7719 7722 7644 6196 4546 7019 6334 4112 2693 5718 8868 8337 7105 8401 3479 9883 5297 5826 5195 1694 1052 7624 8084 5368 1792 1809 5308 5291 3604 6611 2470 4720 1363 1360 1366 2541 2540 2244 7448 7845 5208 5228 5224 5362 5230 3448 7779 7781 9870 7776 4248 2935 5756 4391 4378 9775 4390 1461 914 4939 6837 7793 8451 9304 9302 922 718 4070 7852 1527 1526 8977 246 684 3865 6547 1386 387 2223 1554 8322 252 249 248 2214 7084 4690 328 6873 7325 2968 9025 8682 9533 6729 9375 1072 6897 4926 7268 2344 6963 9907 4698 7342 949 5424 6033 1290 7577 297 3515 8897 9306 2854 9019 6360 6487 2389 9203 7871 9321 377 1683 8468 3397 4855 3219 4853 7825 8066 2391 2312 2364 2341 2308 2336 2359 2355 2291 2309 8676 2334 8674 2338 2293 6361 5880 4164 2896 6929 5179 4595 8031 1887 6630 5425 7499 1442 7539 5770 |
| 145: | 585 3920 765 759 2616 8355 4161 2637 7094 9183 4433 9037 5612 7711 708 9981 1449 535 369 3735 3293 3266 3269 8463 8467 8543 8464 3289 3286 3297 3287 3262 5702 5683 5698 7139 1676 9405 9107 8749 779 4302 6597 6771 5571 7748 6790 5122 8975 8959 6766 8978 8958 9114 7307 6807 8875 5118 8980 6787 7247 6769 6530 5704 6823 5121 6786 8954 873 8636 3808 3804 2021 8654 3510 3490 6003 413 2715 3140 589 7741 3717 7864 4809 1615 1297 3474 2657 8486 1090 4379 3610 1681 7276 3538 9250 5439 9541 6420 6446 6448 6453 1779 2759 4209 8839 5759 6316 5079 9067 7346 965 5537 4924 932 4239 5440 4550 4553 9891 728 6411 3757 1365 749 8359 4212 5384 5887 5885 7619 5344 8695 4266 8762 895 5170 9300 4177 3407 3406 1658 4158 3996 5386 9435 3353 2967 7334 1571 9189 1662 9905 784 8069 1679 4032 8480 1420 8470 2469 6970 3941 10007 1233 7595 1223 3392 9479 5643 4657 5675 2843 6552 8891 733 1929 6409 4271 |

TABLE 2-continued

| PEP SEQ ID NO: | homolog SEQ ID NOs |
|---|---|
| | 1806 8106 906 5484 7989 1861 5345 3310 2776 6368 2838 8416 |
| | 5284 3760 9836 7972 7638 6223 760 8339 639 626 4576 7072 |
| | 6595 3817 5644 3801 500 8184 9664 182 3226 3544 2678 5693 |
| | 8861 428 9165 4156 8484 9539 275 279 280 730 736 739 |
| | 741 758 763 767 778 781 3505 5684 3264 2966 7474 1093 |
| | 7069 8585 5272 2654 2683 624 5465 5356 7266 5797 3536 1828 |
| | 547 1597 8870 6843 10022 8087 8540 2613 3377 9407 1980 4818 |
| | 5874 7036 1298 1335 2836 7790 3404 1182 3845 3785 8290 3075 |
| | 7048 6182 3791 4149 2282 6718 5538 679 9878 2857 8645 5464 |
| | 7964 1621 5456 477 476 475 2742 8088 8670 6713 9308 3421 |
| | 5326 5668 4641 9333 1369 1749 6883 4532 961 7152 6032 5703 |
| | 8658 774 9119 7953 3512 9537 3823 4365 8395 1780 488 2388 |
| | 3356 6398 7648 3878 3906 7124 7182 5189 746 2122 644 8448 |
| | 9888 8140 6672 217 4167 8812 6029 3543 4023 7409 8142 2473 |
| | 5200 772 546 1868 7354 6135 3651 9257 8149 1604 9928 3589 |
| | 1820 6020 4900 8814 963 2723 5479 5280 7755 1762 775 7059 |
| | 776 5842 6839 3690 6921 8787 4186 8301 3732 1119 1114 1715 |
| | 7142 7143 714 3780 9326 6442 5485 1407 6888 4871 3002 6383 |
| | 1161 7161 7157 7065 3783 8739 2979 4246 2649 3844 2647 2325 |
| | 2642 743 740 734 731 738 6590 6591 4561 8433 7535 8157 |
| | 346 499 9813 773 7165 780 8640 2945 2556 438 7219 7179 |
| | 4482 2856 2709 3962 5211 3292 3296 3300 3802 8102 9987 995 |
| | 4700 1720 8404 5786 3433 8639 454 7777 1004 1491 1490 5199 |
| | 969 982 2555 3984 1007 990 5359 9982 306 8565 8574 8570 |
| | 8551 7460 6248 8548 868 8546 8994 6342 6224 6145 6748 1028 |
| | 8067 7339 7140 1005 2536 2771 1006 7381 6324 4286 1013 985 |
| | 983 986 988 1012 1014 5904 6917 9390 8571 3799 9941 1435 |
| | 1184 1700 7836 6450 6415 3826 460 4702 1613 989 3627 7006 |
| | 3820 2775 2019 6031 3109 9844 1190 8286 2676 7249 8053 8050 |
| | 8021 5583 1288 9211 1388 9566 9567 8578 1194 5183 5441 5476 |
| | 9139 1941 7180 2347 7137 7145 3046 3434 2250 659 4654 5998 |
| | 4123 2044 7609 3431 4126 7018 9353 2424 8631 5621 716 3265 |
| | 1927 4113 5029 2741 3179 1255 1258 1259 4029 1699 1680 4579 |
| | 1701 4581 1678 4578 6472 5994 5755 5840 9542 620 967 8297 |
| | 8661 2254 2618 3734 388 1999 6815 6462 3737 3738 5682 |
| 146: | 7116 5816 2975 2710 7572 5242 8569 |
| 147: | 9980 8517 5865 3276 1782 5877 3378 2835 6460 7031 637 7150 |
| | 5976 5053 8379 6853 5054 6835 2396 2400 10014 8794 2777 3049 |
| | 3065 4260 1323 1393 3229 4514 518 6979 2478 4572 7815 8710 |

TABLE 2-continued

| PEP SEQ ID NO: | homolog SEQ ID NOs |
|---|---|
| | 8714 2447 1880 1877 9531 6131 2371 9692 4518 7212 7070 8383 |
| | 2539 447 4509 2757 8254 4486 1886 8886 647 3605 1340 4340 |
| | 4352 2450 9960 9961 9984 5974 3654 2277 3683 4258 7625 7629 |
| | 7807 1667 5942 4108 4951 7663 4817 9558 1497 9335 1922 2552 |
| | 315 5475 1702 8621 1181 4759 6019 412 3885 6535 9659 8860 |
| | 1138 3205 3227 3507 7092 2746 7090 8214 8238 1170 7996 1169 |
| | 2580 4143 700 2066 5653 6377 9985 8119 8133 3999 8846 9385 |
| | 1080 9220 7323 8985 611 9087 4272 4289 9437 9871 7731 1640 |
| | 6396 5112 6732 308 6772 2651 6072 6882 6884 6840 1243 4194 |
| | 8085 6138 5719 7574 9528 7823 6291 5169 6865 3858 9839 7673 |
| | 5764 8979 3419 9556 4316 5574 9235 7604 6645 7218 7992 923 |
| | 7314 7316 5655 2602 2600 1222 1226 9024 1998 8625 2107 9020 |
| | 9749 9033 9750 9030 8706 8220 3106 3838 2032 5349 4566 6025 |
| | 4658 4677 9841 8773 6626 8774 5666 5661 5458 6693 3788 5620 |
| | 5178 6017 6018 2528 2525 226 888 799 2054 4027 4030 9848 |
| | 4545 1071 5285 6911 1565 1568 3943 4377 5487 2125 9897 6666 |
| | 9709 771 7870 5851 3208 8090 810 1624 8292 9433 3388 3387 |
| | 467 2381 5050 1693 5019 1695 1698 1001 2950 1016 7419 4009 |
| | 8816 941 3750 7912 5077 196 2275 5837 5836 311 7444 4898 |
| | 9271 7544 7546 7570 4976 3166 5924 4603 3955 2015 1997 4708 |
| | 8402 7880 3273 905 7113 6305 683 8306 839 272 8308 7888 |
| | 4510 9798 2895 2832 2996 9727 6188 250 228 9569 6665 2669 |
| | 3905 3967 3983 7320 7999 8000 6004 5158 6444 5159 2911 2908 |
| | 4616 5890 9068 2210 3841 8458 3611 517 3630 3617 3634 9484 |
| | 3248 2410 9577 3637 3616 3612 296 6502 232 3745 6421 7737 |
| | 1535 1728 4293 6636 4642 2481 295 8618 7665 5500 6092 6417 |
| | 9793 1756 1107 8880 7849 4355 2551 6728 6727 6725 5717 1618 |
| | 6869 1735 2189 8582 431 6104 2137 4753 300 7068 4364 5925 |
| | 7582 5337 8409 3270 7438 2020 5293 6300 6132 6898 6348 6344 |
| | 6915 6364 6988 6944 6962 6402 6389 6896 6935 6431 6895 7039 |
| | 6164 6960 6933 7037 6424 6363 7012 2698 7035 7054 7062 2625 |
| | 8662 8725 2242 8550 2240 2235 8721 2622 2306 8620 8694 8718 |
| | 2211 2185 2181 1669 2328 2288 8665 8698 8544 8691 2186 2307 |
| | 2302 6323 2283 2261 8612 2269 2329 8588 8614 2303 8572 8592 |
| | 2273 8668 2375 8563 8619 8566 2266 7707 7198 2415 8663 7016 |
| | 7651 8590 7653 2413 2352 8644 7010 2981 6940 7029 6908 6370 |
| | 6303 2330 2408 2350 6406 6964 6758 8583 6307 6899 7586 6942 |
| | 5539 5516 5556 5542 5472 5535 8947 5497 7057 6987 7008 7617 |

TABLE 2-continued

| PEP SEQ ID NO: | homolog SEQ ID NOs |
|---|---|
| | 7553 7032 6985 541 6058 6084 8637 6965 9469 7236 6698 1730 |
| | 9006 3880 5551 1508 6825 595 3061 3766 1241 4738 3338 9162 |
| | 2738 2754 2792 2755 8261 9240 8014 3333 3160 2615 6154 7902 |
| | 1851 1638 6482 5095 2179 4637 7811 7808 9636 7191 7650 2537 |
| | 5006 |
| 148: | 9807 9021 3422 2554 9217 1648 8121 7920 3711 4189 445 8186 |
| | 9777 5773 5629 8481 7331 9861 358 5468 2202 5988 3247 6055 |
| | 4619 474 4670 |
| 149: | 5381 9028 2279 884 4610 8904 4254 5875 6779 4755 8911 5791 |
| | 5808 8596 5957 6105 7423 9570 6777 3703 6770 9316 9694 6778 |
| | 1800 3633 2725 1518 2728 8293 197 7515 6222 817 5934 3432 |
| | 4228 497 9852 9532 9797 2585 9286 4549 2707 6026 7816 7886 |
| | 9885 8531 7941 6505 5939 8407 7918 9261 5926 4508 5980 2753 |
| | 4600 6329 4072 482 3320 1189 6715 6733 4651 4185 6207 4328 |
| | 4305 7347 7753 3966 7961 4768 6708 6614 809 8319 8165 1612 |
| | 4463 2522 6308 9784 3982 7865 1315 9193 4380 5448 9717 1962 |
| | 2714 2820 3593 6916 5746 1143 6972 8371 5751 5306 1696 6855 |
| | 1022 2422 8196 6854 1087 7228 4448 5899 2617 2888 8141 229 |
| | 2851 1359 6649 7079 9751 9877 8961 8311 6617 556 1951 3744 |
| | 1307 9445 6692 2039 188 4412 6543 2640 4522 1318 8539 8579 |
| | 5589 6447 3908 5896 6572 9171 7178 9244 1271 9817 9266 7196 |
| | 7122 7937 2744 9623 3164 1855 3222 5747 3731 8388 631 1245 |
| | 4663 3199 8554 9111 2314 2031 6332 1664 1672 8062 9272 4562 |
| | 1229 1443 850 5294 1908 2034 3937 1627 9459 2172 3699 2324 |
| | 2220 9564 1596 6052 7728 3284 4062 4060 4351 3833 3795 5442 |
| | 5446 8168 9551 2627 9679 6542 2567 8609 9122 6380 7657 3272 |
| | 8965 4079 5096 9540 5633 4911 5173 3094 1532 1748 2145 6278 |
| | 3256 4148 7431 3922 3919 5419 5331 5059 1467 921 7229 4285 |
| | 2140 2571 573 994 3993 6950 1469 3500 2877 5376 7404 6849 |
| | 8018 5094 1374 4042 4962 1459 1463 4601 9948 610 4064 379 |
| | 2475 2960 6166 8246 7298 5379 9417 7830 9137 5938 5923 4827 |
| | 5937 4780 9811 7357 5234 8731 7904 258 4100 7487 233 1079 |
| | 8789 8798 607 2673 2477 9419 3588 2672 6167 6245 7975 5342 |
| | 5322 1030 9660 917 2188 3645 2878 3625 6803 653 4021 2136 |
| | 6522 2665 1990 6623 452 5945 9639 1516 7426 8934 6867 5941 |
| | 339 1901 2174 1572 6009 586 |
| 150: | 6947 9930 8552 4707 600 458 9423 3655 2834 5726 3667 9648 |
| | 650 9611 5396 7913 8923 5649 3615 4630 7483 9614 7700 1010 |
| | 1924 6440 9247 7839 4961 6973 7163 7602 4129 574 3851 6285 |
| | 618 5577 8277 |
| 151: | 2606 2063 2060 496 3946 10020 7076 2024 5495 6475 9700 |
| 152: | 9658 9420 3779 6609 3006 2471 3567 4983 98 979 3486 5549 |
| | 3725 6098 7872 2112 434 3565 10008 5728 8348 8033 5426 8854 |
| | 9642 6255 3980 |
| 153: | 9658 9420 3779 6609 3006 2471 3567 4983 3486 98 979 5549 |
| | 434 3565 10008 8348 5728 8302 8033 6705 8244 9642 6255 |
| 154: | 9424 4676 2340 5445 8252 8604 8158 6499 3027 1765 10009 2963 |
| | 4716 5352 5351 5277 6850 7155 4678 8208 8329 6993 2100 9833 |
| | 2421 9791 7936 7900 9072 9799 4367 6826 6514 4091 4090 2751 |
| | 4093 3033 9312 9554 6607 4421 1703 4418 1817 7022 4357 4059 |
| | 9296 9910 3071 2940 1860 7771 402 2073 9498 928 1909 9653 |
| | 9497 2696 8498 3036 2414 4777 3899 6192 9909 3770 4485 2467 |
| | 2419 9451 2712 837 8434 2138 6351 9108 4836 5481 2124 2418 |
| | 6981 7274 5184 5081 1671 9295 3599 1020 4224 5554 5572 5570 |
| | 6391 3961 |
| 155: | 9424 4676 2340 5445 8252 8604 8158 6499 3027 1765 6510 3427 |
| | 10009 2963 4716 5352 5351 5277 6850 7155 4678 8208 8329 6993 |
| | 2100 9833 6994 9657 6996 9854 3668 8199 5365 7802 9029 2421 |
| | 9791 7936 7900 9072 9799 4367 6826 6514 4091 4090 2751 4093 |
| | 3033 9312 9554 6607 4421 1703 4418 1817 7022 4357 4059 9296 |
| | 9910 3071 2940 1860 2684 782 9276 7425 9991 2492 1884 2794 |
| | 8529 5265 8007 7771 402 3842 2073 9498 928 1909 9653 9497 |
| | 2696 8498 3036 2414 4777 3899 6192 9909 3770 4485 2467 2419 |
| | 9451 2712 837 8434 2138 6351 9108 4836 5481 2124 2418 6981 |
| | 7274 5184 5081 1714 3228 2139 6846 7947 2977 5641 1671 9295 |
| | 3599 1020 4224 5554 5572 5570 6391 3961 |
| 156: | 9060 9635 3511 1890 1852 7041 8456 8503 5709 7232 9824 9121 |
| | 1142 9105 3524 886 99 2910 9802 8893 9050 6116 8210 2648 |
| 157: | 4624 1430 1961 1964 9456 5156 5394 7397 8169 7589 3279 4306 |
| | 7970 5051 6353 5373 7529 7189 7177 9720 9724 9737 8325 9743 |
| | 8310 9762 5483 4841 9547 456 7027 4073 865 3681 4125 2487 |
| | 9754 9715 5852 7311 8287 9858 4556 4386 5237 4843 8283 6968 |
| | 3988 5146 2030 3167 10021 7754 401 6336 1019 9986 7351 9843 |
| | 1519 5919 6463 2568 4326 3251 7257 411 8280 2612 4172 677 |
| | 5236 6337 6941 1939 1846 3268 5264 2126 2850 1413 2595 4865 |
| | 5338 8606 8629 3585 9954 2395 3255 1592 8504 2091 3454 8148 |
| | 2103 6516 7601 9113 5955 8362 7498 6681 8435 682 1616 4872 |
| | 3003 3881 9673 5402 10002 9368 1367 5310 4499 5630 4811 486 |
| | 6466 4114 6893 1167 504 159 7344 2897 9561 6709 3828 8373 |
| | 5779 5405 8890 3368 7467 1794 5605 3202 7077 3414 8605 8267 |
| | 8441 6977 6210 3177 3674 9141 1069 1345 8623 3926 7892 5387 |

TABLE 2-continued

| PEP SEQ ID NO: | homolog SEQ ID NOs |
|---|---|
| | 663 1904 869 6784 3039 6783 5341 9603 7943 1496 1495 8633 |
| | 7703 6564 8195 4295 754 7579 7687 9829 1122 3935 9341 8268 |
| | 4211 3564 2805 8263 792 1124 756 2716 7333 7222 2014 2356 |
| | 3127 3653 7950 4153 8867 6429 9457 6434 8734 6905 2165 4571 |
| | 2072 6064 4650 5252 3798 3915 1666 7185 7706 3720 883 3254 |
| | 4920 8452 5962 7186 1091 8162 8228 843 9140 2345 3987 7200 |
| | 2814 6078 9492 3816 4354 6881 7705 1724 2597 102 4828 238 |
| | 552 5676 1642 4417 5646 3678 6325 4282 2664 3035 9503 7204 |
| | 6422 6586 1652 3175 8323 2399 2394 5427 4430 6378 8097 2704 |
| | 4444 9173 9557 8568 6575 1240 268 5166 550 2093 5835 8235 |
| | 3242 9062 7503 1242 6669 202 4252 3942 1837 5772 7013 3949 |
| | 2387 1872 4132 239 6362 3853 5399 5290 361 1690 6817 1339 |
| | 1096 1489 224 351 1620 7863 9449 6123 8366 6051 2183 1721 |
| | 9238 2680 3626 3344 1116 2750 6932 7588 7744 103 3267 5492 |
| | 104 9588 6655 8671 8426 5594 1218 7709 9637 2882 3986 162 |
| | 8940 7045 1364 3112 2088 6478 9289 3965 1117 5979 9329 2311 |
| | 956 6806 9680 5660 8285 1398 5343 6127 7466 4784 3032 5850 |
| | 5920 9197 3649 8744 8970 8852 1984 5669 7829 6594 8237 1348 |
| | 5789 371 9957 3281 2933 6102 9219 4400 6788 4414 |
| 158: | 2959 3815 4004 3362 3533 6295 3034 6178 1228 1025 5085 |
| 159: | 4624 1430 1961 1964 9456 5156 999 3374 6267 1053 4084 9627 |
| | 5394 6413 7397 8169 9718 6610 7876 4383 1098 1556 783 6842 |
| | 7112 9675 3279 6197 9663 4306 7970 4596 7356 1390 5051 7566 |
| | 5754 6353 2721 2365 7177 7189 4841 9547 3255 2850 8504 1846 |
| | 9224 7752 6742 3039 8268 3564 4153 6429 9457 102 4828 7200 |
| | 4354 6881 8323 5427 6669 4252 162 8940 1117 5660 956 7829 |
| | 5669 6594 4893 5253 9367 5124 9369 5546 157 2141 205 2249 |
| | 7148 8237 1348 5789 9493 371 9957 3281 2933 6102 9219 4400 |
| | 6788 9027 8373 |
| 160: | 7398 4338 6484 6449 9732 6500 6496 6480 6477 4169 7260 6605 |
| | 6606 7280 8487 9607 7439 9236 9237 3131 6585 177 7291 7290 |
| | 4868 7293 7295 7297 7315 7279 8159 6601 6624 6622 6584 6583 |
| | 6388 6387 7341 6891 7253 7321 7324 3947 4452 6330 6620 6598 |
| | 6600 3753 4899 6243 9355 3157 7108 7107 5977 4467 3998 3181 |
| | 3185 3152 3155 7534 1849 7442 7235 3250 8494 176 3357 7369 |
| | 8673 9585 9587 8866 6046 9103 4775 9951 9949 9943 9947 6579 |
| | 6559 6561 6574 1261 8729 1166 9701 8492 8447 8472 4317 1863 |
| | 7956 8326 3400 1267 4696 7761 1266 1270 5036 7100 6366 6519 |
| | 6371 3055 3488 6680 1088 8473 8469 3126 8098 5813 8496 4319 |
| | 8499 8500 1717 1741 4313 9009 854 6660 5001 4099 4086 4077 |

TABLE 2-continued

| PEP SEQ ID NO: | homolog SEQ ID NOs |
|---|---|
| | 7241 8185 3059 3060 8187 2158 8207 5667 8147 7379 6262 9338 |
| | 8145 820 6646 9005 2236 5469 8075 8093 3501 7746 1321 6007 |
| | 3747 1915 5153 7373 3558 7476 212 200 2238 1617 6714 8105 |
| | 7317 7318 6558 7716 3764 7971 7968 3275 6580 8476 3023 |
| 161: | 7166 6423 5969 7138 7828 3577 489 5529 6737 9681 6534 1722 |
| | 8881 8779 4557 8810 4325 7209 9670 5063 2588 3570 2468 3921 |
| | 9958 9301 5466 911 3869 3523 1591 9783 2404 237 7123 6479 |
| | 10012 1898 2921 1361 341 8532 2199 6079 2205 4823 6562 3582 |
| | 4198 5437 2988 1673 7066 5126 9091 6045 745 4216 7254 5161 |
| | 4887 977 5407 564 9761 790 1009 3944 8437 608 1196 5222 |
| | 966 8036 1477 2535 9234 4824 5288 2506 5853 2880 1778 3225 |
| | 6765 919 4375 8702 3209 4812 1562 833 5353 1322 3733 5817 |
| | 6945 3053 7049 900 4591 5238 5868 4483 786 3201 1588 7489 |
| | 5700 2914 5503 2660 2500 6191 2902 2582 8948 8351 185 2766 |
| | 6841 9436 9478 4685 9940 658 4443 1344 8414 1785 1349 8856 |
| | 417 5680 984 3107 1447 4089 3425 2643 3781 3118 4548 7197 |
| | 5541 6047 4613 7933 2239 7734 4497 9378 4202 881 8999 7549 |
| | 2390 7637 795 6418 6577 5266 3253 5855 6759 5325 7607 3119 |
| | 859 2333 3220 1382 4560 4268 240 5654 3739 8059 4397 806 |
| | 686 8170 301 2748 9480 4529 838 9166 769 1265 1112 8997 |
| | 2099 1408 1829 3560 8685 3440 4648 6234 8422 642 3978 3217 |
| | 755 1239 3790 2682 1051 5269 8390 6253 6076 676 6647 1805 |
| | 8971 7955 788 9502 2675 9610 2898 569 3240 110 7810 487 |
| | 9253 6155 3722 2713 9746 5523 8080 6768 5103 4879 6805 9475 |
| | 7593 364 7966 1217 1068 592 5777 568 2301 3933 1747 |
| 162: | 4624 9456 5156 999 3374 1053 4084 9627 5394 6413 2639 7397 |
| | 8169 6610 9718 4383 1556 1098 783 6842 7112 9675 3279 6197 |
| | 4306 7970 4596 7356 5051 7566 5754 6353 2721 2365 7177 7189 |
| | 9724 9547 456 3255 7752 3039 6783 8268 3564 4153 6429 9457 |
| | 102 4828 7200 6881 4354 8323 4252 6669 202 7829 5669 5253 |
| | 9367 4893 6594 157 2141 205 2249 7148 1348 5789 9493 371 |
| | 9957 3281 2933 6102 9219 4400 6788 1117 5660 956 |
| 163: | 3151 8646 4019 4005 282 299 4018 4831 2576 4850 3134 9124 |
| | 9125 9174 9175 9209 9210 9127 9128 9134 7493 2483 4101 9518 |
| | 9521 907 7896 937 1505 8471 8474 8465 5165 5181 5180 7708 |
| | 7710 5235 5233 4103 8785 8786 8790 8788 8723 8703 8733 8735 |
| | 8748 3085 8752 8765 8763 8770 8784 1378 1402 8799 8800 8805 |
| | 8802 8824 8821 8826 9314 9317 9320 9322 9318 9345 9344 9352 |
| | 9354 9384 9400 9358 9356 9374 9380 9377 9382 9406 9408 9421 |
| | 9425 9422 9427 9439 9440 9442 9447 9443 9461 9466 9463 9485 |

TABLE 2-continued

| PEP SEQ ID NO: | homolog SEQ ID NOs |
|---|---|
| | 9468 9487 9488 9489 9495 9511 9963 9965 9970 9990 9968 9966 |
| | 9996 10001 9997 8766 8768 8647 8651 8652 8667 8699 1432 1504 |
| | 1455 1502 805 7528 5864 5866 2489 9147 9148 281 9206 9208 |
| | 9225 9227 2563 9229 9230 715 2008 2011 1387 1389 9100 9101 |
| | 9130 9131 7770 7787 9150 9151 4834 9179 9180 4837 3153 2065 |
| | 2067 2086 2087 4460 3913 3911 3103 1391 1395 2491 1928 1926 |
| | 1973 4008 4003 8746 8743 8833 8829 9993 1940 1963 1992 2006 |
| | 1932 1938 5044 933 939 7558 4219 808 908 811 813 7526 |
| | 7481 828 4221 826 814 931 829 910 851 832 7505 853 |
| | 835 7429 7486 7391 7388 7364 7527 7417 7433 7465 964 875 |
| | 7363 874 876 7361 7360 909 4223 7457 7462 879 7459 4206 |
| | 7482 4733 7464 7507 7557 889 7392 935 7504 7393 7532 7488 |
| | 4205 7554 7437 7533 960 7415 894 892 897 5532 959 890 |
| | 7552 4942 3959 3972 3957 3991 3971 5758 5070 2448 2449 2452 |
| | 2466 2493 2495 2497 2560 7368 7501 7556 4726 4728 1966 9177 |
| | 1397 2514 2538 711 958 1035 7575 7434 855 871 7484 857 |
| | 860 962 7502 7420 7416 5068 4938 1433 7986 8001 1480 8005 |
| | 1501 1528 1373 3095 4225 4730 7396 1277 1279 947 7932 7935 |
| | 2285 2287 4374 4910 4927 4929 4931 4933 4935 9181 9182 1485 |
| | 6986 3088 1522 1338 1356 1353 1427 1426 1487 1525 1351 1399 |
| | 1521 1524 1507 1488 2472 1358 1376 1401 1464 3104 4949 4950 |
| | 4955 4957 4960 4988 4989 4993 4998 4999 5022 5023 5024 5028 |
| | 5031 5486 5488 5489 5490 5494 5507 5510 5513 5515 5511 5527 |
| | 3101 7954 7958 7957 7899 7903 4372 4385 7928 7959 7976 7951 |
| | 7981 7984 8019 8006 8025 8020 4368 4366 4343 4363 4382 7894 |
| | 8026 4334 4332 4822 8003 7923 7983 4336 3180 3158 3129 2245 |
| | 3086 3137 2290 3183 3186 3188 8700 8701 2393 2368 3117 4739 |
| | 4972 4763 4766 4772 4806 2241 2289 2305 2270 2264 2267 2284 |
| | 2212 2237 6357 4975 4756 9294 8327 5259 5256 5867 4794 8493 |
| | 8497 1931 3144 3142 3121 1113 5209 7676 7658 7675 3548 3551 |
| | 4329 8490 9196 9198 4848 9152 9155 9145 9144 9135 9136 9204 |
| | 8385 2228 2226 2231 2234 3552 3553 1589 7721 9640 2515 2518 |
| | 277 3910 3018 6615 3355 6975 6980 6976 7713 7000 3517 4790 |
| | 4802 4830 3405 2451 4011 4833 5828 4712 4805 4771 4746 5318 |
| | 4713 4793 4835 5319 5317 4742 4764 1421 1424 9606 6625 1969 |
| | 1971 1434 8672 8669 3130 2013 2029 9516 8726 8730 9336 9339 |
| | 9337 4829 6934 1743 5745 1958 7869 6426 1986 1987 7340 5037 |
| | 4785 4789 912 3876 3873 3891 3102 8807 8626 8642 3132 4854 |
| | 9232 9233 9202 9132 1418 1419 9199 9200 9184 1628 1172 1175 |
| | 1177 9360 4765 5061 671 657 669 655 5314 5067 8113 8117 |
| | 978 8270 165 7255 8809 298 1989 1991 4796 4808 6244 6488 |
| | 6490 6503 4743 3312 6822 4067 5279 9156 9158 5205 3147 3168 |
| | 3172 4856 3156 1548 1798 1546 208 8944 8933 8949 8276 8279 |
| | 8281 8203 8204 6005 8253 8992 8995 8996 8972 8991 9519 8197 |
| | 5917 5978 8223 5984 5936 8316 5956 5958 8226 8229 8300 9098 |
| | 9099 9560 9580 9579 9582 9583 8919 7418 7794 1587 1579 7692 |
| | 5273 1593 5261 4710 4279 1547 6497 3895 3893 3907 3081 4195 |
| | 5210 4758 4197 8832 8916 8851 8857 8894 8892 8871 8865 8849 |
| | 8872 8889 8874 8927 8932 8930 8895 8909 4770 7681 7691 5226 |
| | 5213 5157 5160 1375 1400 1458 1462 1482 2037 2041 9172 5321 |
| | 1396 1415 4714 4741 4966 4970 5000 5002 4745 5003 4760 4762 |
| | 5005 4769 4798 5064 1379 1352 1341 1453 3929 3925 3080 8750 |
| | 7430 9401 9403 2007 2062 2059 2064 4857 8675 8677 4940 4965 |
| | 4973 5004 5039 5041 5045 705 707 691 693 692 2033 2035 |
| | 4740 4709 4749 4748 4803 5312 5313 5315 1745 9855 6821 |
| 164: | 6237 6238 7766 2180 5501 6061 617 1996 7115 6328 7621 9726 |
| | 1897 1879 6204 5480 6298 8537 6412 5959 1784 7642 8015 1736 |
| | 9952 8126 432 3822 4362 5750 5671 7677 |
| 165: | 3151 1577 8646 4019 4005 282 299 4018 4831 2576 4850 3134 |
| | 9124 9125 9174 9175 9209 9210 9127 9128 9134 7493 2483 9518 |
| | 9521 907 7896 937 1505 2252 2804 2782 2779 2822 2224 2251 |
| | 2149 2256 2846 2781 2257 2255 2855 2852 2797 2785 2221 2802 |
| | 2873 2849 2786 2819 2795 2799 2148 2198 2192 2168 2225 2218 |
| | 2197 2867 2864 2825 2196 2193 2171 2169 2830 2219 2173 2166 |
| | 2853 2827 2889 2871 2874 8471 8474 8465 5165 5181 5180 7708 |
| | 7710 5235 5233 4103 8785 8786 8790 8788 8723 8703 8733 8735 |
| | 8748 3085 8752 8765 8763 8770 8784 1378 1402 8799 8800 8805 |
| | 8802 8824 8821 8826 9314 9317 9320 9322 9318 9345 9344 9352 |
| | 9354 9384 9400 9358 9356 9374 9380 9377 9382 9406 9408 9421 |
| | 9425 9422 9427 9439 9440 9442 9447 9443 9461 9466 9463 9485 |
| | 9468 9487 9488 9489 9495 9511 9963 9965 9970 9990 9968 9966 |
| | 9996 10001 9997 8766 8768 8647 8651 8652 8667 8699 1432 1504 |
| | 1455 1502 805 7528 5864 5866 2489 9147 9148 281 3195 2773 |
| | 9206 9208 9225 9227 2563 9229 9230 715 2008 2011 1387 1389 |
| | 9100 9101 9130 9131 7770 7787 9150 9151 4834 9179 9180 4837 |
| | 3153 2065 2067 2086 2087 4460 3913 3911 3103 1391 1395 2491 |
| | 1928 1926 1973 4008 4003 8746 8743 8833 8829 9993 1940 1963 |

TABLE 2-continued

| PEP SEQ ID NO: | homolog SEQ ID NOs |
| --- | --- |
| | 1992 2006 1932 1938 5044 933 939 7558 4219 808 908 811 |
| | 813 7526 7481 828 4221 826 814 931 829 910 851 832 |
| | 7505 853 835 7429 7486 7391 7388 7364 7527 7417 7433 7465 |
| | 964 875 7363 874 876 7361 7360 909 4223 7457 7462 879 |
| | 7459 4206 7482 4733 7464 7507 7557 889 7392 935 7504 7393 |
| | 7532 7488 4205 7554 7437 7533 960 7415 894 892 897 5532 |
| | 959 890 7552 4942 3959 3972 3957 3991 3971 5758 5070 2448 |
| | 2449 2452 2466 2493 2495 2497 2560 7368 7501 7556 4726 4728 |
| | 1966 9177 1397 2514 2538 711 958 1035 7575 7434 855 871 |
| | 7484 860 857 962 7502 7420 7416 5068 4938 1433 7986 8001 |
| | 1480 8005 1501 1528 1373 3095 4225 4730 7396 1277 1279 947 |
| | 7932 7935 2285 2287 4374 4910 4927 4929 4931 4933 4935 9181 |
| | 9182 1485 6986 976 3088 1522 1338 1356 1353 1427 1426 1487 |
| | 1525 1351 1399 1521 1524 1507 1488 2472 1358 1376 1401 1464 |
| | 3104 4949 4950 4955 4957 4960 4988 4989 4993 4998 4999 5022 |
| | 5023 5024 5028 5031 5486 5488 5489 5490 5494 5507 5510 5513 |
| | 5515 5511 5527 3101 7954 7958 7957 7899 7903 4372 4385 7928 |
| | 7959 7976 7951 7981 7984 8019 8006 8025 8020 4368 4366 4343 |
| | 4363 4382 7894 8026 4334 4332 4822 7117 8003 7923 7983 4336 |
| | 3180 3158 3129 2245 3086 3137 2290 3183 3186 3188 8700 8701 |
| | 2393 2368 3117 4739 4972 4763 4766 4772 4806 2241 2289 2305 |
| | 2270 2264 2267 2284 2212 2237 6357 4975 4756 9294 8327 5259 |
| | 5256 5867 4794 8493 8497 3144 3142 1113 7676 7658 7675 3548 |
| | 3551 4329 8490 9196 9198 4848 9152 9155 9145 9144 9135 9136 |
| | 9204 8385 2226 2228 2231 2234 3552 3553 7721 9640 2515 2518 |
| | 277 3910 3018 6615 3355 6975 6980 6976 7713 7000 3517 4790 |
| | 4802 4830 3405 2451 4011 4833 5828 4712 4805 4771 4746 5318 |
| | 4713 4793 4835 5319 5317 4742 4764 1421 1424 9606 6625 1969 |
| | 1971 1434 8672 8669 3130 2013 2029 9516 8726 8730 9336 9339 |
| | 9337 6631 4829 6934 1743 5745 1958 7869 6426 1986 1987 7340 |
| | 5037 4785 4789 912 3876 3873 3891 3102 8807 8626 8642 3132 |
| | 4854 9232 9233 9202 9132 1418 1419 9199 9200 9184 1628 1172 |
| | 1175 1177 9360 4765 9855 163 5084 6821 5061 671 657 669 |
| | 655 5314 5067 8113 8117 298 1989 1991 4796 4808 6244 6488 |
| | 6490 6503 4743 3312 6822 4067 5279 9156 9158 5205 3147 3168 |
| | 4856 3156 1548 1798 1546 208 8944 8933 8949 8276 8279 8281 |
| | 8203 6005 8253 8992 8995 8996 8972 8991 9519 8197 5917 5978 |
| | 8223 5984 5936 8316 5956 5958 8226 8229 8300 9098 9099 9560 |
| | 9563 9580 9579 9582 9583 8919 7418 7794 1587 1579 7692 5273 |
| | 1593 5261 4710 4279 1547 3895 3893 3907 3081 4195 5210 4758 |
| | 4197 4727 8832 8916 8851 8857 8894 8892 8871 8865 8849 8872 |
| | 8889 8874 8927 8932 8930 8895 8909 4770 1062 7681 7691 5213 |
| | 5226 5157 5160 1375 1400 1458 1462 1482 2037 2041 9172 5321 |
| | 1396 1415 4714 4741 4966 4970 5000 5002 4745 5003 4760 4762 |
| | 5005 4769 4798 5064 7114 1379 1352 1341 1453 3929 3925 3080 |
| | 8750 7430 9401 9403 2007 2059 2062 2064 4857 8675 8677 4940 |
| | 4965 4973 5004 5039 5041 5045 705 707 691 693 692 2033 |
| | 2035 4740 4709 4749 4748 4803 5312 5313 5315 1745 8270 |
| 166: | 7398 6484 6449 4729 6500 6496 6480 6477 4169 7256 7258 2351 |
| | 6605 6606 7280 9607 7439 9571 9415 6711 9236 9237 6585 177 |
| | 1949 7291 7290 4868 6438 6265 7293 7295 7297 7315 7279 7792 |
| | 7788 8159 6601 6622 6624 6584 6583 6388 7341 7253 7277 7321 |
| | 7324 3947 6620 6598 6600 4296 3753 4899 6243 4253 4128 9355 |
| | 8071 7568 7534 7244 7442 7468 7820 7235 3250 8494 176 6372 |
| | 7369 4428 8866 4775 7525 8255 5421 9967 6579 6559 6561 2768 |
| | 1166 9701 4083 9703 8447 4312 8472 4317 1863 7956 3400 757 |
| | 3642 5036 7100 3055 3488 6680 4587 8473 8469 3126 8477 8098 |
| | 5813 9879 2965 9740 5142 8499 4319 8500 1717 8410 2883 1410 |
| | 641 854 6660 5001 4099 4086 7241 4077 7237 8777 3059 8185 |
| | 5491 3060 5667 7379 6262 9338 4236 6646 2236 8075 8093 8076 |
| | 2767 7746 7749 1321 6007 7724 7373 7376 3558 7476 1732 1734 |
| | 1740 1738 212 200 6714 7317 7318 1689 1709 6558 7716 3764 |
| | 435 7971 7968 6580 8476 5457 1346 |

EXAMPLE 5

Selection of Transgenic Plants with Enhanced Agronomic Trait(s)

This example illustrates identification of plant cells of the invention by screening derived plants and seeds for enhanced trait. Transgenic corn seed and plants with recombinant DNA identified in Table 1 were prepared by plant cells transformed with DNA that was stably integrated into the genome of the corn cell. The transgenic seed, plantlets and progeny plants were selected using the methods that measure Transgenic corn plant cells were transformed with recombinant DNA from each of the genes identified in Table 1. Progeny transgenic plants and seed of the transformed plant cells were screened for enhanced water use efficiency, enhanced cold tolerance, increased yield, enhanced nitrogen use efficiency, enhanced seed protein and enhanced seed oil as compared to control plants.

A. Selection for enhanced Nitrogen Use Efficiency

The physiological efficacy of transgenic corn plants (tested as hybrids) can be tested for nitrogen use efficiency (NUE) traits in a high-throughput nitrogen (N) selection method. The collected data are compared to the measurements from wildtype controls using a statistical model to determine if the changes are due to the transgene. Raw data were analyzed by SAS software. Results shown herein are the comparison of transgenic plants relative to the wildtype controls.

(1) Media Preparation for Planting a NUE Protocol

Planting materials used: Metro Mix 200 (vendor: Hummert) Cat. #10-0325, Scotts Micro Max Nutrients (vendor: Hummert) Cat. #07-6330, OS 4⅓"×3⅞" pots (vendor: Hummert) Cat. #16-1415, OS trays (vendor: Hummert) Cat. #16-1515, Hoagland's macronutrients solution, Plastic 5" stakes (vendor: Hummert) yellow Cat. #49-1569, white Cat. #49-1505, Labels with numbers indicating material contained in pots. Fill 500 pots to rim with Metro Mix 200 to a weight of ~140 g/pot. Pots are filled uniformly by using a balancer. Add 0.4 g of Micro Max nutrients to each pot. Stir ingredients with spatula to a depth of 3 inches while preventing material loss.

(2) Planting a NUE Selection in the Greenhouse (a) Seed Germination—Each pot is lightly atered twice using reverse osmosis purified water. The first watering is scheduled to occur just before planting; and the second watering, after the seed has been planted in the pot. Ten Seeds of each entry (1 seed per pot) are planted to select eight healthy uniform seedlings. Additional wild type controls are planted for use as border rows. Alternatively, 15 seeds of each entry (1 seed per pot) are planted to select 12 healthy uniform seedlings (this larger number of plantings is used for the second, or confirmation, planting). Place pots on each of the 12 shelves in the Conviron growth chamber for seven days. This is done to allow more uniform germination and early seedling growth. The following growth chamber settings are 25° C./day and 22° C./night, 14 hours light and ten hours dark, humidity ~80%, and light intensity ~350 μmol/m²/s (at pot level). Watering is done via capillary matting similar to greenhouse benches with duration of ten minutes three times a day.

(b) Seedling transfer—After seven days, the best eight or 12 seedlings for the first or confirmation pass runs, respectively, are chosen and transferred to greenhouse benches. The pots are spaced eight inches apart (center to center) and are positioned on the benches using the spacing patterns printed on the capillary matting. The Vattex matting creates a 384-position grid, randomizing all range, row combinations. Additional pots of controls are placed along the outside of the experimental block to reduce border effects.

Plants are allowed to grow for 28 days under the low N run or for 23 days under the high N run. The macronutrients are dispensed in the form of a macronutrient solution (see composition below) containing precise amounts of N added (2 mM $NH_4NO_3$ for limiting N selection and 20 mM $NH_4NO_3$ for high N selection runs). Each pot is manually dispensed 100 ml of nutrient solution three times a week on alternate days starting at eight and ten days after planting for high N and low N runs, respectively. On the day of nutrient application, two 20 min waterings at 05:00 and 13:00 are skipped. The vattex matting should be changed every third run to avoid N accumulation and buildup of root matter. Table 7 shows the amount of nutrients in the nutrient solution for either the low or high nitrogen selection.

TABLE 7

| Nutrient Stock | 2 mM $NH_4NO_3$ (Low Nitrogen Growth Condition, Low N) mL/L | 20 mM $NH_4NO_3$ (high Nitrogen Growth Condition, High N) mL/L |
|---|---|---|
| 1M $NH_4NO_3$ | 2 | 20 |
| 1M $KH_2PO_4$ | 0.5 | 0.5 |
| 1M $MgSO_4$•$7H_2O$ | 2 | 2 |
| 1M $CaCl_2$ | 2.5 | 2.5 |
| 1M $K_2SO_4$ | 1 | 1 |

Note:
Adjust pH to 5.6 with HCl or KOH (c) Harvest Measurements and Data Collection—After 28 days of plant growth for low N runs and 23 days of plant growth for high N runs, the following measurements are taken (phenocodes in parentheses): total shoot fresh mass (g) (SFM) measured by Sartorius electronic balance, V6 leaf chlorophyll measured by Minolta SPAD meter (relative units) (LC), V6 leaf area (cm²) (LA) measured by a Li-Cor leaf area meter, V6 leaf fresh mass (g) (LFM) measured by Sartorius electronic balance, and V6 leaf dry mass (g) (LDM) measured by Sartorius electronic balance. Raw data were analyzed by SAS software. Results shown are the comparison of transgenic plants relative to the wildtype controls.

To take a leaf reading, samples were excised from the V6 leaf. Since chlorophyll meter readings of corn leaves are affected by the part of the leaf and the position of the leaf on the plant that is sampled, SPAD meter readings were done on leaf six of the plants. Three measurements per leaf were taken, of which the first reading was taken from a point one-half the distance between the leaf tip and the collar and halfway from the leaf margin to the midrib while two were taken toward the leaf tip. The measurements were restricted in the area from ½ to ¾ of the total length of the leaf (from the base) with approximately equal spacing between them. The average of the three measurements was taken from the SPAD machine.

Leaf fresh mass is recorded for an excised V6 leaf, the leaf is placed into a paper bag. The paper bags containing the leaves are then placed into a forced air oven at 80° C. for 3 days. After 3 days, the paper bags are removed from the oven and the leaf dry mass measurements are taken.

From the collected data, two derived measurements are made: (1) Leaf chlorophyll area (LCA), which is a product of V6 relative chlorophyll content and its leaf area (relative units). Leaf chlorophyll area=leaf chlorophyll X leaf area. This parameter gives an indication of the spread of chlorophyll over the entire leaf area; (2) specific leaf area (LSA) is calculated as the ratio of V6 leaf area to its dry mass (cm²/g dry mass), a parameter also recognized as a measure of NUE. The data are shown in Table 8.

TABLE 8

| | | | Leaf chlorophyll area | | | | Leaf chlorophyll | | | | Shoot fresh mass | | | |
|---|---|---|---|---|---|---|---|---|---|---|---|---|---|---|
| PEP SEQ ID | Construct ID | Event ID | Percent change | Mean | Mean of con-trols | P-value | Percent change | Mean | Mean of con-trols | P-value | Percent change | Mean | Mean of con-trols | P-value |
| 91 | PMON73816 | ZM_M37183 | 4 | 3688.43 | 3558.85 | 0.221 | 3 | 24.54 | 23.73 | 0.0722 | 5 | 48.04 | 45.92 | 0.1289 |
| | PMON73816 | ZM_M37183 | 15 | 5963.14 | 5180.33 | 0 | 12 | 31.72 | 28.41 | 0 | 16 | 48.24 | 41.48 | 1.00E−04 |
| | PMON73816 | ZM_M37183 | 8 | 4796 | 4439.2 | 0.0438 | 3 | 27.1 | 26.2 | 0.2569 | 23 | 55.2 | 44.8 | 0 |
| | PMON73816 | ZM_M37188 | 12 | 4002.73 | 3558.85 | 0 | 13 | 26.86 | 23.73 | 0 | 4 | 47.83 | 45.92 | 0.1707 |
| | PMON73816 | ZM_M37188 | 13 | 5832.79 | 5180.33 | 3.00E−04 | 12 | 31.73 | 28.41 | 0 | 11 | 46.25 | 41.48 | 0.0046 |
| | PMON73816 | ZM_M37188 | −9 | 4037.7 | 4439.2 | 0.0234 | −1 | 26 | 26.2 | 0.7492 | −10 | 40.4 | 44.8 | 0.0144 |
| | PMON73816 | ZM_M37197 | 4 | 5375.2 | 5180.33 | 0.2694 | 1 | 28.81 | 28.41 | 0.5194 | 17 | 48.42 | 41.48 | 0 |
| | PMON73816 | ZM_M37197 | 21 | 5374.8 | 4439.2 | 0 | 14 | 29.9 | 26.2 | 0 | 30 | 58.4 | 44.8 | 0 |
| | PMON73816 | ZM_M37197 | 5 | 3733.33 | 3558.85 | 0.0996 | 1 | 24.02 | 23.73 | 0.522 | 5 | 48.42 | 45.92 | 0.0742 |
| 100 | PMON75511 | ZM_M44958 | 18.1 | 5065.43 | 4287.52 | 1.00E−04 | 13.9 | 29.44 | 25.86 | 0 | 12 | 44.22 | 39.48 | 0.0096 |
| | PMON75511 | ZM_M44958 | 7.3 | 8006.21 | 7460.91 | 0.0071 | 5.5 | 40.63 | 38.5 | 0.0072 | 0 | 67.53 | 67.56 | 0.9892 |
| | PMON75511 | ZM_M44961 | 8.2 | 4639.06 | 4287.52 | 0.0583 | 5.8 | 27.36 | 25.86 | 0.0449 | 6.7 | 42.13 | 39.48 | 0.1258 |
| | PMON75511 | ZM_M44961 | 4.7 | 7810.27 | 7460.91 | 0.0947 | 4.9 | 40.41 | 38.5 | 0.0195 | 4.9 | 70.87 | 67.56 | 0.1511 |
| | PMON75511 | ZM_M46591 | 5.1 | 4504.72 | 4287.52 | 0.2951 | 5.5 | 27.27 | 25.86 | 0.0734 | −4.5 | 37.69 | 39.48 | 0.3276 |
| | PMON75511 | ZM_M46591 | −4.3 | 7142.88 | 7460.91 | 0.1149 | −1.4 | 37.98 | 38.5 | 0.4997 | 8 | 72.98 | 67.56 | 0.0151 |
| | PMON75511 | ZM_M46601 | 12.3 | 4813.03 | 4287.52 | 0.0117 | 4.7 | 27.07 | 25.86 | 0.1494 | 22.4 | 48.31 | 39.48 | 0 |
| | PMON75511 | ZM_M46601 | 7.7 | 8036.73 | 7460.91 | 0.0045 | 5 | 40.44 | 38.5 | 0.014 | 0.3 | 67.76 | 67.56 | 0.93 |
| 114 | PMON75980 | ZM_M53387 | −8 | 3998.29 | 4368.22 | 0.0065 | 2 | 24.35 | 23.8 | 0.3237 | −18 | 37.79 | 45.85 | 0 |
| | PMON75980 | ZM_M53389 | −10 | 3323.6 | 3691.69 | 0.0189 | −3 | 23.05 | 23.65 | 0.3551 | −8 | 30.6 | 33.21 | 0.0804 |
| | PMON75980 | ZM_M53389 | −5 | 4139.75 | 4368.22 | 0.1038 | −2 | 23.42 | 23.8 | 0.4834 | −10 | 41.22 | 45.85 | 0.0031 |
| | PMON75980 | ZM_M53390 | 8 | 4728.73 | 4368.22 | 0.0188 | 5 | 25.07 | 23.8 | 0.0272 | −3 | 44.65 | 45.85 | 0.4407 |
| | PMON75980 | ZM_M53390 | 10 | 4044.06 | 3691.69 | 0.0245 | 2 | 24.24 | 23.65 | 0.3703 | 9 | 36.29 | 33.21 | 0.0398 |
| | PMON75980 | ZM_M53392 | 27 | 4679.18 | 3691.69 | 0 | 10 | 26.06 | 23.65 | 3.00E−04 | 27 | 42.31 | 33.21 | 0 |
| | PMON75980 | ZM_M53392 | 2 | 4446.67 | 4368.22 | 0.5757 | 4 | 24.88 | 23.8 | 0.0534 | 3 | 47.36 | 45.85 | 0.3298 |
| | PMON75980 | ZM_M53396 | 13 | 4948.67 | 4368.22 | 0 | 7 | 25.37 | 23.8 | 0.0068 | 8 | 49.32 | 45.85 | 0.0259 |
| | PMON75980 | ZM_M53396 | 16 | 4271.59 | 3691.69 | 2.00E−04 | 4 | 24.7 | 23.65 | 0.109 | 13 | 37.46 | 33.21 | 0.0046 |
| | PMON75980 | ZM_M53397 | 1 | 4411.5 | 4368.22 | 0.7574 | 1 | 24.06 | 23.8 | 0.6707 | −6 | 43.08 | 45.85 | 0.0992 |
| | PMON75980 | ZM_M53398 | 2 | 4476.43 | 4368.22 | 0.4235 | 7 | 25.36 | 23.8 | 0.0052 | −6 | 43.12 | 45.85 | 0.0792 |
| 103 | PMON78949 | ZM_M63936 | −2.1 | 4587.66 | 4686.12 | 0.4835 | 3.3 | 30.35 | 29.37 | 0.1605 | −6.1 | 32.65 | 34.77 | 0.0457 |
| | PMON78949 | ZM_M63936 | −2.1 | 3863.18 | 3946.32 | 0.4391 | −0.6 | 28.37 | 28.55 | 0.7352 | 8.7 | 45.14 | 41.55 | 0.0077 |
| | PMON78949 | ZM_M63941 | 7.5 | 5037.73 | 4686.12 | 0.0128 | 3.9 | 30.51 | 29.37 | 0.1021 | 7.4 | 37.33 | 34.77 | 0.0158 |
| | PMON78949 | ZM_M63941 | −1.9 | 3871.03 | 3946.32 | 0.4835 | −2.5 | 27.83 | 28.55 | 0.1742 | 9.8 | 45.63 | 41.55 | 0.0036 |
| | PMON78949 | ZM_M63942 | 7.5 | 5036.21 | 4686.12 | 0.0132 | 6.4 | 31.26 | 29.37 | 0.007 | 9.2 | 37.98 | 34.77 | 0.0025 |
| | PMON78949 | ZM_M63942 | 13 | 4459.25 | 3946.32 | 0 | 7.6 | 30.73 | 28.55 | 0 | 9.2 | 45.37 | 41.55 | 0.0047 |
| | PMON78949 | ZM_M63944 | 4.3 | 4887.29 | 4686.12 | 0.1528 | 4.9 | 30.81 | 29.37 | 0.0393 | −6.6 | 32.48 | 34.77 | 0.0306 |
| | PMON78949 | ZM_M63944 | 0.8 | 3979.53 | 3946.32 | 0.7571 | 0.4 | 28.66 | 28.55 | 0.8318 | −0.9 | 41.17 | 41.55 | 0.7776 |
| 108 | PMON79709 | ZM_M51983 | 3 | 5110.49 | 4947.82 | 0.1855 | 6 | 28.18 | 26.59 | 0.0012 | 4 | 46.1 | 44.36 | 0.076 |
| | PMON79709 | ZM_M51983 | 2 | 6011.13 | 5906.6 | 0.6174 | 3 | 28.75 | 27.9 | 0.2078 | 16 | 62.26 | 53.53 | 2.00E−04 |
| | PMON79709 | ZM_M51983 | 0.9 | 5829.16 | 5776.02 | 0.7681 | −0.7 | 30.24 | 30.45 | 0.7671 | −3.1 | 45.46 | 46.92 | 0.4097 |
| | PMON79709 | ZM_M51985 | 0 | 5773.16 | 5776.02 | 0.988 | −0.2 | 30.38 | 30.45 | 0.9183 | −1.6 | 46.16 | 46.92 | 0.682 |
| | PMON79709 | ZM_M51985 | 7 | 6301.05 | 5906.6 | 0.0602 | 3 | 28.81 | 27.9 | 0.1763 | 16 | 62.11 | 53.53 | 2.00E−04 |
| | PMON79709 | ZM_M51985 | 6 | 5263.87 | 4947.82 | 0.0079 | 6 | 28.07 | 26.59 | 0.0026 | 3 | 45.48 | 44.36 | 0.2555 |
| | PMON79709 | ZM_M52025 | 3 | 5075.34 | 4947.82 | 0.2817 | 4 | 27.58 | 26.59 | 0.0415 | 4 | 46.33 | 44.36 | 0.052 |
| | PMON79709 | ZM_M52025 | 3.2 | 5959.63 | 5776.02 | 0.3087 | −1.7 | 29.93 | 30.45 | 0.4617 | 1 | 47.38 | 46.92 | 0.7983 |
| | PMON79709 | ZM_M52025 | 21 | 7124.16 | 5906.6 | 0 | 14 | 31.74 | 27.9 | 0 | 20 | 64.48 | 53.53 | 0 |
| | PMON79709 | ZM_M52710 | 6 | 6240.85 | 5906.6 | 0.1109 | 10 | 30.6 | 27.9 | 1.00E−04 | 9 | 58.5 | 53.53 | 0.0321 |
| | PMON79709 | ZM_M52710 | 8 | 5339.8 | 4947.82 | 0.001 | 7 | 28.46 | 26.59 | 1.00E−04 | 3 | 45.82 | 44.36 | 0.1373 |
| | PMON79709 | ZM_M52710 | 3.8 | 5995.36 | 5776.02 | 0.2241 | 3.6 | 31.55 | 30.45 | 0.1214 | −4.1 | 45 | 46.92 | 0.2779 |
| | PMON79709 | ZM_M52720 | 7.4 | 6201.46 | 5776.02 | 0.0188 | 5.2 | 32.04 | 30.45 | 0.0258 | 6.1 | 49.8 | 46.92 | 0.1242 |
| | PMON79709 | ZM_M52720 | 7 | 5280.25 | 4947.82 | 0.0053 | 7 | 28.39 | 26.59 | 2.00E−04 | −5 | 42.31 | 44.36 | 0.0357 |
| | PMON79709 | ZM_M52720 | 12 | 6617.79 | 5906.6 | 8.00E−04 | 9 | 30.28 | 27.9 | 9.00E−04 | 3 | 55.01 | 53.53 | 0.5222 |
| 96 | PMON80270 | ZM_M55967 | 5.2 | 6306.34 | 5993.37 | 0.0376 | 4.3 | 30.64 | 29.39 | 0.028 | 7.3 | 54.7 | 50.98 | 0.0017 |
| | PMON80270 | ZM_M55967 | 6.6 | 5.33 | 5 | 0.0666 | 6.7 | 33.48 | 31.38 | 0.0075 | 6 | 44.75 | 42.21 | 0.0627 |
| | PMON80270 | ZM_M55968 | 16.6 | 5.83 | 5 | 0 | 5.7 | 33.17 | 31.38 | 0.0421 | 17.5 | 49.6 | 42.21 | 0 |
| | PMON80270 | ZM_M55968 | −1 | 5930.77 | 5993.37 | 0.6873 | −0.5 | 29.25 | 29.39 | 0.8058 | 7.7 | 54.89 | 50.98 | 0.001 |
| | PMON80270 | ZM_M55969 | −4.1 | 5749.51 | 5993.37 | 0.1048 | 0.3 | 29.47 | 29.39 | 0.892 | 4.7 | 53.36 | 50.98 | 0.0427 |
| | PMON80270 | ZM_M55969 | 5 | 5.25 | 5 | 0.1118 | 4.1 | 32.66 | 31.38 | 0.1464 | 8 | 45.58 | 42.21 | 0.0139 |
| | PMON80270 | ZM_M55970 | −2.3 | 5855.83 | 5993.37 | 0.3595 | 1.3 | 29.76 | 29.39 | 0.5246 | 4.4 | 53.2 | 50.98 | 0.0504 |
| | PMON80270 | ZM_M55970 | 2.6 | 5.13 | 5 | 0.4257 | −2.5 | 30.58 | 31.38 | 0.3062 | 2.9 | 43.45 | 42.21 | 0.3616 |
| | PMON80270 | ZM_M55971 | −4 | 5754.31 | 5993.37 | 0.1118 | 0.7 | 29.61 | 29.39 | 0.7 | 1.8 | 51.92 | 50.98 | 0.4075 |
| | PMON80270 | ZM_M55971 | 6 | 5.3 | 5 | 0.0728 | 4.8 | 32.89 | 31.38 | 0.0536 | 6 | 44.74 | 42.21 | 0.064 |
| | PMON80270 | ZM_M55972 | −1 | 5933.48 | 5993.37 | 0.6897 | −0.3 | 29.29 | 29.39 | 0.8631 | 3.6 | 52.81 | 50.98 | 0.1193 |
| | PMON80270 | ZM_M55972 | 13.8 | 5.69 | 5 | 0 | 5.1 | 32.99 | 31.38 | 0.0397 | 9.4 | 46.19 | 42.21 | 0.0037 |
| | PMON80270 | ZM_M56524 | 8 | 5.4 | 5 | 0.0364 | 5.1 | 32.98 | 31.38 | 0.0413 | 15.5 | 48.74 | 42.21 | 0 |
| | PMON80270 | ZM_M56524 | −1.4 | 5908.18 | 5993.37 | 0.5702 | 1 | 29.67 | 29.39 | 0.6255 | 6.3 | 54.18 | 50.98 | 0.0067 |
| | PMON80270 | ZM_M56526 | −2.7 | 5829.79 | 5993.37 | 0.276 | −1.4 | 28.98 | 29.39 | 0.4744 | 2.5 | 52.23 | 50.98 | 0.2681 |
| | PMON80270 | ZM_M56526 | 20 | 6 | 5 | 0 | 0.5 | 31.54 | 31.38 | 0.8352 | 13.8 | 48.05 | 42.21 | 0 |
| | PMON80270 | ZM_M56527 | 1.2 | 6063.11 | 5993.37 | 0.6421 | −0.2 | 29.32 | 29.39 | 0.8978 | 5.6 | 53.82 | 50.98 | 0.0126 |
| | PMON80270 | ZM_M56527 | 2.2 | 5.11 | 5 | 0.489 | 2.4 | 32.14 | 31.38 | 0.3294 | 4.1 | 43.95 | 42.21 | 0.2012 |
| 118 | PMON80461 | ZM_M52932 | 24.5 | 8417.13 | 6759.85 | 0 | 13.4 | 34.66 | 30.57 | 0 | 25.7 | 76.5 | 60.88 | 0 |
| | PMON80461 | ZM_M52932 | 6 | 7095.13 | 6713.17 | 0.0553 | 3 | 30.63 | 29.82 | 0.294 | −1 | 54.05 | 54.73 | 0.653 |
| | PMON80461 | ZM_M52932 | 1 | 4877.13 | 4816.31 | 0.5834 | 2 | 29.24 | 28.65 | 0.2351 | −2 | 30.75 | 31.34 | 0.4187 |
| | PMON80461 | ZM_M52932 | −4.5 | 5830.38 | 6107.25 | 0.1599 | −1.1 | 29.45 | 29.77 | 0.6468 | −2.7 | 37.58 | 38.63 | 0.5145 |

TABLE 8-continued

| | | | Leaf chlorophyll area | | | | Leaf chlorophyll | | | | Shoot fresh mass | | | |
|---|---|---|---|---|---|---|---|---|---|---|---|---|---|---|
| PEP SEQ ID | Construct ID | Event ID | Percent change | Mean | Mean of controls | P-value | Percent change | Mean | Mean of controls | P-value | Percent change | Mean | Mean of controls | P-value |
| | PMON80461 | ZM_M52932 | −9 | 4808.1 | 5269.64 | 0.0084 | 1 | 30.86 | 30.68 | 0.7905 | 2 | 35.8 | 35.13 | 0.4119 |
| | PMON80461 | ZM_M52932 | 8.2 | 5068.24 | 4686.12 | 0.0069 | 10 | 32.31 | 29.37 | 0 | −6 | 32.68 | 34.77 | 0.0483 |
| | PMON80461 | ZM_M52932 | 14.3 | 4511.99 | 3946.32 | 0 | 6.5 | 30.42 | 28.55 | 5.00E−04 | 11 | 46.12 | 41.55 | 7.00E−04 |
| | PMON80461 | ZM_M53218 | −14.6 | 5773.62 | 6759.85 | 1.00E−04 | −5.6 | 28.87 | 30.57 | 0.0168 | −16.4 | 50.92 | 60.88 | 1.00E−04 |
| | PMON80461 | ZM_M53218 | 7 | 7166.44 | 6713.17 | 0.0231 | 5 | 31.33 | 29.82 | 0.0501 | 9 | 59.48 | 54.73 | 0.002 |
| | PMON80461 | ZM_M53218 | 2 | 4908.21 | 4816.31 | 0.4075 | 3 | 29.55 | 28.65 | 0.072 | 3 | 32.25 | 31.34 | 0.1908 |
| | PMON80461 | ZM_M53218 | −9 | 4808.4 | 5269.64 | 0.0085 | −2 | 30.04 | 30.68 | 0.3563 | −2 | 34.52 | 35.13 | 0.4641 |
| | PMON80461 | ZM_M53218 | 8.2 | 5071.81 | 4686.12 | 0.0064 | 6.2 | 31.19 | 29.37 | 0.0096 | 0.4 | 34.91 | 34.77 | 0.8893 |
| | PMON80461 | ZM_M53218 | 1.7 | 6211.2 | 6107.25 | 0.6164 | −1.5 | 29.33 | 29.77 | 0.5225 | 0.9 | 38.97 | 38.63 | 0.8332 |
| | PMON80461 | ZM_M53218 | 1.1 | 3987.88 | 3946.32 | 0.6988 | 1.3 | 28.92 | 28.55 | 0.484 | 1.3 | 42.07 | 41.55 | 0.6981 |
| | PMON80461 | ZM_M53235 | 3 | 4955.98 | 4816.31 | 0.2084 | 1 | 28.93 | 28.65 | 0.5828 | 0 | 31.45 | 31.34 | 0.8709 |
| | PMON80461 | ZM_M53235 | 20.2 | 8122.46 | 6759.85 | 0 | 13.8 | 34.79 | 30.57 | 0 | 17.3 | 71.4 | 60.88 | 0 |
| | PMON80461 | ZM_M53235 | 3 | 6907.56 | 6713.17 | 0.3282 | 5 | 31.36 | 29.82 | 0.0447 | 1 | 55.05 | 54.73 | 0.8357 |
| | PMON80461 | ZM_M53503 | 2 | 4921.37 | 4816.31 | 0.3438 | 8 | 30.95 | 28.65 | 0 | 3 | 32.32 | 31.34 | 0.1605 |
| | PMON80461 | ZM_M53503 | 14.9 | 7763.72 | 6759.85 | 1.00E−04 | 10.4 | 33.77 | 30.57 | 0 | 25.9 | 76.63 | 60.88 | 0 |
| | PMON80461 | ZM_M53503 | 7 | 7197.24 | 6713.17 | 0.0154 | 6 | 31.54 | 29.82 | 0.0255 | 12 | 61.48 | 54.73 | 0 |
| | PMON80461 | ZM_M53504 | −1 | 6666.94 | 6713.17 | 0.816 | 1 | 29.98 | 29.82 | 0.8413 | 10 | 60.29 | 54.73 | 6.00E−04 |
| | PMON80461 | ZM_M53504 | −1 | 4748.6 | 4816.31 | 0.5416 | −1 | 28.4 | 28.65 | 0.6231 | −2 | 30.82 | 31.34 | 0.4559 |
| | PMON80461 | ZM_M53504 | −15.3 | 5724.41 | 6759.85 | 0 | −8.6 | 27.93 | 30.57 | 2.00E−04 | −21 | 48.11 | 60.88 | 0 |
| | PMON80461 | ZM_M53848 | 2 | 4897.29 | 4816.31 | 0.4654 | 4 | 29.87 | 28.65 | 0.0153 | −2 | 30.63 | 31.34 | 0.3077 |
| | PMON80461 | ZM_M53848 | −15.3 | 5722.73 | 6759.85 | 0 | −5.6 | 28.87 | 30.57 | 0.0168 | −24.1 | 46.19 | 60.88 | 0 |
| | PMON80461 | ZM_M53848 | 3 | 6882.64 | 6713.17 | 0.394 | 7 | 31.86 | 29.82 | 0.008 | 2 | 56 | 54.73 | 0.4059 |
| | PMON80461 | ZM_M54282 | 0 | 4800.09 | 4816.31 | 0.8878 | 2 | 29.31 | 28.65 | 0.2011 | −1 | 30.98 | 31.34 | 0.6261 |
| | PMON80461 | ZM_M54282 | −2 | 6592.76 | 6713.17 | 0.5446 | −2 | 29.35 | 29.82 | 0.5372 | 3 | 56.57 | 54.73 | 0.2552 |
| | PMON80461 | ZM_M54282 | −12.7 | 5900.82 | 6759.85 | 7.00E−04 | −4.9 | 29.07 | 30.57 | 0.0346 | −19.8 | 48.83 | 60.88 | 0 |
| | PMON80461 | ZM_M54284 | 7 | 7155.9 | 6713.17 | 0.0265 | 5 | 31.2 | 29.82 | 0.0723 | 1 | 55.01 | 54.73 | 0.855 |
| | PMON80461 | ZM_M54284 | 19.2 | 8060.14 | 6759.85 | 0 | 9.7 | 33.55 | 30.57 | 0 | 16.4 | 70.88 | 60.88 | 1.00E−04 |
| | PMON80461 | ZM_M54284 | 5 | 5052.8 | 4816.31 | 0.0404 | 1 | 28.94 | 28.65 | 0.5692 | 3 | 32.14 | 31.34 | 0.2488 |
| | PMON80461 | ZM_M55266 | −2.4 | 5962.4 | 6107.25 | 0.4616 | 0.2 | 29.81 | 29.77 | 0.9457 | −6.7 | 36.04 | 38.63 | 0.1098 |
| | PMON80461 | ZM_M55957 | 5 | 6414.71 | 6107.25 | 0.1187 | 2.9 | 30.63 | 29.77 | 0.2128 | −3.7 | 37.21 | 38.63 | 0.3528 |
| | PMON80461 | ZM_M56233 | 2.7 | 6270.89 | 6107.25 | 0.4056 | 5 | 31.25 | 29.77 | 0.0426 | −0.7 | 38.38 | 38.63 | 0.8653 |
| | PMON80461 | ZM_M56728 | 3.8 | 6338.35 | 6107.25 | 0.2405 | 4 | 30.96 | 29.77 | 0.0831 | −0.5 | 38.43 | 38.63 | 0.8911 |
| 102 | PMON80542 | ZM_M57107 | −3.8 | 5766.93 | 5993.37 | 0.1461 | −0.2 | 29.34 | 29.39 | 0.9327 | 6.1 | 54.07 | 50.98 | 0.0089 |
| | PMON80542 | ZM_M57107 | 14.2 | 5.71 | 5 | 0 | 1.2 | 31.75 | 31.38 | 0.6312 | 12.3 | 47.4 | 42.21 | 2.00E−04 |
| | PMON80542 | ZM_M57119 | −8 | 5512.76 | 5993.37 | 0.0015 | −1.1 | 29.08 | 29.39 | 0.5896 | 4.6 | 53.34 | 50.98 | 0.0375 |
| | PMON80542 | ZM_M57119 | 11.6 | 5.58 | 5 | 5.00E−04 | 5.1 | 32.96 | 31.38 | 0.0429 | 16.2 | 49.03 | 42.21 | 0 |
| | PMON80542 | ZM_M57120 | 2.6 | 5.13 | 5 | 0.4257 | 2.5 | 32.16 | 31.38 | 0.3138 | −1.1 | 41.75 | 42.21 | 0.7377 |
| | PMON80542 | ZM_M57120 | −3.1 | 5807.66 | 5993.37 | 0.2163 | 0.2 | 29.46 | 29.39 | 0.9036 | 0.1 | 51.04 | 50.98 | 0.9595 |
| | PMON80542 | ZM_M57121 | −2.7 | 5829.33 | 5993.37 | 0.2746 | 1.9 | 29.94 | 29.39 | 0.3311 | 8.4 | 55.24 | 50.98 | 2.00E−04 |
| | PMON80542 | ZM_M57121 | 4.4 | 5.22 | 5 | 0.2467 | −1.4 | 30.95 | 31.38 | 0.5865 | 9 | 45.99 | 42.21 | 0.0058 |
| | PMON80542 | ZM_M57122 | −3.5 | 5785.68 | 5993.37 | 0.1669 | 0.4 | 29.5 | 29.39 | 0.8458 | 8.9 | 55.51 | 50.98 | 1.00E−04 |
| | PMON80542 | ZM_M57122 | 0 | 5 | 5 | 1 | 2.3 | 32.1 | 31.38 | 0.3537 | 6.8 | 45.07 | 42.21 | 0.0474 |
| | PMON80542 | ZM_M57124 | −3 | 5815.15 | 5993.37 | 0.2353 | −2.7 | 28.61 | 29.39 | 0.1694 | 6.6 | 54.33 | 50.98 | 0.0032 |
| | PMON80542 | ZM_M57124 | 13.4 | 5.67 | 5 | 2.00E−04 | 0.3 | 31.48 | 31.38 | 0.8981 | 13.1 | 47.74 | 42.21 | 1.00E−04 |
| | PMON80542 | ZM_M57131 | 13.3 | 7776.21 | 6866.4 | 0 | 6.5 | 33.54 | 31.48 | 0.0099 | 27.9 | 68.11 | 53.23 | 0 |
| | PMON80542 | ZM_M57132 | −2.3 | 5853.25 | 5993.37 | 0.3506 | −2.3 | 28.71 | 29.39 | 0.2306 | 13.2 | 57.73 | 50.98 | 0 |
| | PMON80542 | ZM_M57132 | 7.6 | 5.38 | 5 | 0.0174 | −1.9 | 30.79 | 31.38 | 0.4522 | 7.4 | 45.34 | 42.21 | 0.0221 |
| | PMON80542 | ZM_M57146 | 0.6 | 6031.47 | 5993.37 | 0.7995 | 4.9 | 30.82 | 29.39 | 0.0124 | −2.6 | 49.63 | 50.98 | 0.2347 |
| | PMON80542 | ZM_M57146 | 0.4 | 5.02 | 5 | 0.9047 | 7 | 33.58 | 31.38 | 0.0052 | 0.7 | 42.51 | 42.21 | 0.8221 |
| 123 | PMON80850 | ZM_M56061 | −3.7 | 4.94 | 5.13 | 0.1027 | 2.8 | 30.43 | 29.6 | 0.2912 | −1.8 | 44.81 | 45.62 | 0.6326 |
| | PMON80850 | ZM_M56061 | −1.1 | 5272.7 | 5331.51 | 0.7088 | 0.7 | 28.56 | 28.35 | 0.7113 | −6.3 | 42.33 | 45.16 | 0.0465 |
| | PMON80850 | ZM_M56062 | 3.5 | 5.31 | 5.13 | 0.1181 | 0.1 | 29.63 | 29.6 | 0.9654 | 6.2 | 48.44 | 45.62 | 0.0972 |
| | PMON80850 | ZM_M56062 | 4.4 | 5566.18 | 5331.51 | 0.1369 | 1.6 | 28.8 | 28.35 | 0.4251 | 9.3 | 49.37 | 45.16 | 0.0032 |
| | PMON80850 | ZM_M56071 | −3.3 | 4.96 | 5.13 | 0.141 | 2.5 | 30.33 | 29.6 | 0.379 | 7.6 | 49.1 | 45.62 | 0.0407 |
| | PMON80850 | ZM_M56071 | −0.5 | 5302.33 | 5331.51 | 0.853 | −0.8 | 28.11 | 28.35 | 0.6697 | 10.7 | 50.01 | 45.16 | 7.00E−04 |
| | PMON80850 | ZM_M56222 | −0.8 | 5.09 | 5.13 | 0.719 | 6.1 | 31.41 | 29.6 | 0.0211 | 0.9 | 46.01 | 45.62 | 0.8177 |
| | PMON80850 | ZM_M56222 | 4 | 5545.23 | 5331.51 | 0.1754 | 4.2 | 29.53 | 28.35 | 0.0367 | −0.8 | 44.78 | 45.16 | 0.7867 |
| | PMON80850 | ZM_M56722 | −1.8 | 5.05 | 5.13 | 0.4557 | 0.1 | 29.61 | 29.6 | 0.9841 | −5.6 | 43.05 | 45.62 | 0.1295 |
| | PMON80850 | ZM_M56722 | 0.9 | 5379.37 | 5331.51 | 0.7693 | 2.1 | 28.94 | 28.35 | 0.3101 | 2.8 | 46.42 | 45.16 | 0.3906 |
| | PMON80850 | ZM_M56723 | −4.1 | 4.92 | 5.13 | 0.0711 | −1.2 | 29.25 | 29.6 | 0.6582 | −2.9 | 44.28 | 45.62 | 0.4536 |
| | PMON80850 | ZM_M56723 | 8.3 | 5774.12 | 5331.51 | 0.0052 | 2.1 | 28.94 | 28.35 | 0.2947 | 2.6 | 46.33 | 45.16 | 0.4113 |
| | PMON80850 | ZM_M57056 | 7.2 | 5.51 | 5.13 | 0.0014 | 5 | 31.06 | 29.6 | 0.0623 | 11.5 | 50.85 | 45.62 | 0.0022 |
| | PMON80850 | ZM_M57056 | 2.6 | 5472.58 | 5331.51 | 0.3707 | 1.4 | 28.75 | 28.35 | 0.4782 | 2.1 | 46.11 | 45.16 | 0.5035 |

Nitrogen Use Field Efficacy Assay

Level I. Transgenic plants provided by the present invention are planted in field without any nitrogen source being applied. Transgenic plants and control plants are grouped by genotype and construct with controls arranged randomly within genotype blocks. Each type of transgenic plants are tested by 3 replications and across 5 locations. Nitrogen levels in the fields are analyzed in early April pre-planting by collecting 30 sample soil cores from 0-24" and 24 to 48" soil layer. Soil samples are analyzed for nitrate-nitrogen, phosphorus(P), Potassium(K), organic matter and pH to provide baseline values. P, K and micronutrients are applied based upon soil test recommendations.

Level II. Transgenic plants provided by the present invention are planted in field with three levels of nitrogen (N) fertilizer being applied, i.e. low level (0 N), medium level (80 lb/ac) and high level (180 lb/ac). Liquid 28% or 32% UAN (Urea, Ammonium Nitrogen) are used as the N source and apply by broadcast boom and incorporate with a field cultivator with rear rolling basket in the same direction as intended crop rows. Although there is no N applied to the 0 N treatment the soil should still be disturbed in the same fashion as the treated area. Transgenic plants and control plants are grouped by genotype and construct with controls arranged randomly within genotype blocks. Each type of transgenic plants is tested by 3 replications and across 4 locations. Nitrogen levels in the fields are analyzed in early April pre-planting by collecting 30 sample soil cores from 0-24" and 24 to 48" soil layer. Soil samples are analyzed for nitrate-nitrogen, phosphorus(P), Potassium(K), organic matter and pH to provide baseline values. P, K and micronutrients are applied based upon soil test recommendations.

TABLE 9

Genes increase seed yield in transgenic plants at different nitrogen levels.

| | PEP SEQ ID NO | Phe ID | Gene | Construct | Event | Transgenic mean | Control Mean | Percent change | Pvalue |
|---|---|---|---|---|---|---|---|---|---|
| I | 108 | PHE0001623_1734 | maize magnesium transporter, mrs2-1-like 1 | PMON79709 | ZM_M51983 | 137.5 | 124.76521 | 10.207 | 0.0908 |
| | 105 | PHE0001376_1468 | Corn Rubisco Activase 2 | PMON75524 | ZM_M47998 | 140.2 | 124.76521 | 12.3711 | 0.0407 |
| | 130 | PHE0001111_1201 | Yeast alanine aminotransferase | PMON77895 | ZM_M61017 | 140.3 | 124.76521 | 12.4512 | 0.0394 |

| | PEP SEQ ID NO | Phe ID | Gene | Construct | treatment | event | Transgenic yield | Control yield | Percent change | P-value |
|---|---|---|---|---|---|---|---|---|---|---|
| II | 114 | PHE0002412_2512 | *Ralstonia metallidurans* glutamate decarboxylase | pMON75980 | High | ZM_M53398 | 159.7 | 142.45 | 10.801503 | 0.0621 |
| | | PHE0002412_2512 | *Ralstonia metallidurans* glutamate decarboxylase | | Low | ZM_M53398 | 137.125 | 125.14298 | 8.7380273 | 0.0263 |
| | | PHE0002412_2512 | *Ralstonia metallidurans* glutamate decarboxylase | | High | ZM_M53392 | 202.575 | 190.5333333 | 5.9443005 | 0.0833 |
| | 118 | PHE0002492_2592 | *Arabidopsis* E2F | pMON80461 | High | ZM_M53218 | 160.6 | 142.45 | 11.30137 | 0.0498 |
| | | PHE0002492_2592 | *Arabidopsis* E2F | | High | ZM_M53848 | 158.675 | 142.45 | 10.225303 | 0.0792 |
| | | PHE0002492_2592 | *Arabidopsis* E2F | | Low | ZM_M53848 | 141.175 | 125.14298 | 11.356132 | 0.0031 |
| | | PHE0002492_2592 | *Arabidopsis* E2F | | Med | ZM_M53218 | 159.15 | 145.075 | 8.843858 | 0.0883 |
| | 91 | PHE0001017_1108 | MADS box 110 | pMON73816 | Low | ZM_M37188 | 134.575 | 125.14298 | 7.008746 | 0.0798 |

B. Selection for Increased Yield

Many transgenic plants of this invention exhibit improved yield as compared to a control plant. Improved yield can result from enhanced seed sink potential, i.e. the number and size of endosperm cells or kernels and/or enhanced sink strength, i.e. the rate of starch biosynthesis. Sink potential can be established very early during kernel development, as endosperm cell number and size are determined within the first few days after pollination.

Much of the increase in corn yield of the past several decades has resulted from an increase in planting density. During that period, corn yield has been increasing at a rate of 2.1 bushels/acre/year, but the planting density has increased at a rate of 250 plants/acre/year. A characteristic of modern hybrid corn is the ability of these varieties to be planted at high density. Many studies have shown that a higher than current planting density should result in more biomass production, but current germplasm does not perform, well at these higher densities. One approach to increasing yield is to increase harvest index (HI), the proportion of biomass that is allocated to the kernel compared to total biomass, in high density plantings.

Effective yield selection of enhanced yielding transgenic corn events uses hybrid progeny of the transgenic event over multiple locations with plants grown under optimal production management practices, and maximum pest control. A useful target for improved yield is a 5% to 10% increase in yield as compared to yield produced by plants grown from seed for a control plant. Selection methods may be applied in multiple and diverse geographic locations, for example up to 16 or more locations, over one or more plating seasons, for example at least two planting seasons to statistically distinguish yield improvement from natural environmental effects. It is to plant multiple transgenic plants, positive and negative control plants, and pollinator plants in standard plots, for example 2 row plots, 20 feet long by 5 feet wide with 30 inches distance between rows and a 3 foot alley between ranges. Transgenic events can be grouped by recombinant DNA constructs with groups randomly placed in the field. A pollinator plot of a high quality corn line is planted for every two plots to allow open pollination when using male sterile transgenic events. A useful planting density is about 30,000 plants/acre. High planting density is greater than 30,000 plants/acre, preferably about 40,000 plants/acre, more preferably about 42,000 plants/acre, most preferably about 45,000 plants/acre. Surrogate indicators for yield improvement include source capacity (biomass), source output (sucrose and photosynthesis), sink components (kernel size, ear size, starch in the seed), development (light response, height, density tolerance), maturity, early flowering trait and physiological responses to high density planting, for example at 45,000 plants per acre, for example as illustrated in Table 10 and 11.

TABLE 10

| Timing | Evaluation | Description | comments |
|---|---|---|---|
| V2-3 | Early stand | Can be taken any time after germination and prior to removal of any plants. | |
| Pollen shed | GDU to 50% shed | GDU to 50% plants shedding 50% tassel. | |
| Silking | GDU to 50% silk | GDU to 50% plants showing silks. | |
| Maturity | Plant height | Height from soil surface to flag leaf attachment (inches). | 10 plants per plot - Yield team assistance |
| Maturity | Ear height | Height from soil surface to primary ear attachment node. | 10 plants per plot - Yield team assistance |
| Maturity | Leaves above ear | visual scores: erect, size, rolling | |
| Maturity | Tassel size | Visual scores +/− vs. WT | |
| Pre-Harvest | Final Stand | Final stand count prior to harvest, exclude tillers | |
| Pre-Harvest | Stalk lodging | No. of stalks broken below the primary ear attachment. Exclude leaning tillers | |
| Pre-Harvest | Root lodging | No. of stalks leaning >45° angle from perpendicular. | |
| Pre-Harvest | Stay green | After physiological maturity and when differences among genotypes are evident: Scale 1 (90-100% tissue green)-9 (0-19% tissue green). | |
| Harvest | Grain Yield | Grain yield/plot (Shell weight) | |

TABLE 11

| Timing | Evaluation | Description |
|---|---|---|
| V8-V12 | Chlorophyll | |
| V12-VT | Ear leaf area | |
| V15-15DAP | Chl fluorescence | |
| V15-15DAP | CER | |
| 15-25 DAP | Carbohydrates | sucrose, starch |
| Pre-Harvest | 1st internode diameter | |
| Pre-Harvest | Base 3 internode diameter | |
| Pre-Harvest | Ear internode diameter | |
| Maturity | Ear traits | diameter, length, kernel number, kernel weight |

Electron transport rates (ETR) and CO2 exchange rates (CER): ETR and CER were measured with Li6400LCF (Licor, Lincoln, Nebr.) around V9-R1 stages. Leaf chlorophyll fluorescence is a quick way to monitor the source activity and was reported to be highly correlated with $CO_2$ assimilation under varies conditions (Photosyn Research, 37: 89-102). The youngest fully expanded leaf or 2 leaves above the ear leaf was measured with actinic light 1500 (with 10% blue light) micromol $m^{-2}$ $s^{-1}$, 28° C., CO2 levels 450 ppm. Ten plants were measured in each event. There were 2 readings for each plant.

A hand-held chlorophyll meter SPAD-502 (Minolta-Japan) was used to measure the total chlorophyll level on live transgenic plants and the wild type counterparts a. Three trifoliates from each plant were analyzed, and each trifoliate were analyzed three times. Then 9 data points were averaged to obtain the chlorophyll level. The number of analyzed plants of each genotype ranged from 5 to 8.

TABLE 12

| pep | | | Witchita, KS | | | Carrollton, IL | | |
|---|---|---|---|---|---|---|---|---|
| SEQ ID | construct | | Mean SPAD vaule | % change | p-value | Mean SPAD vaule | % change | p-value |
| 88 | pMON68399 | ZM_M31143 | 64.8 | 2 | 0.5215 | 58.87 | 4 | 0.0507 |
| | | ZM_M31143 | 64.8 | 2 | 0.5828 | | | |
| | | ZM_M31146 | 64 | 1 | 0.7624 | 54 | −1.14 | 0.0337 |
| | | ZM_M31146 | 64 | 1 | 0.8319 | | | |
| | | ZM_M31147 | 67.3 | 6 | 0.0858 | 59.84 | 6 | 0.0665 |
| | | ZM_M31147 | 67.3 | 6 | 0.105 | | | |
| | | ZM_M31152 | 66.6 | 5 | 0.1564 | 58.9 | 1 | 0.7965 |
| | | ZM_M31152 | 66.6 | 5 | 0.1862 | | | |

TABLE 12-continued

| pep SEQ ID | construct | Witchita, KS Mean SPAD vaule | % change | p-value | Carrollton, IL Mean SPAD vaule | % change | p-value |
|---|---|---|---|---|---|---|---|
| | ZM_M31524 | 60.4 | −5 | 0.2009 | 57.44 | 2 | 0.5839 |
| | ZM_M31524 | 60.4 | −5 | 0.1734 | | | |
| | ZM_M32356 | 61.9 | −2 | 0.5386 | 59.36 | −2 | 0.4308 |
| | ZM_M32356 | 61.9 | −3 | 0.4836 | | | |
| | ZM_M34171 | 62.7 | −1 | 0.7919 | 60.18 | 0 | 0.9203 |
| | ZM_M34171 | 62.7 | −1 | 0.7255 | | | |
| | ZM_M38646 | 64.5 | 2 | 0.6164 | 59.89 | 3 | 0.3042 |
| | ZM_M38646 | 64.5 | 1 | 0.6819 | | | |
| | ZM_M38660 | 67.3 | 6 | 0.0836 | 62.35 | 7 | 0.004 |

TABLE 13

| PEP SEQ ID | Construct | event | n-trt | n-ctr | ETR-ctr | % Change | Pvalue | CER-ctr | % Change |
|---|---|---|---|---|---|---|---|---|---|
| 105 | PMON75524 | ZM_M47998 | 20 | 40 | 141.3 | 3 | 0.001 | 45.7 | 7 |
| | PMON75524 | ZM_M48003 | 20 | 40 | 141.3 | 8 | 0.000 | 45.7 | 6 |
| | PMON75524 | ZM_M48004 | 20 | 40 | 141.3 | −4 | 0.000 | 45.7 | −8 |
| | PMON75524 | ZM_M48005 | 20 | 40 | 141.3 | 2 | 0.008 | 45.7 | 4 |
| | PMON75524 | ZM_M48007 | 20 | 40 | 141.3 | 4 | 0.000 | 45.7 | −3 |
| | PMON75524 | ZM_M48010 | 20 | 40 | 141.3 | 6 | 0.000 | 45.7 | 8 |
| 125 | PMON81853 | ZM_M70887 | 18 | 64 | 136.3 | −3 | 0.298 | 43.7 | −5 |
| | PMON81853 | ZM_M70888 | 22 | 64 | 136.3 | 15 | 0.000 | 43.7 | 15 |
| | PMON81853 | ZM_M70889 | 22 | 64 | 136.3 | −23 | 0.000 | 43.7 | −18 |
| | PMON81853 | ZM_M70900 | 22 | 64 | 136.3 | −14 | 0.000 | 43.7 | −14 |
| | PMON81853 | ZM_M71630 | 16 | 64 | 136.3 | 9 | 0.005 | 43.7 | 5 |
| 102 | PMON80542 | ZM_M57107 | 20 | 101 | 154.1 | 0 | 0.863 | 40.5 | 5 |
| | PMON80542 | ZM_M57119 | 20 | 101 | 154.1 | 3 | 0.002 | 40.5 | 5 |
| | PMON80542 | ZM_M57120 | 20 | 101 | 154.1 | −6 | 0.000 | 40.5 | −4 |
| | PMON80542 | ZM_M57121 | 20 | 101 | 154.1 | −5 | 0.000 | 40.5 | −8 |
| | PMON80542 | ZM_M57122 | 20 | 101 | 154.1 | 10 | 0.000 | 40.5 | 19 |
| | PMON80542 | ZM_M57124 | 20 | 101 | 154.1 | 1 | 0.514 | 40.5 | 3 |
| | PMON80542 | ZM_M57131 | 20 | 101 | 154.1 | 6 | 0.000 | 40.5 | 7 |
| | PMON80542 | ZM_M57132 | 20 | 101 | 154.1 | 9 | 0.000 | 40.5 | 11 |
| | PMON80542 | ZM_M57146 | 20 | 101 | 154.1 | 9 | 0.000 | 40.5 | 13 |

| PEP SEQ ID | Construct | Pvalue | n-trt | n-ctr | ETR-ctr | % Change | Pvalue | CER-ctr | % Change | Pvalue |
|---|---|---|---|---|---|---|---|---|---|---|
| 105 | PMON75524 | 0.000 | 10 | 42 | 153.7 | −0 | 0.978 | 45.8 | −2 | 0.067 |
| | PMON75524 | 0.000 | 10 | 42 | 153.7 | 1 | 0.414 | 45.8 | 4 | 0.001 |
| | PMON75524 | 0.000 | 11 | 42 | 153.7 | 7 | 0.000 | 45.8 | 9 | 0.000 |
| | PMON75524 | 0.012 | 12 | 42 | 153.7 | 3 | 0.004 | 45.8 | 5 | 0.000 |
| | PMON75524 | 0.052 | 11 | 42 | 153.7 | 1 | 0.498 | 45.8 | −2 | 0.072 |
| | PMON75524 | 0.000 | 10 | 42 | 153.7 | 7 | 0.000 | 45.8 | 9 | 0.000 |
| 125 | PMON81853 | 0.097 | 19 | 51 | 151.5 | 8 | 0.001 | 34.8 | 9 | 0.012 |
| | PMON81853 | 0.000 | 10 | 51 | 151.5 | 11 | 0.000 | 34.8 | 22 | 0.000 |
| | PMON81853 | 0.000 | 16 | 51 | 151.5 | 10 | 0.000 | 34.8 | 13 | 0.000 |
| | PMON81853 | 0.000 | 21 | 51 | 151.5 | 1 | 0.666 | 34.8 | −0 | 0.944 |
| | PMON81853 | 0.119 | 10 | 51 | 151.5 | 12 | 0.000 | 34.8 | 22 | 0.000 |
| 102 | PMON80542 | 0.084 | 9 | 40 | 131.7 | 16 | 0.000 | 28.9 | 18 | 0.000 |
| | PMON80542 | 0.099 | 10 | 40 | 131.7 | −1 | 0.691 | 28.9 | −3 | 0.304 |
| | PMON80542 | 0.112 | 10 | 40 | 131.7 | 18 | 0.000 | 28.9 | 15 | 0.000 |
| | PMON80542 | 0.003 | 12 | 40 | 131.7 | −9 | 0.000 | 28.9 | −12 | 0.000 |
| | PMON80542 | 0.000 | 9 | 40 | 131.7 | −3 | 0.126 | 28.9 | −5 | 0.080 |
| | PMON80542 | 0.204 | 11 | 40 | 131.7 | 20 | 0.000 | 28.9 | 27 | 0.000 |
| | PMON80542 | 0.017 | 10 | 40 | 131.7 | −3 | 0.098 | 28.9 | −3 | 0.276 |
| | PMON80542 | 0.000 | 11 | 40 | 131.7 | −4 | 0.025 | 28.9 | −3 | 0.191 |
| | PMON80542 | 0.000 | 10 | 40 | 131.7 | 8 | 0.000 | 28.9 | 5 | 0.062 |

When selecting for yield improvement a useful statistical measurement approach comprises three components, i.e. modeling spatial autocorrelation of the test field separately for each location, adjusting traits of recombinant DNA events for spatial dependence for each location, and conducting an across location analysis. The first step in modeling spatial autocorrelation is estimating the covariance parameters of the semivariogram. A spherical covariance model is assumed to model the spatial autocorrelation. Because of the size and nature of the trial, it is likely that the spatial autocorrelation may change. Therefore, anisotropy is also assumed along with spherical covariance structure. The following set of equations describes the statistical form of the anisotropic spherical covariance model.

$$C(h;\theta) = \nu I(h=0) + \sigma^2\left(1 - \frac{3}{2}h + \frac{1}{2}h^3\right)I(h<1),$$

where I(•) is the indicator function $$h = \sqrt{\dot{x}^2 + \dot{y}^2},$$

and $$\dot{x} = [\cos(\rho\pi/180)(x_1 - x_2) - \sin(\rho\pi/180)(y_1 - y_2)]/\omega_x$$

$$\dot{y} = [\sin(\rho\pi/180)(x_1 - x_2) + \cos(\rho\pi/180)(y_1 - y_2)]/\omega_y$$

where $s_1=(x_1, y_1)$ are the spatial coordinates of one location and $s_2=(x_2, y_2)$ are the spatial coordinates of the second location. There are 5 covariance parameters, $\theta=(\nu, \sigma^2, \rho, \omega_n, \omega_j)$, where $\nu$ is the nugget effect, $\sigma^2$ is the partial sill, $\rho$ is a rotation in degrees clockwise from north, $\omega_n$ is a scaling parameter for the minor axis and $\omega_j$ is a scaling parameter for the major axis of an anisotropical ellipse of equal covariance. The five covariance parameters that defines the spatial trend will then be estimated by using data from heavily replicated pollinator plots via restricted maximum likelihood approach. In a multi-location field trial, spatial trend are modeled separately for each location.

After obtaining the variance parameters of the model, a variance-covariance structure is generated for the data set to be analyzed. This variance-covariance structure contains spatial information required to adjust yield data for spatial dependence. In this case, a nested model that best represents the treatment and experimental design of the study is used along with the variance-covariance structure to adjust the yield data. During this process the nursery or the seed batch effects can also be modeled and estimated to adjust the yields for any yield parity caused by seed batch differences. After spatially adjusted data from different locations are generated, all adjusted data is combined and analyzed assuming locations as replications. In this analysis, intra and inter-location variances are combined to estimate the standard error of yield from transgenic plants and control plants. Relative mean comparisons are used to indicate statistically significant yield improvements.

TABLE 14

| PEP SEQ ID NO | construct id | Transgenic event | control | Mean Transgenic | Control mean | Percent difference | P-value |
|---|---|---|---|---|---|---|---|
| 105 | pMON75524 | ZM_M47998 | Negative segregant | 173.3 | 176.1 | −1.6 | 0.392 |
| | | ZM_M48003 | Negative segregant | 167.2 | 176.1 | −5.1 | 0.007 |
| | | ZM_M48004 | Negative segregant | 176.2 | 176.1 | 0.0 | 0.990 |
| | | ZM_M48005 | Negative segregant | 186.0 | 176.1 | 5.6 | 0.003 |
| | | ZM_M48007 | Negative segregant | 177.9 | 176.1 | 1.0 | 0.631 |
| | | ZM_M48010 | Negative segregant | 176.8 | 176.1 | 0.4 | 0.841 |
| 88 | pMON68399 | ZM_M31146 | Negative segregant | 179.1 | 179.9 | −0.4 | 0.778 |
| | | ZM_M31147 | Negative segregant | 181.7 | 179.9 | 1.0 | 0.497 |
| | | ZM_M31524 | Negative segregant | 179.3 | 179.9 | −0.3 | 0.829 |
| | | ZM_M32356 | Negative segregant | 181.3 | 179.9 | 0.8 | 0.601 |
| | | ZM_M38646 | Negative segregant | 180.3 | 179.9 | 0.2 | 0.880 |
| | | ZM_M38681 | Negative segregant | 180.2 | 179.9 | 0.2 | 0.894 |
| | | ZM_M39295 | Negative segregant | 176.6 | 179.9 | −1.8 | 0.259 |
| | | ZM_M39297 | Negative segregant | 175.6 | 179.9 | −2.3 | 0.125 |
| | | ZM_M39298 | Negative segregant | 184.6 | 179.9 | 2.7 | 0.082 |
| | | ZM_M39302 | Negative segregant | 182.0 | 179.9 | 1.2 | 0.440 |
| 105 | pMON75524 | ZM_M47998 | Negative segregant | 173.3 | 176.1 | −1.6 | 0.392 |
| | | ZM_M48003 | Negative segregant | 167.2 | 176.1 | −5.1 | 0.007 |
| | | ZM_M48004 | Negative segregant | 176.2 | 176.1 | 0.0 | 0.990 |
| | | ZM_M48005 | Negative segregant | 186.0 | 176.1 | 5.6 | 0.003 |
| | | ZM_M48007 | Negative segregant | 177.9 | 176.1 | 1.0 | 0.631 |
| | | ZM_M48010 | Negative segregant | 176.8 | 176.1 | 0.4 | 0.841 |
| 88 | pMON68399 | ZM_M31146 | Negative segregant | 179.1 | 179.9 | −0.4 | 0.778 |
| | | ZM_M31147 | Negative segregant | 181.7 | 179.9 | 1.0 | 0.497 |
| | | ZM_M31524 | Negative segregant | 179.3 | 179.9 | −0.3 | 0.829 |
| | | ZM_M32356 | Negative segregant | 181.3 | 179.9 | 0.8 | 0.601 |

TABLE 14-continued

| PEP SEQ ID NO | construct id | Transgenic event | control | Mean Transgenic | Control mean | Percent difference | P-value |
|---|---|---|---|---|---|---|---|
| | | ZM_M38646 | Negative segregant | 180.3 | 179.9 | 0.2 | 0.880 |
| | | ZM_M38681 | Negative segregant | 180.2 | 179.9 | 0.2 | 0.894 |
| | | ZM_M39295 | Negative segregant | 176.6 | 179.9 | −1.8 | 0.259 |
| | | ZM_M39297 | Negative segregant | 175.6 | 179.9 | −2.3 | 0.125 |
| | | ZM_M39298 | Negative segregant | 184.6 | 179.9 | 2.7 | 0.082 |
| | | ZM_M39302 | Negative segregant | 182.0 | 179.9 | 1.2 | 0.440 |

TABLE 15

| PEP SEQ ID | Construct | Event | Mean Transgenic | Mean Control | Percent change | P-value |
|---|---|---|---|---|---|---|
| 127 | PMON78911 | ZM_M45101 | 167.9 | 176.1 | −4.7 | 0.015 |
| 127 | PMON78911 | ZM_M59413 | 175.4 | 176.1 | −0.4 | 0.832 |
| 127 | PMON78911 | ZM_M59778 | 161.2 | 176.1 | −8.5 | 0.000 |
| 127 | PMON78911 | ZM_M59783 | 191.0 | 176.1 | 8.4 | 0.000 |
| 127 | PMON78911 | ZM_M59784 | 182.6 | 176.1 | 3.7 | 0.053 |
| 127 | PMON78911 | ZM_M62810 | 180.2 | 176.1 | 2.3 | 0.212 |
| 130 | PMON77895 | ZM_M61016 | 171.5 | 176.1 | −2.6 | 0.163 |
| 139 | PMON77895 | ZM_M61017 | 173.4 | 176.1 | −1.6 | 0.397 |
| 130 | PMON77895 | ZM_M61033 | 184.1 | 176.1 | 4.5 | 0.015 |
| 131 | PMON79152 | ZM_M64367 | 162.9 | 176.1 | −7.5 | 0.000 |
| 131 | PMON79152 | ZM_M65978 | 184.5 | 176.1 | 4.7 | 0.012 |
| 131 | PMON79152 | ZM_M65982 | 175.0 | 176.1 | −0.6 | 0.733 |
| 131 | PMON79152 | ZM_M65986 | 139.7 | 176.1 | −20.7 | 0.000 |
| 131 | PMON79152 | ZM_M65992 | 171.8 | 176.1 | −2.5 | 0.182 |
| 132 | PMON80921 | ZM_M63833 | 184.2 | 176.1 | 4.6 | 0.015 |
| 133 | PMON75505 | ZM_M49384 | 183.6 | 176.1 | 4.2 | 0.023 |
| 134 | PMON80925 | ZM_M60505 | 183.4 | 176.1 | 4.1 | 0.039 |
| 134 | PMON80925 | ZM_M62005 | 179.8 | 176.1 | 2.1 | 0.268 |
| 134 | PMON80925 | ZM_M62007 | 178.5 | 176.1 | 1.3 | 0.489 |
| 134 | PMON80925 | ZM_M63594 | 180.1 | 176.1 | 2.3 | 0.229 |
| 106 | PMON79163 | ZM_M45011 | 177.0 | 176.1 | 0.5 | 0.792 |
| 106 | PMON79163 | ZM_M48217 | 179.8 | 176.1 | 2.1 | 0.289 |
| 106 | PMON79163 | ZM_M61816 | 183.5 | 176.1 | 4.2 | 0.033 |
| 106 | PMON79163 | ZM_M61822 | 168.1 | 176.1 | −4.6 | 0.023 |
| 136 | PMON79164 | ZM_M44045 | 172.1 | 176.1 | −2.3 | 0.217 |
| 136 | PMON79164 | ZM_M59749 | 180.6 | 176.1 | 2.5 | 0.175 |
| 136 | PMON79164 | ZM_M59750 | 181.8 | 176.1 | 3.2 | 0.087 |
| 136 | PMON79164 | ZM_M61349 | 169.5 | 176.1 | −3.8 | 0.042 |
| 136 | PMON79164 | ZM_M61889 | 175.0 | 176.1 | −0.6 | 0.738 |
| 136 | PMON79164 | ZM_M61890 | 145.4 | 176.1 | −17.4 | 0.000 |
| 136 | PMON79164 | ZM_M62988 | 175.7 | 176.1 | −0.3 | 0.881 |
| 136 | PMON79164 | ZM_M63003 | 185.0 | 176.1 | 5.0 | 0.007 |
| 107 | PMON75533 | ZM_M47453 | 183.4 | 176.1 | 4.1 | 0.027 |
| 107 | PMON75533 | ZM_M47460 | 178.4 | 176.1 | 1.3 | 0.491 |
| 107 | PMON75533 | ZM_M49275 | 183.9 | 176.1 | 4.4 | 0.018 |
| 107 | PMON75533 | ZM_M49278 | 177.0 | 176.1 | 0.5 | 0.790 |
| 137 | PMON79653 | ZM_M49883 | 174.6 | 176.1 | −0.9 | 0.633 |
| 137 | PMON79653 | ZM_M65281 | 183.4 | 176.1 | 4.1 | 0.030 |
| 138 | PMON81228 | ZM_M59931 | 169.3 | 176.1 | −3.9 | 0.055 |
| 138 | PMON81228 | ZM_M60825 | 185.8 | 176.1 | 5.5 | 0.003 |
| 148 | PMON82223 | ZM_M70571 | 185.8 | 176.1 | 5.5 | 0.007 |
| 161 | PMON79665 | ZM_M51224 | 171.9 | 176.1 | −2.4 | 0.198 |
| 161 | PMON79665 | ZM_M53787 | 172.2 | 176.1 | −2.2 | 0.233 |
| 161 | PMON79665 | ZM_M55078 | 184.2 | 176.1 | 4.6 | 0.019 |
| 139 | PMON79430 | ZM_M50221 | 181.1 | 176.1 | 2.8 | 0.137 |
| 139 | PMON79430 | ZM_M50222 | 178.6 | 176.1 | 1.4 | 0.477 |
| 139 | PMON79430 | ZM_M50223 | 180.8 | 176.1 | 2.7 | 0.153 |
| 139 | PMON79430 | ZM_M50727 | 177.7 | 176.1 | 0.9 | 0.637 |
| 139 | PMON79430 | ZM_M50729 | 179.0 | 176.1 | 1.6 | 0.377 |
| 139 | PMON79430 | ZM_M51479 | 171.7 | 176.1 | −2.5 | 0.198 |
| 139 | PMON79430 | ZM_M51481 | 185.4 | 176.1 | 5.2 | 0.006 |
| 139 | PMON79430 | ZM_M51490 | 178.5 | 176.1 | 1.3 | 0.492 |
| 140 | PMON79731 | ZM_M52239 | 187.5 | 176.1 | 6.5 | 0.001 |
| 140 | PMON79731 | ZM_M52245 | 172.2 | 176.1 | −2.2 | 0.230 |
| 140 | PMON79731 | ZM_M52252 | 174.6 | 176.1 | −0.9 | 0.638 |
| 140 | PMON79731 | ZM_M52255 | 172.4 | 176.1 | −2.1 | 0.248 |

TABLE 15-continued

| | Construct | Event | Mean Transgenic | Mean Control | Percent change | P-value |
|---|---|---|---|---|---|---|
| 140 | PMON79731 | ZM_M52375 | 173.3 | 176.1 | −1.6 | 0.396 |
| 140 | PMON79731 | ZM_M52802 | 173.6 | 176.1 | −1.5 | 0.447 |
| 140 | PMON79731 | ZM_M52812 | 166.6 | 176.1 | −5.4 | 0.004 |
| 141 | PMON78229 | ZM_M55961 | 176.0 | 176.1 | −0.1 | 0.963 |
| 141 | PMON78229 | ZM_M55962 | 182.3 | 176.1 | 3.5 | 0.065 |
| 141 | PMON78229 | ZM_M55964 | 175.1 | 176.1 | −0.6 | 0.743 |
| 141 | PMON78229 | ZM_M56184 | 187.2 | 176.1 | 6.3 | 0.001 |
| 141 | PMON78229 | ZM_M56185 | 181.8 | 176.1 | 3.2 | 0.083 |
| 141 | PMON78229 | ZM_M59082 | 176.1 | 176.1 | 0.0 | 0.984 |
| SEQ ID NO | | | | | | |
| 116 | PMON79697 | ZM_M53938 | 171.6 | 176.1 | −2.6 | 0.171 |
| 116 | PMON79697 | ZM_M53939 | 180.2 | 176.1 | 2.3 | 0.238 |
| 116 | PMON79697 | ZM_M54371 | 175.0 | 176.1 | −0.6 | 0.733 |
| 116 | PMON79697 | ZM_M54372 | 185.1 | 176.1 | 5.1 | 0.009 |
| 116 | PMON79697 | ZM_M54374 | 181.2 | 176.1 | 2.8 | 0.127 |
| 144 | PMON78240 | ZM_M53464 | 184.1 | 176.1 | 4.5 | 0.015 |
| 144 | PMON78240 | ZM_M53465 | 175.2 | 176.1 | −0.5 | 0.785 |
| 144 | PMON78240 | ZM_M53470 | 174.4 | 176.1 | −1.0 | 0.611 |
| 144 | PMON78240 | ZM_M53471 | 166.7 | 176.1 | −5.4 | 0.005 |
| 144 | PMON78240 | ZM_M53478 | 173.6 | 176.1 | −1.4 | 0.456 |
| 144 | PMON78240 | ZM_M53673 | 175.8 | 176.1 | −0.2 | 0.917 |
| 144 | PMON78240 | ZM_M53674 | 172.5 | 176.1 | −2.1 | 0.269 |
| 144 | PMON78240 | ZM_M53684 | 179.4 | 176.1 | 1.8 | 0.342 |
| 122 | PMON80500 | ZM_M56549 | 173.4 | 176.1 | −1.6 | 0.408 |
| 122 | PMON80500 | ZM_M56560 | 173.4 | 176.1 | −1.6 | 0.394 |
| 122 | PMON80500 | ZM_M56565 | 175.4 | 176.1 | −0.4 | 0.811 |
| 122 | PMON80500 | ZM_M56567 | 177.9 | 176.1 | 1.0 | 0.599 |
| 122 | PMON80500 | ZM_M56568 | 185.9 | 176.1 | 5.6 | 0.003 |
| 122 | PMON80500 | ZM_M58003 | 169.4 | 176.1 | −3.8 | 0.047 |
| 145 | PMON80283 | ZM_M58140 | 174.6 | 176.1 | −0.9 | 0.641 |
| 145 | PMON80283 | ZM_M58141 | 179.7 | 176.1 | 2.0 | 0.294 |
| 145 | PMON80283 | ZM_M58143 | 183.8 | 176.1 | 4.4 | 0.024 |
| 146 | PMON80866 | ZM_M58256 | 177.6 | 176.1 | 0.8 | 0.651 |
| 146 | PMON80866 | ZM_M59441 | 183.3 | 176.1 | 4.1 | 0.028 |
| 146 | PMON80866 | ZM_M60646 | 174.8 | 176.1 | −0.7 | 0.692 |
| 147 | PMON80292 | ZM_M57487 | 180.8 | 176.1 | 2.6 | 0.159 |
| 147 | PMON80292 | ZM_M58571 | 184.2 | 176.1 | 4.6 | 0.021 |
| 147 | PMON80292 | ZM_M58578 | 177.5 | 176.1 | 0.8 | 0.717 |
| 142 | PMON79696 | ZM_M53849 | 177.6 | 179.1 | −1.2 | 0.431 |
| 142 | PMON79696 | ZM_M53849 | 190.3 | 179.1 | 5.8 | 0.0003 |
| 142 | PMON79696 | ZM_M53849 | 178.5 | 179.1 | −0.7 | 0.0635 |
| 150 | PMON81857 | ZM_M67504 | 178.8 | 176.1 | 1.5 | 0.415 |
| 150 | PMON81857 | ZM_M70000 | 182.7 | 176.1 | 3.7 | 0.047 |
| 150 | PMON81857 | ZM_M71064 | 172.1 | 176.1 | −2.3 | 0.229 |
| 150 | PMON81857 | ZM_M71065 | 184.6 | 176.1 | 4.8 | 0.011 |
| 150 | PMON81857 | ZM_M72550 | 174.3 | 176.1 | −1.0 | 0.589 |
| 149 | PMON83553 | ZM_M71131 | 150.7 | 176.1 | −14.5 | 0.000 |
| 149 | PMON83553 | ZM_M71140 | 187.4 | 176.1 | 6.4 | 0.001 |
| 149 | PMON83553 | ZM_M71156 | 150.3 | 176.1 | −14.7 | 0.000 |
| 149 | PMON83553 | ZM_M71161 | 172.7 | 176.1 | −1.9 | 0.298 |
| 150 | PMON81857 | ZM_M67504 | 178.8 | 176.1 | 1.5 | 0.415 |
| 150 | PMON81857 | ZM_M70000 | 182.7 | 176.1 | 3.7 | 0.047 |
| 150 | PMON81857 | ZM_M71064 | 172.1 | 176.1 | −2.3 | 0.229 |
| 150 | PMON81857 | ZM_M71065 | 184.6 | 176.1 | 4.8 | 0.011 |
| 150 | PMON81857 | ZM_M72550 | 174.3 | 176.1 | −1.0 | 0.589 |
| 151 | PMON82212 | ZM_M67581 | 171.1 | 176.1 | −2.8 | 0.126 |
| 151 | PMON82212 | ZM_M67583 | 186.1 | 176.1 | 5.6 | 0.002 |
| 151 | PMON82212 | ZM_M69111 | 173.2 | 176.1 | −1.7 | 0.368 |
| PEP SEQ ID NO | | | | | | |
| 108 | PMON79709 | ZM_M51983 | 184.3 | 176.1 | 4.7 | 0.037 |
| 108 | PMON79709 | ZM_M51985 | 180.1 | 176.1 | 2.3 | 0.231 |
| 108 | PMON79709 | ZM_M52052 | 185.6 | 176.1 | 5.3 | 0.013 |
| 108 | PMON79709 | ZM_M52710 | 175.5 | 176.1 | −0.4 | 0.862 |
| 108 | PMON79709 | ZM_M52720 | 175.2 | 176.1 | −0.6 | 0.765 |
| 129 | PMON73787 | ZM_M55089 | 162.6 | 176.1 | −7.7 | 0.000 |
| 129 | PMON73787 | ZM_M61950 | 186.4 | 176.1 | 5.8 | 0.002 |
| 129 | PMON73787 | ZM_M61953 | 164.7 | 176.1 | −6.5 | 0.001 |
| 129 | PMON73787 | ZM_M61958 | 165.9 | 176.1 | −5.8 | 0.003 |
| 129 | PMON73787 | ZM_M61965 | 134.3 | 176.1 | −23.8 | 0.000 |
| 129 | PMON73787 | ZM_M61966 | 172.6 | 176.1 | −2.0 | 0.280 |
| 135 | PMON78942 | ZM_M66312 | 176.2 | 176.1 | 0.0 | 0.997 |
| 135 | PMON78942 | ZM_M66316 | 173.1 | 176.1 | −1.7 | 0.362 |
| 135 | PMON78942 | ZM_M66318 | 164.1 | 176.1 | −6.9 | 0.000 |
| 135 | PMON78942 | ZM_M66331 | 183.3 | 176.1 | 4.1 | 0.029 |

C. Selection for Enhanced Water Use Efficiency (WUE)

Described in this example is a high-throughput method for greenhouse selection of transgenic corn plants to wild type corn plants (tested as inbreds or hybrids) for water use efficiency. This selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment. The hydration status of the shoot tissues following the drought is also measured. The plant height are measured at three time points. The first is taken just prior to the onset drought when the plant is 11 days old, which is the shoot initial height (SIH). The plant height is also measured halfway throughout the drought/re-water regimen, on day 18 after planting, to give rise to the shoot mid-drought height (SMH). Upon the completion of the final drought cycle on day 26 after planting, the shoot portion of the plant is harvested and measured for a final height, which is the shoot wilt height (SWH) and also measured for shoot wilted biomass (SWM). The shoot is placed in water at 40 degree Celsius in the dark. Three days later, the shoot is weighted to give rise to the shoot turgid weight (STM). After drying in an oven for four days, the shoots are weighted for shoot dry biomass (SDM). The shoot average height (SAH) is the mean plant height across the 3 height measurements. The procedure described above may be adjusted for +/−~one day for each step given the situation.

To correct for slight differences between plants, a size corrected growth value is derived from SIH and SWH. This is the Relative Growth Rate (RGR). Relative Growth Rate (RGR) is calculated for each shoot using the formula [RGR %=(SWH−SIH)/((SWH+SIH)/2)*100]. Relative water content (RWC) is a measurement of how much (%) of the plant was water at harvest. Water Content (RWC) is calculated for each shoot using the formula [RWC %=(SWM−SDM)/(STM−SDM)*100]. Fully watered corn plants of this age run around 98% RWC.

The transgenic plants provided by this invention were selected through the selection process according to the standard procedure described above and the performance of these transgenic plants are shown in Table 16 below.

TABLE 16

| PEP SEQ ID NO | Construct | N Event | Perc, SAH | Pvalue, SAH | Perc, RGR | Pvalue, RGR | Perc, SDM | Pvalue, SDM | Perc, RWC | Pvalue, RWC |
|---|---|---|---|---|---|---|---|---|---|---|
| 88 | PMON68399 | 18 | −2.9129 | 0 | 4.6104 | 0 | −1.2282 | 0.0534 | 2.0799 | 0 |
| 87 | PMON72494 | 2 | −2.6854 | 0 | 3.3347 | 0.0034 | −3.178 | 0.0258 | 2.8177 | 0.0001 |
| | PMON72494 | 2 | −1.4189 | 0 | 4.5389 | 0 | 1.0503 | 0.2808 | 1.8075 | 0.0272 |
| | PMON72494 | 6 | −2.8912 | 0 | 5.0217 | 0 | −3.0056 | 0.0032 | 3.0684 | 0 |
| | PMON72494 | 1 | −3.2736 | 0 | 1.4026 | 0.2741 | 0.0968 | 0.9545 | −2.3654 | 0.0194 |
| 97 | PMON76342 | 1 | −3.6096 | 0.0003 | 8.9657 | 0 | −2.9332 | 0.2317 | 2.1037 | 0.1252 |
| | PMON76342 | 2 | −0.9997 | 0.0384 | 4.9006 | 0 | −1.7424 | 0.1472 | −0.8155 | 0.2552 |
| 117 | PMON78237 | 4 | −2.0513 | 0 | 2.1335 | 0.0011 | 3.2477 | 0.0002 | 0.5998 | 0.2456 |
| 104 | PMON78936 | 2 | 0.2781 | 0.3727 | 1.3631 | 0.0165 | 2.1849 | 0.023 | 1.4237 | 0.0744 |
| | PMON78936 | 4 | −2.3342 | 0 | 6.1784 | 0 | −2.5964 | 0.0336 | 2.5358 | 0.0003 |
| 103 | PMON78949 | 4 | −1.6398 | 0 | 4.5323 | 0 | 2.2077 | 0.0112 | 0.9068 | 0.08 |
| 109 | PMON79422 | 4 | −2.0016 | 0 | 2.8698 | 0 | −1.3511 | 0.0488 | 1.8883 | 0.0009 |
| 116 | PMON79697 | 2 | −1.0829 | 0.1252 | 2.9806 | 0.0225 | −0.0495 | 0.9771 | 0.0115 | 0.9907 |
| | PMON79697 | 3 | −1.5704 | 0 | 2.1663 | 0 | −0.4949 | 0.5582 | 1.7787 | 0.0073 |
| 120 | PMON80452 | 1 | −1.7626 | 0.0032 | 2.1476 | 0.2778 | 2.1702 | 0.3832 | −1.914 | 0.1164 |
| | PMON80452 | 8 | −0.2756 | 0.0645 | −1.0206 | 0.0002 | 0.4707 | 0.3101 | −0.072 | 0.8521 |
| | PMON80452 | 11 | −0.7077 | 0.0258 | 2.1403 | 0.0003 | 1.4477 | 0.0623 | −0.0405 | 0.9267 |
| 115 | PMON80489 | 6 | −0.895 | 0.0001 | 3.7262 | 0 | −1.5941 | 0.0442 | 1.4212 | 0.0038 |
| 102 | PMON80542 | 8 | −2.5925 | 0 | 1.1234 | 0.0254 | 2.1829 | 0.0013 | 3.2415 | 0 |
| | PMON80542 | 1 | −5.5931 | 0 | 2.5902 | 0.0486 | −2.1444 | 0.2158 | 9.5238 | 0 |

Transgenic plants transformed with pMON67754 comprising the recombinant DNA as set forth in SEQ ID NO: 3 were tested in field with moderate drought conditions in Satanta, Ill. and Dixon Calif. SPAD readings on leaves under a moderate drought stress showed a significant increase in chlorophyll level in the transgenic plants as compared to the control plants. Two events showed a significant increase in SPAD reading for chlorophyll level, indicating an improvement in drought tolerance. In replicated field trials, 2 events (ZM_M16396 and ZM_M16401) out of 6 tested, showed significantly ($p<0.1$) improved leaf SPAD readings in two different locations, indicating an improvement in drought tolerance.

D. Selection for Growth Under Cold Stress (1) Cold germination assay—Three sets of seeds are used for the assay. The first set consists of positive transgenic events (F1 hybrid) where the genes of the present invention are expressed in the seed. The second seed set is nontransgenic, wild-type negative control made from the same genotype as the transgenic events. The third set consisted of two cold tolerant and one cold sensitive commercial check lines of corn. All seeds are treated with a fungicide "Captan" (MAESTRO® 80DF Fungicide, Arvesta Corporation, San Francisco, Calif., USA). 0.43 mL Captan is applied per 45 g of corn seeds by mixing it well and drying the fungicide prior to the experiment.

Corn kernels are placed embryo side down on blotter paper within an individual cell (8.9×8.9 cm) of a germination tray (54×36 cm). Ten seeds from an event are placed into one cell of the germination tray. Each tray can hold 21 transgenic events and 3 replicates of wildtype (LH244SDms+LH59), which is randomized in a complete block design. For every event there are five replications (five trays). The trays are placed at 9.7 C for 24 days (no light) in a Convrion growth chamber (Conviron Model PGV36, Controlled Environments, Winnipeg, Canada). Two hundred and fifty millilters of deionized water are added to each germination tray. Germination counts are taken 10th, 11th, 12th, 13th, 14th, 17th, 19th, 21st, and 24th day after start date of the experiment. Seeds are considered germinated if the emerged radicle size is 1 cm. From the germination counts germination index is calculated.

The germination index is calculated as per:

$$\text{Germination index}=(\Sigma([T+1+-n_i]*[P_i-P_{i-1}]))/T$$

Where T is the total number of days for which the germination assay is performed. The number of days after planting is defined by n. "i" indicated the number of times the germination had been counted, including the current day. P is the percentage of seeds germinated during any given rating. Statistical differences are calculated between transgenic events and wild type control. After statistical analysis, the events that show a statistical significance at the p level of less than 0.1 relative to wild-type controls will advance to a secondary cold selection. The secondary cold screen is conducted in the same manner of the primary selection only increasing the number of repetitions to ten. Statistical analysis of the data from the secondary selection is conducted to identify the events that show a statistical significance at the p level of less than 0.05 relative to wild-type controls.

TABLE 17

| | | | Germination index | | | |
|---|---|---|---|---|---|---|
| PEP SEQ ID | Construct ID | Event ID | Percent change | Mean | Mean of controls | P-value |
| 85 | PMON69456 | ZM_M15392 | −27 | 23.4 | 32.07 | 0.0718 |
| | PMON69456 | ZM_M15392 | 12 | 47.88 | 42.93 | 9.00E−04 |
| | PMON69456 | ZM_M15392 | 13 | 48 | 42.44 | 0.0756 |
| | PMON69456 | ZM_M17042 | −9 | 29.2 | 32.07 | 0.4 |
| | PMON69456 | ZM_M17042 | 17 | 49.5 | 42.44 | 0.0248 |
| | PMON69456 | ZM_M17042 | 16 | 49.89 | 42.93 | 0 |
| | PMON69456 | ZM_M17042 | −6 | 28.14 | 30.07 | 0.6526 |
| | PMON69456 | ZM_M17044 | −38 | 19.25 | 30.88 | 0.019 |
| | PMON69456 | ZM_M17044 | 9 | 46.17 | 42.44 | 0.2317 |
| | PMON69456 | ZM_M17044 | 7 | 46.88 | 43.86 | 0.0297 |
| | PMON69456 | ZM_M17044 | 14 | 34.14 | 30.07 | 0.3445 |
| 107 | PMON75533 | ZM_M47453 | 3 | 46.88 | 45.38 | 0.3782 |
| | PMON75533 | ZM_M47453 | 25 | 49.75 | 39.69 | 0.002 |
| | PMON75533 | ZM_M47460 | 23 | 48.83 | 39.69 | 0.0047 |
| | PMON75533 | ZM_M47460 | 3 | 46.88 | 45.38 | 0.3782 |
| | PMON75533 | ZM_M49275 | 14 | 45.08 | 39.69 | 0.0914 |
| | PMON75533 | ZM_M49275 | 11 | 50.46 | 45.38 | 0.0031 |
| | PMON75533 | ZM_M49278 | 15 | 45.83 | 39.69 | 0.055 |
| | PMON75533 | ZM_M49278 | 14 | 51.75 | 45.38 | 2.00E−04 |
| 119 | PMON78235 | ZM_M53641 | 16 | 48.25 | 41.72 | 4.00E−04 |
| | PMON78235 | ZM_M53641 | 23 | 45 | 36.5 | 0.0508 |
| | PMON78235 | ZM_M53641 | 1 | 48.42 | 48.08 | 0.9116 |
| | PMON78235 | ZM_M53641 | 5 | 42.17 | 40.24 | 0.5629 |
| | PMON78235 | ZM_M53994 | 26 | 46 | 36.5 | 0.0294 |
| | PMON78235 | ZM_M53994 | 15 | 47.92 | 41.72 | 7.00E−04 |
| | PMON78235 | ZM_M53994 | 1 | 48.67 | 48.08 | 0.8459 |
| | PMON78235 | ZM_M53994 | −4 | 38.58 | 40.24 | 0.6196 |
| | PMON78235 | ZM_M53997 | 16 | 48.21 | 41.72 | 4.00E−04 |
| | PMON78235 | ZM_M53997 | 15 | 42 | 36.5 | 0.2036 |
| 104 | PMON78936 | ZM_M45248 | 25 | 48.25 | 38.69 | 0.0221 |
| | PMON78936 | ZM_M45248 | 14 | 48.29 | 42.21 | 0.0013 |
| | PMON78936 | ZM_M45274 | 15 | 48.33 | 42.21 | 0.0012 |
| | PMON78936 | ZM_M45274 | 24 | 48.08 | 38.69 | 0.0245 |
| | PMON78936 | ZM_M45275 | 5 | 40.5 | 38.69 | 0.6613 |
| | PMON78936 | ZM_M46485 | 11 | 42.92 | 38.69 | 0.3066 |
| | PMON78936 | ZM_M46516 | −1 | 38.33 | 38.69 | 0.9301 |
| | PMON78936 | ZM_M46516 | −4 | 40.38 | 42.21 | 0.3274 |
| | PMON78936 | ZM_M47276 | 11 | 43.08 | 38.69 | 0.288 |
| 110 | PMON79425 | ZM_M50823 | 4 | 42.79 | 41.31 | 0.3848 |
| | PMON79425 | ZM_M50823 | 18 | 42.83 | 36.25 | 0.0378 |
| | PMON79425 | ZM_M50856 | 4 | 42.88 | 41.31 | 0.3589 |
| | PMON79425 | ZM_M50856 | 13 | 40.83 | 36.25 | 0.1462 |
| | PMON79425 | ZM_M51300 | 7 | 44.25 | 41.31 | 0.087 |
| | PMON79425 | ZM_M51300 | −3 | 35.16 | 36.25 | 0.7282 |
| | PMON79425 | ZM_M51302 | 23 | 44.54 | 36.25 | 0.0093 |
| | PMON79425 | ZM_M51302 | 17 | 48.17 | 41.31 | 1.00E−04 |
| | PMON79425 | ZM_M51313 | 12 | 46.33 | 41.31 | 0.004 |
| | PMON79425 | ZM_M51313 | 23 | 44.7 | 36.25 | 0.008 |
| | PMON79425 | ZM_M51608 | 24 | 45.08 | 36.25 | 0.0057 |
| | PMON79425 | ZM_M51608 | 11 | 45.88 | 41.31 | 0.0086 |
| | PMON79425 | ZM_M51623 | 21 | 43.7 | 36.25 | 0.0189 |
| | PMON79425 | ZM_M51623 | 14 | 47.21 | 41.31 | 8.00E−04 |
| | PMON79425 | ZM_M52067 | −5 | 39.13 | 41.31 | 0.2033 |
| | PMON79425 | ZM_M52067 | 8 | 39.08 | 36.25 | 0.368 |
| 116 | PMON79697 | ZM_M53938 | 7 | 47.04 | 43.93 | 0.0587 |
| | PMON79697 | ZM_M53938 | 5 | 42 | 40.17 | 0.6198 |
| | PMON79697 | ZM_M53939 | 18 | 47.25 | 40.17 | 0.0575 |
| | PMON79697 | ZM_M53939 | 11 | 48.58 | 43.93 | 0.0049 |
| | PMON79697 | ZM_M54371 | 11 | 48.88 | 43.93 | 0.0028 |
| | PMON79697 | ZM_M54371 | 15 | 46.25 | 40.17 | 0.1019 |
| | PMON79697 | ZM_M54372 | 1 | 40.75 | 40.17 | 0.8745 |
| | PMON79697 | ZM_M54374 | 12 | 49.21 | 43.93 | 0.0022 |
| | PMON79697 | ZM_M54374 | 18 | 47.25 | 40.17 | 0.0575 |

TABLE 17-continued

| PEP SEQ ID | Construct ID | Event ID | Germination index Percent change | Mean | Mean of controls | P-value |
|---|---|---|---|---|---|---|
| 111 | PMON79718 | ZM_M50838 | 6 | 45.25 | 42.78 | 0.331 |
| | PMON79718 | ZM_M51591 | −3 | 42.67 | 43.93 | 0.4409 |
| | PMON79718 | ZM_M51591 | −18 | 35.08 | 42.78 | 0.0031 |
| | PMON79718 | ZM_M51592 | −3 | 41.42 | 42.78 | 0.5919 |
| | PMON79718 | ZM_M51594 | 6 | 46.46 | 43.93 | 0.1241 |
| | PMON79718 | ZM_M51594 | 13 | 48.15 | 42.78 | 0.0545 |
| | PMON79718 | ZM_M51598 | 11 | 48.96 | 43.93 | 0.0024 |
| | PMON79718 | ZM_M51598 | 11 | 47.58 | 42.78 | 0.0606 |
| | PMON79718 | ZM_M51615 | 6 | 46.46 | 43.93 | 0.1241 |
| | PMON79718 | ZM_M51615 | 11 | 47.33 | 42.78 | 0.075 |
| | PMON79718 | ZM_M51618 | 2 | 43.5 | 42.78 | 0.7759 |
| | PMON79718 | ZM_M52797 | −6 | 40.17 | 42.78 | 0.3047 |
| | PMON79718 | ZM_M52937 | 16 | 49.67 | 42.78 | 0.0077 |
| | PMON79718 | ZM_M52937 | 12 | 49.04 | 43.93 | 0.0021 |
| 96 | PMON80270 | ZM_M55967 | 10.19 | 50.63 | 45.94 | 6.00E−04 |
| | PMON80270 | ZM_M55968 | 7.38 | 49.33 | 45.94 | 0.0129 |
| | PMON80270 | ZM_M55969 | 3.27 | 47.44 | 45.94 | 0.2678 |
| | PMON80270 | ZM_M55970 | 10.56 | 50.79 | 45.94 | 4.00E−04 |
| | PMON80270 | ZM_M55971 | 7.38 | 49.33 | 45.94 | 0.0129 |
| | PMON80270 | ZM_M55972 | 2.66 | 47.17 | 45.94 | 0.3663 |
| | PMON80270 | ZM_M56524 | 3.81 | 47.7 | 45.94 | 0.1952 |
| | PMON80270 | ZM_M56526 | −7.6 | 42.46 | 45.94 | 0.0105 |
| | PMON80270 | ZM_M56527 | −19.87 | 36.82 | 45.94 | 0 |
| 120 | PMON80452 | ZM_M53452 | 13 | 41.83 | 37.08 | 0.1902 |
| | PMON80452 | ZM_M53452 | 19 | 49.63 | 41.56 | 0 |
| | PMON80452 | ZM_M53452 | 7 | 51.42 | 48.08 | 0.2683 |
| | PMON80452 | ZM_M53452 | 0 | 40.25 | 40.24 | 0.9971 |
| | PMON80452 | ZM_M53455 | −3 | 36 | 37.08 | 0.7642 |
| | PMON80452 | ZM_M53455 | 17 | 48.67 | 41.56 | 0 |
| | PMON80452 | ZM_M53455 | −9 | 43.67 | 48.08 | 0.1434 |
| | PMON80452 | ZM_M53455 | −1 | 39.92 | 40.24 | 0.9231 |
| | PMON80452 | ZM_M53456 | 18 | 49.17 | 41.56 | 0 |
| | PMON80452 | ZM_M53456 | 18 | 43.83 | 37.08 | 0.0639 |
| | PMON80452 | ZM_M53469 | 14 | 47.54 | 41.56 | 1.00E−04 |
| | PMON80452 | ZM_M53469 | 18 | 43.75 | 37.08 | 0.0672 |
| | PMON80452 | ZM_M53694 | 14 | 42.42 | 37.08 | 0.1418 |
| | PMON80452 | ZM_M53694 | 13 | 46.92 | 41.56 | 4.00E−04 |
| | PMON80452 | ZM_M53695 | 21 | 50.08 | 41.56 | 0 |
| | PMON80452 | ZM_M53695 | 22 | 45.25 | 37.08 | 0.0256 |
| | PMON80452 | ZM_M53696 | 21 | 50.42 | 41.56 | 0 |
| | PMON80452 | ZM_M53696 | 31 | 48.5 | 37.08 | 0.002 |
| | PMON80452 | ZM_M54104 | 13 | 41.75 | 37.08 | 0.198 |
| | PMON80452 | ZM_M54104 | 13 | 47.17 | 41.56 | 2.00E−04 |
| | PMON80452 | ZM_M54106 | 8 | 39.92 | 37.08 | 0.4332 |
| | PMON80452 | ZM_M54106 | 12 | 46.38 | 41.56 | 0.0015 |
| 118 | PMON80461 | ZM_M52932 | 17 | 48.67 | 41.56 | 0 |
| | PMON80461 | ZM_M52932 | 32 | 48.17 | 36.5 | 0.0079 |
| | PMON80461 | ZM_M52932 | −8 | 43.25 | 46.86 | 0.1944 |
| | PMON80461 | ZM_M52932 | 9 | 43.92 | 40.24 | 0.271 |
| | PMON80461 | ZM_M53218 | 16 | 42.42 | 36.5 | 0.1717 |
| | PMON80461 | ZM_M53218 | 7 | 44.58 | 41.56 | 0.0448 |
| | PMON80461 | ZM_M53218 | −6 | 44.08 | 46.86 | 0.3172 |
| | PMON80461 | ZM_M53218 | 4 | 41.92 | 40.24 | 0.6145 |
| | PMON80461 | ZM_M53235 | 22 | 50.71 | 41.56 | 0 |
| | PMON80461 | ZM_M53235 | 24 | 45.25 | 36.5 | 0.0445 |
| | PMON80461 | ZM_M53503 | 13 | 46.79 | 41.56 | 6.00E−04 |
| | PMON80461 | ZM_M53503 | 28 | 46.83 | 36.5 | 0.0181 |
| | PMON80461 | ZM_M53504 | 12 | 41 | 36.5 | 0.2975 |
| | PMON80461 | ZM_M53504 | 14 | 47.5 | 41.56 | 1.00E−04 |
| | PMON80461 | ZM_M53848 | 24 | 51.57 | 41.56 | 0 |
| | PMON80461 | ZM_M53848 | 15 | 41.92 | 36.5 | 0.2104 |
| | PMON80461 | ZM_M54282 | 22 | 50.75 | 41.56 | 0 |
| | PMON80461 | ZM_M54282 | 29 | 47 | 36.5 | 0.0164 |
| | PMON80461 | ZM_M54284 | 21 | 44.33 | 36.5 | 0.0714 |
| | PMON80461 | ZM_M54284 | 22 | 50.71 | 41.56 | 0 |
| | PMON80461 | ZM_M55266 | 7 | 50.22 | 46.86 | 0.2268 |
| | PMON80461 | ZM_M55957 | 10 | 51.53 | 46.86 | 0.0945 |
| | PMON80461 | ZM_M56233 | 9 | 51.18 | 46.86 | 0.1217 |
| | PMON80461 | ZM_M56728 | 2 | 47.92 | 46.86 | 0.7033 |

TABLE 17-continued

| PEP SEQ ID | Construct ID | Event ID | Germination index Percent change | Mean | Mean of controls | P-value |
|---|---|---|---|---|---|---|
| 122 | PMON80500 | ZM_M56549 | −0.52 | 45.71 | 45.94 | 0.8613 |
| | PMON80500 | ZM_M56560 | 8.29 | 49.75 | 45.94 | 0.0053 |
| | PMON80500 | ZM_M56565 | 2.2 | 46.96 | 45.94 | 0.4535 |
| | PMON80500 | ZM_M56567 | 9.19 | 50.17 | 45.94 | 0.002 |
| | PMON80500 | ZM_M56568 | 10.82 | 50.92 | 45.94 | 3.00E−04 |
| | PMON80500 | ZM_M58003 | 4.2 | 47.88 | 45.94 | 0.1542 |

(2) Cold Shock assay—The experimental set-up for the cold shock assay was the same as described in the above cold germination assay except seeds were grown in potted media for the cold shock assay.

The desired numbers of 2.5" square plastic pots were placed on flats (n=32, 4×8). Pots were filled with Metro Mix 200 soil-less media containing 19:6:12 fertilizer (6 lbs/cubic yard) (Metro Mix, Pots and Flat are obtained from Hummert International, Earth City, Mo.). After planting seeds, pots were placed in a growth chamber set at 23° C., relative humidity of 65% with 12 hour day and night photoperiod (300 uE/m2-min). Planted seeds were watered for 20 minute every other day by sub-irrigation and flats were rotated every third day in a growth chamber for growing corn seedlings.

On the 10$^{th}$ day after planting the transgenic positive and wild-type negative (WT) plants were positioned in flats in an alternating pattern. Chlorophyll fluorescence of plants was measured on the 10$^{th}$ day during the dark period of growth by using a PAM-2000 portable fluorometer as per the manufacturer's instructions (Walz, Germany). After chlorophyll measurements, leaf samples from each event were collected for confirming the expression of genes of the present invention. For expression analysis six V1 leaf tips from each selection were randomly harvested. The flats were moved to a growth chamber set at 5° C. All other conditions such as humidity, day/night cycle and light intensity were held constant in the growth chamber. The flats were sub-irrigated every day after transfer to the cold temperature. On the 4$^{th}$ day chlorophyll fluorescence was measured. Plants were transferred to normal growth conditions after six days of cold shock treatment and allowed to recover for the next three days. During this recovery period the length of the V3 leaf was measured on the 1$^{st}$ and 3$^{rd}$ days. After two days of recovery V2 leaf damage was determined visually by estimating percent of green V2 leaf.

Statistical differences in V3 leaf growth, V2 leaf necrosis and fluorescence during pre-shock and cold shock can be used for estimation of cold shock damage on corn plants.

(3) Early seedling growth assay—Three sets of seeds were used for the experiment. The first set consists of positive transgenic events (F1 hybrid) where the genes of the present invention were expressed in the seed. The second seed set was nontransgenic, wild-type negative control made from the same genotype as the transgenic events. The third seed set consisted of two cold tolerant and two cold sensitive commercial check lines of corn. All seeds were treated with a fungicide "Captan", (3a,4,7,a-tetrahydro-2-[(trichloromethly)thio]-1H-isoindole-1,3(2H)-dione, Drex Chemical Co. Memphis, Tenn.). Captan (0.43 mL) was applied per 45 g of corn seeds by mixing it well and drying the fungicide prior to the experiment.

Seeds were grown in germination paper for the early seedling growth assay. Three 12"×18" pieces of germination paper (Anchor Paper #SD7606) were used for each entry in the test (three repetitions per transgenic event). The papers were wetted in a solution of 0.5% $KNO_3$ and 0.1% Thyram.

For each paper fifteen seeds were placed on the line evenly spaced down the length of the paper. The fifteen seeds were positioned on the paper such that the radical would grow downward, for example longer distance to the paper's edge. The wet paper was rolled up starting from one of the short ends. The paper was rolled evenly and tight enough to hold the seeds in place. The roll was secured into place with two large paper clips, one at the top and one at the bottom. The rolls were incubated in a growth chamber at 23° C. for three days in a randomized complete block design within an appropriate container. The chamber was set for 65% humidity with no light cycle. For the cold stress treatment the rolls were then incubated in a growth chamber at 12° C. for twelve days. The chamber was set for 65% humidity with no light cycle.

After the cold treatment the germination papers were unrolled and the seeds that did not germinate were discarded. The lengths of the radicle and coleoptile for each seed were measured through an automated imaging program that automatically collects and processes the images. The imaging program automatically measures the shoot length, root length, and whole seedling length of every individual seedling and then calculates the average of each roll.

After statistical analysis, the events that show a statistical significance at the p level of less than 0.1 relative to wild-type controls will advance to a secondary cold selection. The secondary cold selection is conducted in the same manner of the primary selection only increasing the number of repetitions to five. Statistical analysis of the data from the secondary selection is conducted to identify the events that show a statistical significance at the p level of less than 0.05 relative to wild-type controls.

TABLE 18

| | | | Root length | | | | Shoot length | | | | Seedlling length | | | |
|---|---|---|---|---|---|---|---|---|---|---|---|---|---|---|
| PEP SEQ ID | Construct ID | Event ID | Percent change | Mean | Mean of controls | P-value | Percent change | Mean | Mean of controls | P-value | Percent change | Mean | Mean of controls | P-value |
| 88 | PMON68399 | ZM_M31143 | −4 | 9.5 | 9.85 | 0.5479 | −1 | 7.94 | 6.04 | 0.7666 | −3 | 17.45 | 17.9 | 0.6024 |
| | PMON68399 | ZM_M31143 | 7 | 11.15 | 10.41 | 0.1158 | 8 | 9.42 | 8.69 | 0.0536 | 8 | 20.57 | 19.1 | 0.0607 |
| | PMON68399 | ZM_M31146 | 11 | 11.52 | 10.41 | 0.0186 | 0 | 8.67 | 8.69 | 0.9668 | 6 | 20.2 | 19.1 | 0.1593 |
| | PMON68399 | ZM_M31146 | 14 | 9.9 | 8.66 | 0.011 | 6 | 7.37 | 6.99 | 0.2969 | 10 | 17.27 | 15.65 | 0.0396 |
| | PMON68399 | ZM_M31147 | 13 | 11.75 | 10.41 | 0.0051 | 12 | 9.69 | 8.69 | 0.0088 | 12 | 21.43 | 19.1 | 0.0034 |
| | PMON68399 | ZM_M31147 | 14 | 11.25 | 9.85 | 0.0185 | 4 | 8.33 | 8.04 | 0.3961 | 9 | 19.58 | 17.9 | 0.0513 |
| | PMON68399 | ZM_M31152 | −20 | 8.4 | 10.45 | 2.00E−04 | −7 | 7.44 | 7.96 | 0.3265 | −14 | 15.84 | 18.41 | 0.0087 |
| | PMON68399 | ZM_M31152 | 1 | 10.48 | 10.41 | 0.8793 | 6 | 9.17 | 8.69 | 0.1965 | 3 | 19.66 | 19.1 | 0.4697 |
| | PMON68399 | ZM_M31524 | 15 | 12.01 | 10.41 | 9.00E−04 | 10 | 9.54 | 8.69 | 0.0242 | 13 | 21.55 | 19.1 | 0.0021 |
| | PMON68399 | ZM_M31524 | 12 | 11.08 | 9.85 | 0.0385 | 8 | 8.69 | 8.04 | 0.0569 | 11 | 19.77 | 17.9 | 0.0306 |
| | PMON68399 | ZM_M32356 | 12 | 10.99 | 9.85 | 0.0533 | −1 | 7.99 | 8.04 | 0.8731 | 6 | 18.98 | 17.9 | 0.2052 |
| | PMON68399 | ZM_M32356 | 12 | 11.7 | 10.41 | 0.0068 | 7 | 9.32 | 8.69 | 0.096 | 10 | 21.01 | 19.1 | 0.0153 |
| | PMON68399 | ZM_M34171 | −24 | 8.6 | 11.39 | 4.00E−04 | −13 | 7.35 | 8.48 | 0.0331 | −20 | 15.95 | 19.87 | 0.0016 |
| | PMON68399 | ZM_M34171 | 13 | 11.72 | 10.41 | 0.006 | 6 | 9.23 | 8.69 | 0.1486 | 10 | 20.95 | 19.1 | 0.0187 |
| | PMON68399 | ZM_M38646 | 10 | 12.63 | 11.52 | 0.032 | 3 | 10.38 | 10.05 | 0.4864 | 7 | 23.01 | 21.57 | 0.106 |
| | PMON68399 | ZM_M38660 | 10 | 12.68 | 11.52 | 0.0249 | 3 | 10.37 | 10.05 | 0.4953 | 7 | 23.06 | 21.57 | 0.0947 |
| | PMON68399 | ZM_M38681 | 6 | 12.2 | 11.52 | 0.1829 | 3 | 10.31 | 10.05 | 0.5738 | 4 | 22.52 | 21.57 | 0.2835 |
| | PMON68399 | ZM_M38697 | 7 | 12.35 | 11.52 | 0.1053 | 0 | 10.03 | 10.05 | 0.9751 | 4 | 22.38 | 21.57 | 0.3563 |
| | PMON68399 | ZM_M39295 | 11 | 12.84 | 11.52 | 0.0115 | 11 | 11.12 | 10.05 | 0.0264 | 11 | 23.97 | 21.57 | 0.0084 |
| | PMON68399 | ZM_M39297 | 20 | 13.84 | 11.52 | 0 | 7 | 10.79 | 10.05 | 0.1203 | 14 | 24.63 | 21.57 | 0.001 |
| | PMON68399 | ZM_M39298 | 7 | 12.29 | 11.52 | 0.1342 | −1 | 9.91 | 10.05 | 0.7669 | 3 | 22.19 | 21.57 | 0.4785 |
| | PMON68399 | ZM_M39299 | 6 | 12.17 | 11.52 | 0.2051 | 1 | 10.13 | 10.05 | 0.8674 | 3 | 22.29 | 21.57 | 0.4118 |
| | PMON68399 | ZM_M39302 | −44 | 6.44 | 11.52 | 0 | −31 | 6.98 | 10.05 | 0 | −38 | 13.42 | 21.57 | 0 |
| 87 | PMON72494 | ZM_M26428 | 22 | 17.55 | 14.42 | 0 | 4 | 12.4 | 11.87 | 0.21 | 14 | 29.95 | 26.29 | 1.00E−04 |
| | PMON72494 | ZM_M26428 | 46 | 15.57 | 10.67 | 0 | 12 | 11.3 | 10.11 | 0.0033 | 29 | 26.86 | 20.78 | 0 |
| | PMON72494 | ZM_M26428 | 23 | 14.1 | 11.43 | 0 | 13 | 9 | 7.98 | 0.0704 | 19 | 23.1 | 19.4 | 8.00E−04 |
| | PMON72494 | ZM_M26428 | −6 | 10.7 | 11.43 | 0.2402 | 9 | 8.71 | 7.98 | 0.1938 | 0 | 19.41 | 19.4 | 0.9925 |
| | PMON72494 | ZM_M26428 | 3 | 11.02 | 10.67 | 0.5208 | 9 | 11.07 | 10.11 | 0.0163 | 6 | 22.09 | 20.78 | 0.1209 |
| | PMON72494 | ZM_M49327 | 8 | 12.13 | 11.23 | 0.2163 | 5 | 10.44 | 9.93 | 0.271 | 7 | 22.57 | 21.16 | 0.2103 |
| | PMON72494 | ZM_M49327 | 17 | 11.22 | 9.61 | 0.0189 | 4 | 8.28 | 7.93 | 0.5332 | 11 | 19.51 | 17.53 | 0.0853 |
| | PMON72494 | ZM_M49327 | 22 | 14.04 | 11.54 | 4.00E−04 | 21 | 9.73 | 8.06 | 0.0039 | 21 | 23.77 | 19.59 | 1.00E−04 |
| | PMON72494 | ZM_M49328 | 4 | 11.7 | 11.23 | 0.5112 | 11 | 11.03 | 9.93 | 0.0196 | 7 | 22.74 | 21.16 | 0.1618 |
| | PMON72494 | ZM_M49328 | 28 | 12.31 | 9.61 | 1.00E−04 | 17 | 9.27 | 7.93 | 0.0206 | 23 | 21.58 | 17.53 | 6.00E−04 |
| | PMON72494 | ZM_M49328 | 27 | 14.61 | 11.54 | 0 | 37 | 11.07 | 8.06 | 0 | 31 | 25.68 | 19.59 | 0 |
| | PMON72494 | ZM_M60546 | −2 | 12.67 | 12.95 | 0.7032 | 6 | 9.48 | 8.95 | 0.4795 | 1 | 22.15 | 21.91 | 0.8478 |
| 89 | PMON73765 | ZM_M35084 | 10 | 10.56 | 9.61 | 0.1621 | −2 | 7.8 | 7.93 | 0.8286 | 5 | 18.36 | 17.53 | 0.4667 |
| | PMON73765 | ZM_M35084 | 30 | 14.51 | 11.2 | 1.00E−04 | 27 | 9.25 | 7.27 | 0.0015 | 29 | 23.76 | 18.46 | 0 |
| | PMON73765 | ZM_M54013 | 42 | 13.61 | 9.61 | 0 | 13 | 8.96 | 7.93 | 0.0717 | 29 | 22.57 | 17.53 | 0 |
| | PMON73765 | ZM_M54013 | 32 | 14.78 | 11.2 | 0 | 49 | 10.82 | 7.27 | 0 | 39 | 25.6 | 18.46 | 0 |
| | PMON73765 | ZM_M54016 | 33 | 12.82 | 9.61 | 0 | 7 | 8.51 | 7.93 | 0.3051 | 22 | 21.33 | 17.53 | 0.0013 |
| | PMON73765 | ZM_M54016 | 34 | 14.98 | 11.2 | 0 | 39 | 10.09 | 7.27 | 0 | 36 | 25.07 | 18.46 | 0 |
| 91 | PMON73816 | ZM_M37183 | 21 | 12.1 | 9.96 | 0.0378 | 14 | 10.65 | 9.35 | 0.0587 | 18 | 22.75 | 19.31 | 0.0348 |
| | PMON73816 | ZM_M37183 | 33 | 11.5 | 8.66 | 0 | 21 | 9.82 | 8.09 | 0 | 27 | 21.32 | 16.75 | 0 |
| | PMON73816 | ZM_M37188 | 18 | 11.78 | 9.96 | 0.076 | 21 | 11.3 | 9.35 | 0.0051 | 20 | 23.08 | 19.31 | 0.021 |
| | PMON73816 | ZM_M37188 | 24 | 10.71 | 8.66 | 0 | 16 | 9.41 | 8.09 | 3.00E−04 | 20 | 20.11 | 16.75 | 0 |
| | PMON73816 | ZM_M37197 | 30 | 12.93 | 9.96 | 0.0044 | 6 | 9.88 | 9.35 | 0.4306 | 18 | 22.82 | 19.31 | 0.0313 |
| | PMON73816 | ZM_M37197 | 30 | 11.26 | 8.66 | 0 | 13 | 9.11 | 8.09 | 0.0047 | 22 | 20.37 | 16.75 | 0 |
| 90 | PMON73829 | ZM_M37805 | 29 | 9.46 | 7.32 | 1.00E−04 | 13 | 6.58 | 5.8 | 0.0171 | 22 | 16.04 | 13.12 | 1.00E−04 |
| | PMON73829 | ZM_M37805 | 18 | 11.78 | 9.96 | 0.076 | 15 | 10.74 | 9.35 | 0.0436 | 17 | 22.52 | 19.31 | 0.0484 |
| | PMON73829 | ZM_M37815 | 30 | 12.92 | 9.96 | 0.0046 | 13 | 10.57 | 9.35 | 0.0756 | 22 | 23.49 | 19.31 | 0.0109 |
| | PMON73829 | ZM_M37815 | 11 | 8.14 | 7.32 | 0.1117 | 13 | 6.54 | 5.8 | 0.0225 | 12 | 14.68 | 13.12 | 0.0241 |
| | PMON73829 | ZM_M38768 | 13 | 11.26 | 9.96 | 0.201 | −1 | 9.25 | 9.35 | 0.8842 | 6 | 20.51 | 19.31 | 0.4543 |
| | PMON73829 | ZM_M38768 | −2 | 7.2 | 7.32 | 0.8084 | 2 | 5.93 | 5.8 | 0.6854 | 0 | 13.13 | 13.12 | 0.9914 |
| | PMON73829 | ZM_M38797 | −39 | 4.49 | 7.32 | 0 | −19 | 4.68 | 5.8 | 8.00E−04 | −30 | 9.16 | 13.12 | 0 |
| | PMON73829 | ZM_M38797 | −11 | 8.83 | 9.96 | 0.2685 | 0 | 9.36 | 9.35 | 0.9827 | −6 | 18.2 | 19.31 | 0.4895 |
| | PMON73829 | ZM_M38798 | −62 | 3.75 | 9.96 | 0 | −35 | 6.07 | 9.35 | 0 | −49 | 9.82 | 19.31 | 0 |
| | PMON73829 | ZM_M38798 | −50 | 3.67 | 7.32 | 0 | −41 | 3.41 | 5.8 | 0 | −46 | 7.08 | 13.12 | 0 |
| | PMON73829 | ZM_M39692 | 3 | 7.54 | 7.32 | 0.6671 | −3 | 5.62 | 5.8 | 0.5857 | 0 | 13.16 | 13.12 | 0.9475 |
| | PMON73829 | ZM_M39692 | 17 | 11.69 | 9.96 | 0.0919 | 3 | 9.59 | 9.35 | 0.7181 | 10 | 21.28 | 19.31 | 0.2211 |
| 92 | PMON75305 | ZM_M35696 | 26 | 14.78 | 11.77 | 0 | 18 | 11.74 | 9.97 | 3.00E−04 | 22 | 26.52 | 21.74 | 0 |
| | PMON75305 | ZM_M35696 | 33 | 11.51 | 8.66 | 0 | 15 | 9.33 | 8.09 | 7.00E−04 | 24 | 20.84 | 16.75 | 0 |
| | PMON75305 | ZM_M36703 | 27 | 14.94 | 11.77 | 0 | 13 | 11.25 | 9.97 | 0.007 | 20 | 26.19 | 21.74 | 0 |
| | PMON75305 | ZM_M36703 | 40 | 12.15 | 8.66 | 0 | 22 | 9.84 | 8.09 | 0 | 31 | 21.99 | 16.75 | 0 |
| | PMON75305 | ZM_M36711 | 26 | 14.88 | 11.77 | 0 | 9 | 10.91 | 9.97 | 0.0455 | 19 | 25.78 | 21.74 | 2.00E−04 |
| | PMON75305 | ZM_M36711 | 35 | 11.68 | 8.66 | 0 | 16 | 9.38 | 8.09 | 4.00E−04 | 26 | 21.06 | 16.75 | 0 |
| 93 | PMON75306 | ZM_M35601 | 29 | 11.19 | 8.66 | 0 | 33 | 10.76 | 8.09 | 0 | 31 | 21.94 | 16.75 | 0 |
| | PMON75306 | ZM_M35601 | 11 | 13.05 | 11.77 | 0.0507 | 12 | 11.2 | 9.97 | 0.0097 | 11 | 24.24 | 21.74 | 0.0159 |
| | PMON75306 | ZM_M35604 | 24 | 14.64 | 11.77 | 0 | 16 | 11.57 | 9.97 | 9.00E−04 | 21 | 26.21 | 21.74 | 0 |
| | PMON75306 | ZM_M35604 | 42 | 12.29 | 8.66 | 0 | 35 | 10.92 | 8.09 | 0 | 39 | 23.21 | 16.75 | 0 |
| | PMON75306 | ZM_M35605 | 47 | 12.72 | 8.66 | 0 | 30 | 10.49 | 8.09 | 0 | 39 | 23.2 | 16.75 | 0 |
| | PMON75306 | ZM_M35605 | 18 | 13.92 | 11.77 | 0.0013 | 22 | 12.12 | 9.97 | 0 | 20 | 26.04 | 21.74 | 1.00E−04 |

TABLE 18-continued

| | | | Root length | | | | Shoot length | | | | Seedlling length | | | |
|---|---|---|---|---|---|---|---|---|---|---|---|---|---|---|
| PEP SEQ ID | Construct ID | Event ID | Percent change | Mean | Mean of con-trols | P-val-ue | Percent change | Mean | Mean of con-trols | P-val-ue | Percent change | Mean | Mean of con-trols | P-val-ue |
| 94 | PMON75309 | ZM_M35865 | 21 | 10.45 | 8.66 | 0 | 3 | 8.3 | 8.09 | 0.5545 | 12 | 18.75 | 16.75 | 0.0017 |
| | PMON75309 | ZM_M35865 | 22 | 11.75 | 9.66 | 0.0038 | 17 | 10.68 | 9.1 | 0.0064 | 20 | 22.43 | 18.76 | 0.0031 |
| | PMON75309 | ZM_M35878 | 23 | 10.6 | 8.66 | 0 | 26 | 10.17 | 8.09 | 0 | 24 | 20.78 | 16.75 | 0 |
| | PMON75309 | ZM_M35878 | 18 | 11.38 | 9.66 | 0.0163 | 13 | 10.3 | 9.1 | 0.0362 | 16 | 21.68 | 18.76 | 0.017 |
| | PMON75309 | ZM_M36160 | 19 | 11.51 | 9.66 | 0.0099 | 19 | 10.79 | 9.1 | 0.0037 | 19 | 22.31 | 18.76 | 0.0041 |
| | PMON75309 | ZM_M36160 | 32 | 11.41 | 8.66 | 0 | 19 | 9.6 | 8.09 | 0 | 25 | 21.01 | 16.75 | 0 |
| 95 | PMON75312 | ZM_M35649 | 22 | 14.37 | 11.77 | 1.00E−04 | 12 | 11.18 | 9.97 | 0.0107 | 18 | 25.55 | 21.74 | 3.00E−04 |
| | PMON75312 | ZM_M35649 | 28 | 11.06 | 8.66 | 0 | 13 | 9.15 | 8.09 | 0.0034 | 21 | 20.21 | 16.75 | 0 |
| | PMON75312 | ZM_M37099 | 9 | 9.46 | 8.66 | 0.0458 | 13 | 9.11 | 8.09 | 0.0049 | 11 | 18.57 | 16.75 | 0.0042 |
| | PMON75312 | ZM_M37099 | 23 | 14.42 | 11.77 | 1.00E−04 | 10 | 10.97 | 9.97 | 0.0343 | 17 | 25.39 | 21.74 | 6.00E−04 |
| | PMON75312 | ZM_M37100 | 37 | 11.9 | 8.66 | 0 | 22 | 9.83 | 8.09 | 0 | 30 | 21.73 | 16.75 | 0 |
| | PMON75312 | ZM_M37100 | 9 | 12.85 | 11.77 | 0.0979 | 5 | 10.45 | 9.97 | 0.3064 | 7 | 23.29 | 21.74 | 0.1298 |
| 101 | PMON75515 | ZM_M43539 | 26 | 12.88 | 10.19 | 0 | 13 | 10.12 | 8.98 | 0.0097 | 20 | 23 | 19.17 | 0 |
| | PMON75515 | ZM_M43546 | −3 | 9.87 | 10.19 | 0.5762 | −5 | 8.55 | 8.98 | 0.3141 | −4 | 18.43 | 19.17 | 0.3786 |
| | PMON75515 | ZM_M50136 | 16 | 10.41 | 8.98 | 0.0441 | 14 | 7.42 | 6.51 | 0.2064 | 15 | 17.84 | 15.48 | 0.085 |
| | PMON75515 | ZM_M50136 | 24 | 13.2 | 10.68 | 0.0015 | 25 | 9.27 | 7.42 | 0.0053 | 24 | 22.47 | 18.1 | 4.00E−04 |
| | PMON75515 | ZM_M50142 | 25 | 11.25 | 8.98 | 0.0018 | 17 | 7.61 | 6.51 | 0.1294 | 22 | 18.87 | 15.48 | 0.0145 |
| | PMON75515 | ZM_M50142 | 31 | 13.94 | 10.68 | 1.00E−04 | 35 | 10 | 7.42 | 1.00E−04 | 32 | 23.94 | 18.1 | 0 |
| 105 | PMON75524 | ZM_M47998 | 17 | 11.23 | 9.61 | 0.0452 | 35 | 9.69 | 7.17 | 0.0012 | 25 | 20.91 | 16.79 | 0.0043 |
| | PMON75524 | ZM_M47998 | 15 | 13.3 | 11.54 | 0.0101 | 38 | 11.15 | 8.06 | 0 | 25 | 24.45 | 19.59 | 0 |
| | PMON75524 | ZM_M48003 | 4 | 9.99 | 9.61 | 0.6366 | 9 | 7.78 | 7.17 | 0.4187 | 6 | 17.77 | 16.79 | 0.4837 |
| | PMON75524 | ZM_M48003 | 28 | 14.77 | 11.54 | 0 | 15 | 9.22 | 8.06 | 0.0414 | 22 | 24 | 19.59 | 1.00E−04 |
| | PMON75524 | ZM_M48004 | 19 | 11.44 | 9.61 | 0.0245 | 29 | 9.24 | 7.17 | 0.007 | 23 | 20.68 | 16.79 | 0.0069 |
| | PMON75524 | ZM_M48004 | 5 | 12.11 | 11.54 | 0.3919 | 1 | 8.17 | 8.06 | 0.8374 | 4 | 20.28 | 19.59 | 0.5062 |
| | PMON75524 | ZM_M48005 | 18 | 11.37 | 9.61 | 0.0303 | 19 | 8.57 | 7.17 | 0.0654 | 19 | 19.93 | 16.79 | 0.0276 |
| | PMON75524 | ZM_M48005 | 33 | 15.38 | 11.54 | 0 | 29 | 10.4 | 8.06 | 1.00E−04 | 32 | 25.78 | 19.59 | 0 |
| | PMON75524 | ZM_M48007 | 20 | 11.51 | 9.61 | 0.0195 | 7 | 7.66 | 7.17 | 0.5152 | 14 | 19.17 | 16.79 | 0.0927 |
| | PMON75524 | ZM_M48007 | 28 | 14.78 | 11.54 | 0 | 46 | 11.78 | 8.06 | 0 | 36 | 26.55 | 19.59 | 0 |
| | PMON75524 | ZM_M48010 | 22 | 11.77 | 9.61 | 0.0083 | 12 | 8.05 | 7.17 | 0.2443 | 18 | 19.81 | 16.79 | 0.0339 |
| | PMON75524 | ZM_M48010 | 18 | 13.62 | 11.54 | 0.0026 | 25 | 10.08 | 8.06 | 6.00E−04 | 21 | 23.7 | 19.59 | 2.00E−04 |
| 107 | PMON75533 | ZM_M47453 | 55 | 14.93 | 9.61 | 0 | 54 | 11.03 | 7.17 | 0 | 55 | 25.96 | 16.79 | 0 |
| | PMON75533 | ZM_M47453 | 39 | 14.99 | 10.8 | 0 | 44 | 10.24 | 7.12 | 0 | 41 | 25.23 | 17.92 | 0 |
| | PMON75533 | ZM_M47460 | 15 | 11.03 | 9.61 | 0.0782 | 5 | 7.53 | 7.17 | 0.63 | 11 | 18.56 | 16.79 | 0.208 |
| | PMON75533 | ZM_M47460 | 36 | 14.65 | 10.8 | 0 | 21 | 8.6 | 7.12 | 0.0037 | 30 | 23.25 | 17.92 | 0 |
| | PMON75533 | ZM_M49275 | 23 | 11.82 | 9.61 | 0.0069 | 20 | 8.58 | 7.17 | 0.0636 | 22 | 20.4 | 16.79 | 0.0119 |
| | PMON75533 | ZM_M49275 | 30 | 14.09 | 10.8 | 0 | 21 | 8.65 | 7.12 | 0.0028 | 27 | 22.74 | 17.92 | 0 |
| | PMON75533 | ZM_M49278 | 14 | 10.96 | 9.61 | 0.093 | 7 | 7.68 | 7.17 | 0.4982 | 11 | 18.64 | 16.79 | 0.1885 |
| | PMON75533 | ZM_M49278 | 18 | 12.79 | 10.8 | 0.0014 | 13 | 8.01 | 7.12 | 0.0757 | 16 | 20.8 | 17.92 | 0.0023 |
| 114 | PMON75980 | ZM_M53387 | 17 | 13.08 | 11.23 | 0.0122 | 11 | 10.99 | 9.93 | 0.0247 | 14 | 24.08 | 21.16 | 0.0109 |
| | PMON75980 | ZM_M53389 | 13 | 12.69 | 11.23 | 0.0463 | 9 | 10.85 | 9.93 | 0.0503 | 11 | 23.54 | 21.16 | 0.0363 |
| | PMON75980 | ZM_M53390 | 5 | 11.8 | 11.23 | 0.4269 | 4 | 10.33 | 9.93 | 0.3908 | 5 | 22.13 | 21.16 | 0.3859 |
| | PMON75980 | ZM_M53392 | 20 | 13.42 | 11.23 | 0.0033 | 13 | 11.19 | 9.93 | 0.0079 | 16 | 24.62 | 21.16 | 0.0028 |
| | PMON75980 | ZM_M53396 | 14 | 12.75 | 11.23 | 0.0383 | 4 | 10.38 | 9.93 | 0.338 | 9 | 23.12 | 21.16 | 0.0831 |
| | PMON75980 | ZM_M53397 | 6 | 11.92 | 11.23 | 0.3398 | −4 | 9.59 | 9.93 | 0.455 | 2 | 21.51 | 21.16 | 0.7576 |
| | PMON75980 | ZM_M53398 | 4 | 11.66 | 11.23 | 0.5533 | 3 | 10.27 | 9.93 | 0.4659 | 4 | 21.93 | 21.16 | 0.4944 |
| 113 | PMON78232 | ZM_M55911 | −3 | 12.1 | 12.44 | 0.652 | 12 | 9.85 | 8.82 | 0.1004 | 3 | 21.94 | 21.27 | 0.5616 |
| | PMON78232 | ZM_M55911 | −5 | 13.18 | 13.83 | 0.3591 | 2 | 9.43 | 9.27 | 0.8057 | −2 | 22.61 | 23.09 | 0.6774 |
| | PMON78232 | ZM_M56069 | 14 | 14.13 | 12.44 | 0.031 | 7 | 9.44 | 8.82 | 0.3213 | 11 | 23.56 | 21.27 | 0.0511 |
| | PMON78232 | ZM_M56069 | 11 | 15.39 | 13.83 | 0.0296 | 12 | 10.38 | 9.27 | 0.0932 | 12 | 25.77 | 23.09 | 0.0237 |
| | PMON78232 | ZM_M56206 | −14 | 10.75 | 12.44 | 0.0307 | −9 | 8 | 8.82 | 0.1837 | −12 | 18.75 | 21.27 | 0.0333 |
| | PMON78232 | ZM_M56206 | 1 | 14.03 | 13.83 | 0.7776 | 5 | 9.73 | 9.27 | 0.4808 | 3 | 23.76 | 23.09 | 0.5663 |
| | PMON78232 | ZM_M56428 | 12 | 13.9 | 12.44 | 0.0606 | 11 | 9.83 | 8.82 | 0.1065 | 12 | 23.73 | 21.27 | 0.0367 |
| | PMON78232 | ZM_M56428 | 13 | 15.55 | 13.83 | 0.0164 | 18 | 10.91 | 9.27 | 0.0143 | 15 | 26.46 | 23.09 | 0.0048 |
| 106 | PMON79163 | ZM_M45011 | 16 | 11.88 | 10.25 | 0.0215 | 7 | 8.54 | 8 | 0.4508 | 12 | 20.42 | 18.26 | 0.0941 |
| | PMON79163 | ZM_M45011 | 20 | 12.98 | 10.8 | 0.0017 | 23 | 8.74 | 7.12 | 0.0046 | 21 | 21.71 | 17.92 | 4.00E−04 |
| | PMON79163 | ZM_M48217 | 16 | 11.89 | 10.25 | 0.0213 | 18 | 9.42 | 8 | 0.0487 | 17 | 21.3 | 18.26 | 0.0197 |
| | PMON79163 | ZM_M48217 | 28 | 13.81 | 10.8 | 0 | 20 | 8.51 | 7.12 | 0.0062 | 24 | 22.32 | 17.92 | 0 |
| 98 | PMON79174 | ZM_M47171 | 13 | 11.58 | 10.25 | 0.0602 | 20 | 9.61 | 8 | 0.0259 | 16 | 21.18 | 18.26 | 0.0247 |
| | PMON79174 | ZM_M47171 | 28 | 13.84 | 10.8 | 0 | 24 | 8.82 | 7.12 | 0.001 | 26 | 22.65 | 17.92 | 0 |
| | PMON79174 | ZM_M47941 | 18 | 12.09 | 10.25 | 0.0101 | 6 | 8.48 | 8 | 0.4971 | 13 | 20.57 | 18.26 | 0.0734 |
| | PMON79174 | ZM_M47941 | 25 | 13.53 | 10.8 | 0 | 16 | 8.24 | 7.12 | 0.026 | 21 | 21.77 | 17.92 | 1.00E−04 |
| 99 | PMON79413 | ZM_M48525 | 44 | 13.83 | 9.61 | 0 | 30 | 9.34 | 7.17 | 0.0049 | 38 | 23.17 | 16.79 | 0 |
| | PMON79413 | ZM_M48525 | 26 | 13.66 | 10.8 | 0 | 32 | 9.41 | 7.12 | 0 | 29 | 23.07 | 17.92 | 0 |
| | PMON79413 | ZM_M50333 | 25 | 12.05 | 9.61 | 0.0031 | 25 | 8.95 | 7.17 | 0.0197 | 25 | 21 | 16.79 | 0.0036 |
| | PMON79413 | ZM_M50333 | 27 | 13.75 | 10.8 | 0 | 34 | 9.55 | 7.12 | 0 | 30 | 23.3 | 17.92 | 0 |
| | PMON79413 | ZM_M53171 | 18 | 11.34 | 9.61 | 0.0331 | 27 | 9.13 | 7.17 | 0.0107 | 22 | 20.46 | 16.79 | 0.0106 |
| | PMON79413 | ZM_M53171 | 21 | 13.04 | 10.8 | 3.00E−04 | 37 | 9.78 | 7.12 | 0 | 27 | 22.82 | 17.92 | 0 |

TABLE 18-continued

| PEP SEQ ID | Construct ID | Event ID | Root length | | | | Shoot length | | | | Seedlling length | | | |
|---|---|---|---|---|---|---|---|---|---|---|---|---|---|---|
| | | | Percent change | Mean | Mean of con-trols | P-val-ue | Percent change | Mean | Mean of con-trols | P-val-ue | Percent change | Mean | Mean of con-trols | P-val-ue |
| 112 | PMON79447 | ZM_M53825 | 16 | 12.45 | 10.71 | 0.0079 | 17 | 9.12 | 7.83 | 0.0281 | 16 | 21.57 | 18.53 | 0.0077 |
| | PMON79447 | ZM_M53825 | 30 | 14.57 | 11.2 | 1.00E−04 | 34 | 9.75 | 7.27 | 1.00E−04 | 32 | 24.32 | 18.46 | 0 |
| | PMON79447 | ZM_M53826 | 11 | 11.87 | 10.71 | 0.0705 | 0 | 7.84 | 7.83 | 0.9839 | 6 | 19.71 | 18.53 | 0.2903 |
| | PMON79447 | ZM_M53826 | 34 | 15 | 11.2 | 0 | 42 | 10.31 | 7.27 | 0 | 37 | 25.32 | 18.46 | 0 |
| | PMON79447 | ZM_M53835 | 6 | 11.31 | 10.71 | 0.342 | −5 | 7.42 | 7.83 | 0.4779 | 1 | 18.73 | 18.53 | 0.8568 |
| | PMON79447 | ZM_M53835 | 32 | 14.83 | 11.2 | 0 | 47 | 10.66 | 7.27 | 0 | 38 | 25.49 | 18.46 | 0 |

4. Cold Field Efficacy Trial

This example sets forth a cold field efficacy trial to identify gene constructs that confer enhanced cold vigor at germination and early seedling growth under early spring planting field conditions in conventional-till and simulated no-till environments. Seeds are planted into the ground around two weeks before local farmers are beginning to plant corn so that a significant cold stress is exerted onto the crop, named as cold treatment. Seeds also are planted under local optimal planting conditions such that the crop has little or no exposure to cold condition, named as normal treatment. The cold field efficacy trials are carried out in five locations, including Glyndon Minn., Mason Mich., Monmouth Ill., Dayton Iowa, Mystic Conn. At each location, seeds are planted under both cold and normal conditions with 3 repetitions per treatment, 20 kernels per row and single row per plot. Seeds are planted 1.5 to 2 inch deep into soil to avoid muddy conditions. Two temperature monitors are set up at each location to monitor both air and soil temperature daily.

Seed emergence is defined as the point when the growing shoot breaks the soil surface. The number of emerged seedling in each plot is counted everyday from the day the earliest plot begins to emerge until no significant changes in emergence occur. In addition, for each planting date, the latest date when emergence is 0 in all plots is also recorded. Seedling vigor is also rated at V3-V4 stage before the average of corn plant height reaches 10 inches, with 1=excellent early growth, 5=Average growth and 9=poor growth. Days to 50% emergence, maximum percent emergence and seedling vigor are calculated using SAS software for the data within each location or across all locations.

The following table lists the data that were collected and analyzed based on the procedure illustrated above. The analyzed data across all locations only include those from Glyndon Minn., Mason Mich., and Mystic Conn.

TABLE 19

| PEP SEQ ID construct | Event1 | Days to 50% Emergence | | | | | | | | | |
|---|---|---|---|---|---|---|---|---|---|---|---|
| | | Across Black Dirt Trts | | Warm Trts | | Mason_Trt 2 | | Glyndon_Trt 2 | | Mystic_Trt 2 | |
| | | Delta | P value | Delta | P value | Delta | P value | Delta | P value | Delta | P value |
| 88 | ZM_M31146 | 1.46 | 0.106 | 0.04 | 0.979 | 0.51 | 0.755 | 2.17 | 0.079 | 0.99 | 0.551 |
| pMON68399 | ZM_M31147 | 1.29 | 0.153 | 0.34 | 0.81 | 0.59 | 0.721 | 1.47 | 0.234 | 1.64 | 0.322 |
| | ZM_M31524 | −0.41 | 0.649 | 0.23 | 0.873 | −2.09 | 0.205 | −0.13 | 0.919 | 0.69 | 0.676 |
| | ZM_M32356 | −0.21 | 0.814 | 0.33 | 0.815 | −1.18 | 0.472 | −1.59 | 0.197 | 3.52 | 0.034 |
| | Construct | 0.53 | 0.302 | 0.24 | 0.772 | −0.54 | 0.563 | 0.48 | 0.495 | 1.71 | 0.071 |
| 90 | ZM_M37805 | 0.95 | 0.293 | −0.04 | 0.977 | −0.4 | 0.808 | 2.28 | 0.065 | −0.35 | 0.831 |
| pMON73829 | ZM_M37815 | −1.24 | 0.169 | 0.06 | 0.965 | −0.84 | 0.611 | −1.4 | 0.258 | −1.35 | 0.417 |
| | ZM_M38768 | 2.79 | 0.002 | 0.7 | 0.621 | 0.64 | 0.696 | 2.11 | 0.087 | 6.3 | 0 |
| | Construct | 0.83 | 0.145 | 0.24 | 0.788 | −0.2 | 0.849 | 1 | 0.2 | 1.53 | 0.144 |
| 92 | ZM_M35696 | 1.75 | 0.053 | 0.14 | 0.922 | −1.93 | 0.24 | 4.17 | 0.001 | 0.61 | 0.715 |
| pMON75305 | ZM_M36703 | −0.47 | 0.603 | 0.4 | 0.777 | −2.34 | 0.155 | −0.83 | 0.502 | 2.12 | 0.202 |
| | ZM_M36711 | −0.92 | 0.31 | 0.32 | 0.823 | −1.23 | 0.454 | −1.5 | 0.223 | 0.57 | 0.731 |
| | Construct | 0.12 | 0.832 | 0.29 | 0.749 | −1.84 | 0.078 | 0.61 | 0.432 | 1.1 | 0.295 |
| 93 | ZM_M35601 | −0.53 | 0.56 | −0.36 | 0.803 | −0.25 | 0.877 | −0.22 | 0.861 | −1.42 | 0.392 |
| pMON75306 | ZM_M35604 | −0.92 | 0.309 | 0.45 | 0.752 | 0.1 | 0.951 | −1.89 | 0.125 | −0 | 1 |
| | ZM_M35605 | 1.46 | 0.105 | −0.08 | 0.958 | −0.74 | 0.654 | 2.89 | 0.019 | 0.82 | 0.623 |
| | Construct | 0.01 | 0.992 | 0.01 | 0.994 | −0.3 | 0.776 | 0.26 | 0.738 | −0.2 | 0.847 |
| 94 | ZM_M35865 | −0.31 | 0.735 | −0.27 | 0.849 | −2.91 | 0.078 | 0.25 | 0.84 | 1.18 | 0.475 |
| pMON75309 | ZM_M35878 | −0.1 | 0.916 | 0.33 | 0.817 | 0.3 | 0.858 | −0.48 | 0.698 | 0.28 | 0.867 |
| | ZM_M36160 | −0.58 | 0.519 | −0.46 | 0.748 | −1.84 | 0.264 | −0.65 | 0.597 | 0.81 | 0.625 |
| | Construct | −0.33 | 0.566 | −0.13 | 0.882 | −1.48 | 0.155 | −0.29 | 0.707 | 0.76 | 0.47 |
| 107 | ZM_M49275 | −3.72 | 0.001 | 2.39 | 0.343 | −5.47 | 0.004 | −5.14 | 0 | X | X |
| pMON75533 | ZM_M49278 | −2.37 | 0.042 | 2.08 | 0.409 | −7.87 | 0 | −1.9 | 0.185 | X | X |
| | Construct | −3.04 | 0.001 | 2.24 | 0.241 | −6.67 | 0 | −3.52 | 0.003 | X | X |
| 119 | ZM_M53641 | 1.25 | 0.166 | 0.04 | 0.978 | 2.88 | 0.081 | −0.31 | 0.804 | 2.74 | 0.099 |
| pMON78235 | ZM_M53994 | −0.56 | 0.536 | −0.13 | 0.926 | −1.04 | 0.526 | 0.06 | 0.962 | −1.31 | 0.429 |
| | ZM_M53997 | −0.8 | 0.376 | 0.11 | 0.937 | 0.38 | 0.816 | −1.82 | 0.139 | 0.07 | 0.968 |
| | Construct | −0.04 | 0.95 | 0.01 | 0.994 | 0.74 | 0.478 | −0.69 | 0.376 | 0.5 | 0.635 |

TABLE 19-continued

| | | | | | | | | | | | |
|---|---|---|---|---|---|---|---|---|---|---|---|
| 104 | ZM_M45248 | −1.52 | 0.211 | 2.65 | 0.294 | −4.77 | 0.013 | −2.01 | 0.188 | X | X |
| pMON78936 | ZM_M45274 | −3.87 | 0.001 | 2.58 | 0.307 | −5 | 0.009 | −5.59 | 0 | X | X |
| | Construct | −2.69 | 0.004 | 2.61 | 0.171 | −4.89 | 0.002 | −3.8 | 0.002 | X | X |
| 110 | ZM_M50823 | −2 | 0.057 | −0.17 | 0.921 | −5.85 | 0.002 | −2.51 | 0.08 | 2.87 | 0.136 |
| pMON79425 | ZM_M50856 | 0.01 | 0.993 | −0.6 | 0.714 | −5.19 | 0.007 | −0.31 | 0.839 | 6.23 | 0.001 |
| | ZM_M51300 | −1.91 | 0.068 | −0.02 | 0.989 | −4.43 | 0.021 | −2.42 | 0.091 | 1.61 | 0.402 |
| | ZM_M51302 | −3.5 | 0.001 | −0.21 | 0.899 | −6.08 | 0.002 | −5.38 | 0 | 2.85 | 0.139 |
| | ZM_M51313 | −4.06 | 0 | −0.12 | 0.94 | −4.16 | 0.03 | −5.38 | 0 | −1.31 | 0.496 |
| | ZM_M51608 | −2.84 | 0.007 | −0.27 | 0.87 | −3.74 | 0.051 | −4.88 | 0.001 | 2.15 | 0.265 |
| | ZM_M51623 | −2.09 | 0.047 | −0.15 | 0.926 | −5.14 | 0.007 | −3.15 | 0.028 | 3.09 | 0.11 |
| | Construct | −2.34 | 0.001 | −0.22 | 0.838 | −4.94 | 0 | −3.43 | 0 | 2.5 | 0.048 |
| 116 | ZM_M53939 | −2.66 | 0.022 | 2.55 | 0.313 | −3.3 | 0.085 | −4.63 | 0.001 | X | X |
| pMON79697 | ZM_M54371 | −1.02 | 0.378 | 2.71 | 0.282 | −3.56 | 0.063 | −2.04 | 0.154 | X | X |
| | ZM_M54374 | −2.79 | 0.016 | 2.67 | 0.29 | −4.36 | 0.023 | −4.3 | 0.003 | X | X |
| | Construct | −2.16 | 0.01 | 2.64 | 0.11 | −3.74 | 0.009 | −3.66 | 0.001 | X | X |
| 111 | ZM_M51598 | −2.19 | 0.071 | 2.23 | 0.376 | −4.51 | 0.019 | −3.25 | 0.033 | X | X |
| pMON79718 | ZM_M52937 | −1.8 | 0.138 | 3.07 | 0.224 | −5.32 | 0.006 | −2.14 | 0.162 | X | X |
| | Construct | −2 | 0.037 | 2.65 | 0.165 | −4.92 | 0.002 | −2.69 | 0.028 | X | X |
| 120 | ZM_M53455 | 0.14 | 0.873 | 0.29 | 0.838 | 3.04 | 0.065 | −1.71 | 0.166 | 0.95 | 0.565 |
| pMON80452 | ZM_M53456 | −0.56 | 0.532 | −0.51 | 0.719 | 0.97 | 0.555 | −1.18 | 0.337 | −0.86 | 0.602 |
| | ZM_M53694 | 0.88 | 0.332 | 0.25 | 0.859 | 2.06 | 0.211 | 1.04 | 0.401 | −0.62 | 0.706 |
| | ZM_M53695 | 1.47 | 0.104 | 0 | 0.998 | 3.07 | 0.062 | 0.22 | 0.857 | 2.37 | 0.154 |
| | ZM_M53696 | 0.95 | 0.295 | −0.2 | 0.888 | 0.46 | 0.78 | 0.74 | 0.55 | 1.85 | 0.265 |
| | Construct | 0.57 | 0.23 | −0.03 | 0.965 | 1.92 | 0.028 | −0.18 | 0.783 | 0.74 | 0.402 |
| 118 | ZM_M53218 | −1.55 | 0.087 | −0.02 | 0.988 | −3.54 | 0.032 | −2.09 | 0.09 | 1.55 | 0.351 |
| pMON80461 | ZM_M53235 | −1.42 | 0.117 | 0.34 | 0.808 | −0.5 | 0.761 | −1.86 | 0.131 | −1.44 | 0.386 |
| | ZM_M53848 | −0.36 | 0.69 | −0.02 | 0.988 | −1.11 | 0.5 | −0.6 | 0.624 | 0.88 | 0.595 |
| | ZM_M54282 | −0.98 | 0.279 | 0.16 | 0.909 | −3.97 | 0.016 | 0.32 | 0.796 | −0.58 | 0.727 |
| | ZM_M54284 | −1.06 | 0.24 | 0.05 | 0.972 | −0.35 | 0.832 | −1.21 | 0.328 | −1.49 | 0.37 |
| | Construct | −1.07 | 0.025 | 0.1 | 0.891 | −1.89 | 0.03 | −1.09 | 0.095 | −0.21 | 0.806 |

| | | Maximum Percent Emergence | | | | | | | | | |
|---|---|---|---|---|---|---|---|---|---|---|---|
| | | Across Black Dirt Trts | | Warm Trts | | Mason_Trt 2 | | Glyndon_Trt 2 | | Mystic_Trt 2 | |
| PEP SEQ ID construct | Event1 | Delta | P value | Delta | P value | Delta | P value | Delta | P value | Delta | P value |
| 88 | ZM_M31146 | −2.7 | 0.428 | 1.42 | 0.601 | 0.19 | 0.97 | −7.53 | 0.125 | 4.07 | 0.503 |
| pMON68399 | ZM_M31147 | −6.31 | 0.064 | −5.8 | 0.033 | −6.48 | 0.184 | −9.75 | 0.047 | 0.74 | 0.903 |
| | ZM_M31524 | −2.7 | 0.428 | −1.91 | 0.481 | 5.19 | 0.288 | −4.2 | 0.393 | −7.59 | 0.212 |
| | ZM_M32356 | 3.55 | 0.297 | −1.91 | 0.481 | 8.52 | 0.081 | 5.8 | 0.237 | −5.93 | 0.33 |
| | Construct | −2.04 | 0.293 | −2.05 | 0.185 | 1.85 | 0.505 | −3.92 | 0.161 | −2.18 | 0.53 |
| 90 | ZM_M37805 | −4.18 | 0.22 | 5.83 | 0.032 | 1.67 | 0.733 | −9.01 | 0.067 | −0.37 | 0.951 |
| pMON73829 | ZM_M37815 | 4.71 | 0.167 | −3.62 | 0.183 | 8.33 | 0.088 | 2.1 | 0.669 | 6.3 | 0.301 |
| | ZM_M38768 | −6.27 | 0.066 | −2.51 | 0.356 | −1.67 | 0.733 | −5.68 | 0.247 | 12.04 | 0.048 |
| | Construct | −1.91 | 0.374 | −0.1 | 0.954 | 2.78 | 0.368 | −4.2 | 0.177 | −2.04 | 0.596 |
| 92 | ZM_M35696 | −5.02 | 0.141 | 2.49 | 0.359 | 10 | 0.041 | 12.35 | 0.012 | −5.37 | 0.377 |
| pMON75305 | ZM_M36703 | 0.4 | 0.906 | −1.95 | 0.473 | 6.67 | 0.172 | 0.99 | 0.841 | −7.04 | 0.248 |
| | ZM_M36711 | 3.6 | 0.291 | 1.38 | 0.611 | 1.67 | 0.733 | 6.54 | 0.183 | −0.37 | 0.951 |
| | Construct | −0.34 | 0.875 | 0.64 | 0.709 | 6.11 | 0.048 | −1.6 | 0.605 | −4.26 | 0.268 |
| 93 | ZM_M35601 | −2.52 | 0.46 | 3.6 | 0.185 | 1.67 | 0.733 | −5.68 | 0.247 | −0.37 | 0.951 |
| pMON75306 | ZM_M35604 | 3.04 | 0.372 | −3.06 | 0.26 | 5 | 0.305 | 5.43 | 0.269 | −3.7 | 0.543 |
| | ZM_M35605 | −3.49 | 0.306 | −1.4 | 0.607 | 8.33 | 0.088 | 10.12 | 0.039 | −2.04 | 0.738 |
| | Construct | −0.99 | 0.647 | −0.28 | 0.869 | 5 | 0.105 | −3.46 | 0.266 | −2.04 | 0.596 |
| 94 | ZM_M35865 | −2.1 | 0.538 | −3.06 | 0.315 | 1.67 | 0.733 | −2.35 | 0.633 | −5.37 | 0.377 |
| pMON75309 | ZM_M35878 | −0.99 | 0.772 | 1.38 | 0.611 | −0 | 1 | −0.12 | 0.98 | −3.7 | 0.543 |
| | ZM_M36160 | 0.82 | 0.81 | 1.38 | 0.611 | 8.33 | 0.088 | 0.99 | 0.841 | −7.04 | 0.248 |
| | Construct | −0.76 | 0.726 | −0.1 | 0.955 | 3.33 | 0.28 | −0.49 | 0.874 | −5.37 | 0.163 |
| 107 | ZM_M49275 | 10.25 | 0.019 | 5.28 | 0.274 | 17.5 | 0.002 | 15 | 0.009 | X | X |
| pMON75533 | ZM_M49278 | 4.88 | 0.265 | −1.39 | 0.773 | 19.17 | 0.001 | 6.11 | 0.284 | X | X |
| | Construct | 7.56 | 0.03 | 1.94 | 0.594 | 18.33 | 0 | 10.56 | 0.024 | X | X |
| 119 | ZM_M53641 | −1.27 | 0.71 | 1.38 | 0.611 | 5 | 0.305 | 0.99 | 0.841 | 12.04 | 0.048 |
| pMON78235 | ZM_M53994 | 1.65 | 0.628 | −1.4 | 0.607 | 3.33 | 0.494 | 0.99 | 0.841 | 1.3 | 0.831 |
| | ZM_M53997 | 5.26 | 0.122 | 3.05 | 0.262 | 1.67 | 0.733 | 9.88 | 0.044 | −0.37 | 0.951 |
| | Construct | 1.86 | 0.382 | 1.01 | 0.557 | 3.33 | 0.28 | 3.95 | 0.203 | −3.7 | 0.336 |
| 104 | ZM_M45248 | −3.09 | 0.481 | 1.94 | 0.687 | 10.83 | 0.056 | −1.67 | 0.77 | X | X |
| pMON78936 | ZM_M45274 | 9.88 | 0.024 | 6.94 | 0.15 | 14.17 | 0.013 | 16.11 | 0.005 | X | X |
| | Construct | 3.39 | 0.331 | 4.44 | 0.223 | 12.5 | 0.007 | 7.22 | 0.121 | X | X |
| 110 | ZM_M50823 | 4.65 | 0.24 | −0.83 | 0.792 | 10.83 | 0.056 | 7.22 | 0.206 | −6.67 | 0.346 |
| pMON79425 | ZM_M50856 | −6.88 | 0.082 | −0.83 | 0.792 | 5.83 | 0.304 | −8.33 | 0.144 | 16.67 | 0.019 |
| | ZM_M51300 | 3.54 | 0.371 | −0.83 | 0.792 | 4.17 | 0.462 | 8.33 | 0.144 | −6.67 | 0.346 |
| | ZM_M51302 | 12.85 | 0.001 | 0.83 | 0.792 | 14.17 | 0.013 | 19.44 | 0.001 | −1.67 | 0.814 |
| | ZM_M51313 | 9.51 | 0.016 | −0.83 | 0.792 | 15.83 | 0.005 | 12.78 | 0.025 | −3.33 | 0.637 |
| | ZM_M51608 | 5.49 | 0.166 | 0.83 | 0.792 | 10.83 | 0.056 | 7.22 | 0.206 | −3.33 | 0.637 |
| | ZM_M51623 | 1.6 | 0.687 | 3.06 | 0.333 | 17.5 | 0.002 | 2.78 | 0.626 | 16.67 | 0.019 |
| | Construct | 4.39 | 0.09 | 0.2 | 0.923 | 11.31 | 0.002 | 7.06 | 0.059 | −7.86 | 0.09 |

TABLE 19-continued

| | | | | | | | | | | | |
|---|---|---|---|---|---|---|---|---|---|---|---|
| 116 | ZM_M53939 | 6.36 | 0.147 | 1.94 | 0.687 | 12.5 | 0.028 | 11.67 | 0.041 | X | X |
| pMON79697 | ZM_M54371 | 0.06 | 0.989 | 3.61 | 0.454 | 2.5 | 0.659 | 7.22 | 0.206 | X | X |
| | ZM_M54374 | 10.06 | 0.022 | −1.39 | 0.773 | 12.5 | 0.028 | 17.22 | 0.003 | X | X |
| | Construct | 5.49 | 0.081 | 1.39 | 0.66 | 9.17 | 0.03 | 12.04 | 0.005 | X | X |
| 111 | ZM_M51598 | 4.13 | 0.345 | −1.39 | 0.773 | 19.17 | 0.001 | 5 | 0.381 | X | X |
| pMON79718 | ZM_M52937 | −1.42 | 0.745 | 6.94 | 0.15 | 15.83 | 0.005 | −1.67 | 0.77 | X | X |
| | Construct | 1.36 | 0.698 | 2.78 | 0.446 | 17.5 | 0 | 1.67 | 0.72 | X | X |
| 120 | ZM_M53455 | 1.65 | 0.628 | −1.95 | 0.473 | −3.33 | 0.494 | 7.65 | 0.119 | −5.37 | 0.377 |
| pMON80452 | ZM_M53456 | 3.04 | 0.372 | 0.27 | 0.921 | −5 | 0.305 | 8.77 | 0.074 | −0.37 | 0.951 |
| | ZM_M53694 | −0.15 | 0.964 | 0.83 | 0.761 | −1.67 | 0.733 | −0.12 | 0.98 | 1.3 | 0.831 |
| | ZM_M53695 | −3.9 | 0.252 | 1.38 | 0.611 | 1.67 | 0.733 | −3.46 | 0.481 | 10.37 | 0.089 |
| | ZM_M53696 | 0.96 | 0.779 | 2.49 | 0.359 | 6.67 | 0.172 | 2.1 | 0.669 | −7.04 | 0.248 |
| | Construct | 0.32 | 0.86 | 0.6 | 0.675 | −0.33 | 0.897 | 2.99 | 0.25 | −4.37 | 0.175 |
| 118 | ZM_M53218 | 3.46 | 0.31 | −0.84 | 0.757 | 8.33 | 0.088 | 8.77 | 0.074 | 12.04 | 0.048 |
| pMON80461 | ZM_M53235 | 3.6 | 0.291 | 0.83 | 0.761 | −3.33 | 0.494 | 9.88 | 0.044 | −2.04 | 0.738 |
| | ZM_M53848 | 4.98 | 0.143 | 3.05 | 0.262 | 6.67 | 0.172 | 7.65 | 0.119 | −2.04 | 0.738 |
| | ZM_M54282 | −0.57 | 0.867 | −3.62 | 0.183 | 6.67 | 0.172 | −3.46 | 0.481 | −2.04 | 0.738 |
| | ZM_M54284 | 4.98 | 0.143 | −1.19 | 0.679 | 10 | 0.041 | 0.99 | 0.841 | 7.96 | 0.191 |
| | Construct | 3.29 | 0.068 | −0.35 | 0.807 | 5.67 | 0.028 | 4.77 | 0.067 | −2.04 | 0.527 |

E. Screens for Transgenic Plant Seeds with Increased Protein and/or Oil Levels

This example sets forth a high-throughput selection for identifying plant seeds with improvement in seed composition using the Infratec 1200 series Grain Analyzer, which is a near-infrared transmittance spectrometer used to determine the composition of a bulk seed sample. Near infrared analysis is a non-destructive, high-throughput method that can analyze multiple traits in a single sample scan. An NIR calibration for the analytes of interest is used to predict the values of an unknown sample. The NIR spectrum is obtained for the sample and compared to the calibration using a complex chemometric software package that provides a predicted values as well as information on how well the sample fits in the calibration.

Infratec Model 1221, 1225, or 1227 with transport module by Foss North America is used with cuvette, item #1000-4033, Foss North America or for small samples with small cell cuvette, Foss standard cuvette modified by Leon Girard Co. Corn and soy check samples of varying composition maintained in check cell cuvettes are supplied by Leon Girard Co. NIT collection software is provided by Maximum Consulting Inc. Software. Calculations are performed automatically by the software. Seed samples are received in packets or containers with barcode labels from the customer. The seed is poured into the cuvettes and analyzed as received.

TABLE 20

| | |
|---|---|
| Typical sample(s): | Whole grain corn and soybean seeds |
| Analytical time to run method: | Less than 0.75 min per sample |
| Total elapsed time per run: | 1.5 minute per sample |
| Typical and minimum sample size: | Corn typical: 50 cc; minimum 30 cc<br>Soybean typical: 50 cc; minimum 5 cc |
| Typical analytical range: | Determined in part by the specific calibration.<br>Corn - moisture 5-15%, oil 5-20%, protein 5-30%, starch 50-75%, and density 1.0-1.3%.<br>Soybean - moisture 5-15%, oil 15-25%, and protein 35-50%. |

TABLE 21

Kernel Protein Content of Transgenic plant seeds in Midwest Hybrid Trials in 2003, 2004, and 2005.

| | | | Hybrid 2003 | | | | Hybrid 2004 | | | | Hybrid 2005 | | | |
|---|---|---|---|---|---|---|---|---|---|---|---|---|---|---|
| PEP SEQ ID | Construct | Event | Mean Transgenic | Mean Control[a] | % Change | Pvalue | Mean Transgenic | Mean Control[a] | % Change | Pvalue | Mean Transgenic | Mean Control[b] | % Change | Pvalue |
| 84 | PMON69462 | ZM_M17475 | 9.2 | 8.7 | 6.9 | 0.00 | 8.8 | 8.1 | 8.8 | 0.00 | 9.5 | 9.0 | 6.4 | 0.00 |
| | PMON69462 | ZM_M17512 | 9.4 | 8.7 | 8.0 | 0.00 | 8.9 | 8.1 | 10.3 | 0.00 | 9.6 | 9.0 | 6.8 | 0.00 |
| | PMON69462 | ZM_M19779 | 8.6 | 8.7 | −1.1 | 0.37 | 8.0 | 8.1 | −1.8 | 0.20 | — | — | — | — |
| | PMON69462 | ZM_M19792 | 8.9 | 8.7 | 2.3 | 0.17 | 8.1 | 8.1 | −0.1 | 0.92 | — | — | — | — |
| | PMON69462 | ZM_M19775 | 8.5 | 8.7 | −2.3 | 0.17 | 8.0 | 8.1 | −1.4 | 0.32 | — | — | — | — |
| | PMON69462 | ZM_M19755 | — | — | — | — | 8.1 | 8.1 | 0.3 | 0.83 | 8.7 | 9.0 | −2.5 | 0.09 |
| | PMON69462 | ZM_M19263 | — | — | — | — | 7.9 | 8.1 | −2.1 | 0.12 | — | —_ | — | — |
| | PMON69462 | ZM_M19752 | — | — | — | — | 8.1 | 8.1 | 0.0 | 0.97 | — | — | — | — |
| 126 | PMON83769 | ZM_M75771 | — | — | — | — | — | — | — | — | 9.6 | 9.1 | 5.9 | 0.00 |
| | PMON83769 | ZM_M73623 | — | — | — | — | — | — | — | — | 9.1 | 9.1 | 0.2 | 0.92 |
| | PMON83769 | ZM_M73624 | — | — | — | — | — | — | — | — | 9.8 | 9.1 | 7.7 | 0.00 |
| | PMON83769 | ZM_M74392 | — | — | — | — | — | — | — | — | 9.6 | 9.1 | 5.0 | 0.00 |
| | PMON83769 | ZM_M74394 | — | — | — | — | — | — | — | — | 9.9 | 9.1 | 8.8 | 0.00 |
| | PMON83769 | ZM_M74395 | — | — | — | — | — | — | — | — | 9.5 | 9.1 | 4.5 | 0.01 |
| | PMON83769 | ZM_M75255 | — | — | — | — | — | — | — | — | 9.8 | 9.1 | 8.0 | 0.00 |
| | PMON83769 | ZM_M75260 | — | — | — | — | — | — | — | — | 9.5 | 9.1 | 4.1 | 0.01 |

TABLE 21-continued

Kernel Protein Content of Transgenic plant seeds in Midwest Hybrid Trials in 2003, 2004, and 2005.

| | | | Hybrid 2003 | | | | Hybrid 2004 | | | | Hybrid 2005 | | | |
|---|---|---|---|---|---|---|---|---|---|---|---|---|---|---|
| PEP SEQ ID | Construct | Event | Mean Trans-genic | Mean Control[a] | % Change | Pval-ue | Mean Trans-genic | Mean Control[a] | % Change | Pva-lue | Mean Trans-genic | Mean Control[b] | % Change | Pval-ue |
| 124 | PMON80868 | ZM_M59335 | — | — | — | — | — | — | — | — | 9.2 | 9.0 | 2.1 | 0.24 |
| | PMON80868 | ZM_M59391 | — | — | — | — | — | — | — | — | 9.3 | 9.0 | 3.0 | 0.10 |
| | PMON80868 | ZM_M59764 | — | — | — | — | — | — | — | — | 9.0 | 9.0 | 0.0 | 0.98 |

Kernel protein reported on a 100% dry matter basis

[a]Control for 2003 and 2004 was recurrent parent

[b]Control for 2005 trial was pollinator for pMON69462 and recurrent parent for pMON83769 and pMON80868

TABLE 22

Kernel Protein Content of Transgenic plant seeds in Hawaii Inbred Trials[a]

| PEP SEQ ID | Construct | Event | Year | Mean Transgenic | Mean Control[b] | % Change | Pvalue |
|---|---|---|---|---|---|---|---|
| 84 | PMON69462 | ZM_M17475 | 2002 | 14.2 | 10.7 | 32.7 | 0.02 |
| | PMON69462 | ZM_M17512 | 2002 | 12.6 | 11.8 | 6.8 | 0.10 |
| | PMON69462 | ZM_M19779 | 2002 | 11.4 | 10.7 | 6.5 | 0.10 |
| | PMON69462 | ZM_M19792 | 2002 | 12.5 | 11.6 | 7.8 | 0.10 |
| | PMON69462 | ZM_M19775 | 2002 | 12.9 | 11.9 | 8.4 | 0.10 |
| | PMON69462 | ZM_M19755 | 2003 | 12.0 | 11.3 | 6.4 | 0.44 |
| | PMON69462 | ZM_M19263 | 2003 | 10.8 | 11.0 | −2.2 | 0.77 |
| | PMON69462 | ZM_M19752 | 2003 | 11.1 | 11.9 | −7.0 | 0.23 |
| | PMON69462 | ZM_M19270 | 2002 | 13.0 | 10.5 | 23.8 | 0.02 |
| | PMON69462 | ZM_M19781 | 2002 | 12.4 | 10.3 | 20.4 | 0.02 |
| | PMON69462 | ZM_M19257 | 2003 | 12.7 | 11.4 | 11.4 | 0.30 |
| 126 | PMON83769 | ZM_M73624 | 2004 | 13.4 | 9.4 | 42.9 | 0.00 |
| | PMON83769 | ZM_M74380 | 2004 | 11.9 | 11.7 | 1.4 | 0.88 |
| | PMON83769 | ZM_M74392 | 2004 | 10.7 | 12.0 | −10.5 | 0.21 |
| | PMON83769 | ZM_M74394 | 2004 | 11.8 | 10.7 | 10.5 | 0.05 |
| | PMON83769 | ZM_M74395 | 2004 | 13.6 | 11.8 | 14.8 | 0.00 |
| | PMON83769 | ZM_M75255 | 2004 | 12.5 | 11.0 | 13.2 | 0.27 |
| | PMON83769 | ZM_M75771 | 2004 | 12.3 | 12.5 | −2.2 | 0.83 |
| 124 | PMON80868 | ZM_M59335 | 2004 | 13.3 | 12.1 | 10.4 | 0.07 |
| | PMON80868 | ZM_M59764 | 2004 | 12.8 | 11.5 | 10.8 | 0.27 |
| | PMON80868 | ZM_M59765 | 2004 | 13.7 | 11.8 | 15.5 | 0.00 |

[a]Kernel protein reported on a 100% dry matter basis

[b]Control was negative isoline for each event

EXAMPLE 6

This example illustrates the preparation of transgenic plant cells containing recombinant DNA (SEQ ID NO:82) expressing a maize phytochrome A protein (PHYA). A full-length cDNA encoding a corn PHYA protein was cloned from corn. The cDNA clone contained 3396 bp of nucleotides encoding a 1131 amino acid PHYA protein with molecular weight at 125.2 kD. Based on the cDNA sequences, primers were designed to clone a genomic DNA, illustrated in FIG. 1, from a maize inbred LH172 genomic library. Recombinant DNA comprising a rice actin promoter operably linked to the genomic DNA encoding the corn PHYA protein followed by a Hsp17 terminator was inserted into transformation vector of pMON74916 as set forth in SEQ ID NO:10030. Corn plant cells were transformed with recombinant DNA expressing PHA using pMON74916 and used to regenerate a population of transgenic plants. Transgenic plants were regenerated from about 100 events of transformed plant cells; plants from 90 of the events with various expression levels were selected for pollination to produce R1 and F1 seeds; and plants from 31 events were selected for screening for an enhanced trait.

Seed Germination and Seedling Development

Five events were selected to be analyzed phenotypic effect on seed germination and seedling development in the dark condition along with other transgenic material. 12 inbred seeds of each wild-type and transgenic maize events were germinated in a wetted and rolled germination paper in a complete dark growth chamber for 10 days. The length of mesocotyl, coleoptiles and root were measured for every seedling. The transgenic maize seedlings were identified showing great elongation growth of both mesocotyl and expanded coleoptiles imparted from recombinant DNA expressing PHYA protein as compared to non-transgenic controls.

Density Study

Transgenic plants were grown in fields at three densities: high density at 42,000 plants per acre; medium density at 35,000 plants per acre; and low density at 28,000 plants per acre. Plants from three plant cell events expressing PHYA were selected for studying physiological and yield responses to different densities. The physiological data from the density trial YI130 is summarized in the Table 23 shown below. Event ZM_S83483 under high planting density showed significant decrease in plant height, ear height, and internode length and had a significant increase in chlorophyll content.

TABLE 23

| Event ID | Low Density YI130 JV 2004 Plant Height | Low Density YI130 JV 2004 Ear Height | Low Density YI130 JV 2004 Stem Diameter | Low Density YI130 JV 2004 Internode Length | High Density YI130 JV 2004 Plant Height | High Density YI130 JV 2004 Ear Height | High Density YI130 JV 2004 Internode Length | High Density YI130 JV 2004 SPAD | High Density YI130 JV 2004 Photo rate |
|---|---|---|---|---|---|---|---|---|---|
| ZM_S83483 | not significant P = 0.727 | Significant Decrease P = 0.085 | not significant P = 0.9436 | Significant Decrease P = 0.0370 | not significant P = 0.5866 | Significant Decrease P = 0.0185 | increase not significant P = 0.2412 | Significant Increase P = 0.0762 | NA |
| ZM_S83897 | not significant P = 0.8778 | decrease not significant P = 0.1937 | not significant P = 0.2517 | Significant Increase P = 0.0421 | Significant Decrease P = 0.0306 | not significant P = 0.6542 | not significant P = 0.5206 | Significant Decrease P = 0.0153 | Significant Decrease |
| ZM_S83907 | Highly Significant Increase P = 0.0021 | increase not significant P = 0.2426 | Significant Increase P = 0.0633 | Highly Significant Increase P = 0.001 | Significant Increase P = 0.0016 | Significant Increase P = 0.015 | not significant P = 0.89 | increase not significant P = 0.3208 | not significant |

Kernel Trait Analysis

As shown in Table 24, events ZM_S83444 ZM_S83446, ZM_S83473, ZM_S83480, ZM_S83483, and ZM_S83907 show significant increases in single kernel weight. Event ZM_S83452 shows significant increases in single kernel weight and total kernel weight. The screening data show that plant cells with stably-integrated, non-natural, recombinant DNA expressing a phytochrome A protein can be regenerated into plants exhibiting increased yield as compared to control plants.

| event | Trait | Mean_TRAN | Mean_CON | TRAN-CON | % change | Pvalue | Result |
|---|---|---|---|---|---|---|---|
| ZM_S83416 | Total kernel weight, g | 151.3 | 140.21 | 11.09 | 8 | 0.1452 | Non Signifincant |
| | Total kernel number | 876 | 830.22 | 45.78 | 6 | 0.3118 | Non Signifincant |
| | Singel kernel weight, g | 0.17 | 0.17 | 0.01 | 6 | 0.3551 | Non Signifincant |
| ZM_S83444 | Total kernel weight, g | 147.14 | 144.65 | 2.49 | 2 | 0.753 | Non Signifincant |
| | Total kernel number | 664.38 | 930.47 | −266.1 | −29 | 0 | Highly Significant |
| | Singel kernel weight, g | 0.25 | 0.16 | 0.09 | 56 | 0 | Highly Significant |
| ZM_S83446 | Total kernel weight, g | 152.12 | 158.27 | −6.15 | −4 | 0.3931 | Non Signifincant |
| | Total kernel number | 718.88 | 918.94 | −200.07 | −22 | 0 | Highly Significant |
| | Singel kernel weight, g | 0.2 | 0.17 | 0.03 | 18 | 0.0008 | Highly Significant |
| ZM_S83452 | Total kernel weight, g | 166.94 | 140.21 | 26.72 | 19 | 0.0014 | Highly Significant |
| | Total kernel number | 888.89 | 830.22 | 58.67 | 7 | 0.2123 | Non Signifincant |
| | Singel kernel weight, g | 0.19 | 0.17 | 0.02 | 12 | 0.0045 | Highly Significant |
| ZM_S83473 | Total kernel weight, g | 145.87 | 146.47 | −0.6 | −0 | 0.9451 | Non Signifincant |
| | Total kernel number | 784.71 | 885.21 | −100.5 | −11 | 0.0099 | Highly Significant |
| | Singel kernel weight, g | 0.18 | 0.16 | 0.02 | 13 | 0.0618 | Signifincant at 10% |
| ZM_S83480 | Total kernel weight, g | 157.23 | 149.44 | 7.79 | 5 | 0.3769 | Non Signifincant |
| | Total kernel number | 856.67 | 924.28 | −67.61 | −7 | 0.0982 | Signifincant at 10% |
| | Singel kernel weight, g | 0.18 | 0.16 | 0.02 | 13 | 0.0018 | Highly Significant |
| ZM_S83483 | Total kernel weight, g | 164.86 | 158.27 | 6.6 | 4 | 0.3599 | Non Signifincant |
| | Total kernel number | 820.4 | 918.94 | −98.54 | −11 | 0.0165 | Significant |
| | Singel kernel weight, g | 0.19 | 0.17 | 0.02 | 12 | 0.0317 | Significant |
| ZM_S83897 | Total kernel weight, g | 132.62 | 149.44 | −16.83 | −11 | 0.0617 | Signifincant at 10% |
| | Total kernel number | 743.5 | 924.28 | −180.78 | −20 | 0.0001 | Highly Significant |
| | Singel kernel weight, g | 0.18 | 0.16 | 0.02 | 13 | 0.0125 | Significant |
| ZM_S83907 | Total kernel weight, g | 146.23 | 146.47 | −0.24 | −0 | 0.9807 | Non Signifincant |
| | Total kernel number | 733.44 | 833.41 | −99.97 | −12 | 0.0703 | Signifincant at 10% |
| | Singel kernel weight, g | 0.19 | 0.17 | 0.02 | 12 | 0.0792 | Signifincant at 10% |
| ZM_S83416 | Total kernel weight, g | 157.3 | 146.47 | 10.83 | 7 | 0.2666 | Non Signifincant |
| | Total kernel number | 881.8 | 833.41 | 48.39 | 6 | 0.3558 | Non Signifincant |
| | Singel kernel weight, g | 0.18 | 0.17 | 0 | 0 | 0.6827 | Non Signifincant |

EXAMPLE 7

This example illustrates the preparation of transgenic plant cells containing recombinant DNA (SEQ ID NO:77) expressing a soybean MADS box transcription factor protein and identified as G 1760.

The DNA encoding the soybean MADS box transcription factor was cloned from a soybean library and inserted into a recombinant DNA construct comprising a CaMV 35S promoter operably linked to the DNA encoding the transcription factor followed by a terminator. The recombinant DNA construct was inserted into a transformation vector plasmid to produce plasmid pMON74470, as set forth in SEQ ID NO: 10029 which was used for *Agrobacterium*-mediated transformation of soybean plant cells.

Soybean plant cells were transformed with recombinant DNA expressing the MADS box transcription factor using MON74470 and used to regenerate a population of transgenic plants. Transgenic soybean plants were regenerated and selected for screening for an enhanced trait.

Transgenic soybean plants exhibited flowers with highly enlarged sepals and a winding stem. The main stem exhibited reduced lateral branching and increased raceme formation. Flowering time was decreased by about 2 to 4 days as compared to control plants under short day (10 hr) and long day (14 hr) conditions. Transgenic plants also flowered by 5 weeks when placed under non-inductive 20 hr light; wild-type control plants did not flower under such conditions. Floral and pod abscission was greatly reduced in the transgenic plants resulting in an increase in the number of pods per plant. Wild type control plants produced on the order of 100 pods, specific transgenic plants produced at least 125 pods per plant and plants regenerated from plant cells of one transgenic event produced greater than 200 pods per plant. There was also a delay in maturity ranging from one week exhibited by plants from single copy event A29204 to a month exhibited by plants from a multi-copy event A28877. Over 95% of the pods on transgenic plants from event A29204 mature in a time period; but only 50% of the pods on transgenic plants from event A28877 mature in the same time period. Seeds from transgenic plants were smaller than seed from control plants and greater in number than seeds from control plants, e.g. about 1800 more seed per pound. Transgenic plants were also shown to be have enhanced water use efficiency.

In testing soybeans for drought tolerance, 4.5" pots were prepared with Metromix 200 and the pots were adjusted to the same weight. Pots were saturated with water. R2 or R3 homozygous seeds were placed in the soil in the pots, 15 pots per event, 3 to 6 events per construct. Plants were grown with a light intensity of 600 $\mu EM^{-2}S^{-1}$; Temperature: 28° C.; Relative humidity (RH): 60%. A gene check with gene check strip (Trait RUR Lateral Flow 50 tests, from Strategic Diagnostics, Inc.) for the presence of the CP4 gene was done on selected plants. Unwanted negative plants were discarded. When plants reached the V1 stage. Pots were saturated with water by thorough irrigation. A picture was taken of the plant in the water saturated pot. Excess water was drained and further water was withheld until the pot water content of 50% and 10% of the water capacity for well watered controls and drought treated plants, respectively (monitor the water content by measuring soil moisture or pot weight every 3-5 days). At approximately 10% of the saturated water weight, the plants began to show the onset of the wilting phenotype. Limited-watering was continued every 1-2 days to maintain pot water content at 50 or 10%. The drought injury phenotype was determined for next 14 days (see the table of measurements). Photograph of plants and physiological assays were run on each at 14 days after the onset of drought treatment. Theses included, but were not limited to, plant height, leaf relative water content, leaf water potential, chlorophyll content and chlorophyll fluorescence. Pot were saturated with nutrient solution and resume regular watering schedule after 14 days.

TABLE 25

| Measurement | Protocol |
|---|---|
| Agronomic measurements | Emergence, early season vigor, height (cm) |
| Visual drought score | Score of 1 to 4: 1. Healthy plants, no difference from control plants; 2. On sight of wilting, leaves become wilt; 3. Wilted plants, still green and recoverable; 4. Severely wilted, chlorotic and not recoverable |

Drought assay measurements as described in Table 25 taken on transgenic soybean plants showed that transgenic soybean plants from transgenic plant cells of event GM 29204 exhibited enhanced water use efficiency.

R0 plants regenerated from one transgenic plant cell event (28877) of 41 transgenic plant cells events produced a large number of pods per node and seeds/plant−531 R1 seeds per plant compared to an average of 150 seeds per plant, i.e. increased yield.

EXAMPLE 6

Consensus Sequence

This example illustrates the identification of consensus amino acid sequence for the proteins and homologs encoded by DNA that is used to prepare the transgenic seed and plants of this invention having enhanced agronomic traits.

ClustalW program was selected for multiple sequence alignments of the amino acid sequence of SEQ ID NO: 136 and its nine homologs, and SEQ ID NO: 151 and its 11 homologs. Three major factors affecting the sequence alignments dramatically are (1) protein weight matrices; (2) gap open penalty; (3) gap extension penalty. Protein weight matrices available for ClustalW program include Blosum, Pam and Gonnet series. Those parameters with gap open penalty and gap extension penalty were extensively tested. On the basis of the test results, Blosum weight matrix, gap open penalty of 10 and gap extension penalty of 1 were chosen for multiple sequence alignment. FIG. 2 shows the sequences of SEQ ID NO: 136, its homologs and the consensus sequence (SEQ ID NO: 10031) at the end. FIG. 3 shows the sequences of SEQ ID NO: 151, its homologs and the consensus sequence (SEQ ID NO: 10032) at the end. The symbols for consensus sequence are (1) uppercase letters for 100% identity in all positions of multiple sequence alignment output; (2) lowercase letters for >=70% identity; symbol; (3) "X" indicated <70% identity; (4) dashes "-" meaning that gaps were in >=70% sequences.

The consensus amino acid sequence can be used to identify DNA corresponding to the full scope of this invention that is useful in providing transgenic plants, for example corn and soybean plants with enhanced agronomic traits, for example improved nitrogen use efficiency, improved yield, improved water use efficiency and/or improved growth under cold stress, due to the expression in the plants of DNA encoding a protein with amino acid sequence identical to the consensus amino acid sequence.

EXAMPLE 7

Identification of Amino Acid Domain by Pfam Analysis

The amino acid sequence of the expressed proteins that were shown to be associated with an enhanced trait were analyzed for Pfam protein family against the current Pfam collection of multiple sequence alignments and hidden Markov models using the HMMER software in the appended computer listing. The Pfam protein families for the proteins of SEQ ID NO:84 through 166 are shown in Table 26. The Hidden Markov model databases for the identified patent families are also in the appended computer listing allowing identification of other homologous proteins and their cognate encoding DNA to enable the full breadth of the invention for a person of ordinary skill in the art. Certain proteins are identified by a single Pfam domain and others by multiple Pfam domains. For instance, the protein with amino acids of SEQ ID NO: 91 is characterized by two Pfam domains, i.e. SRF-TF and K-box; and, the protein with amino acids of SEQ ID NO:165 is characterized by six Pfam domains, i.e. GAF, Phytochrome, PAS, a repeated PAS, HisKA, and HATPase.

TABLE 26

| NUC SEQ ID | PEP SEQ ID | Pfam domain name | begin | stop | score | E-value |
|---|---|---|---|---|---|---|
| 3 | 86 | Pkinase | 79 | 337 | 343 | 4.30E−100 |
| 5 | 88 | FA_desaturase | 99 | 319 | 206.2 | 6.60E−59 |
| 2 | 85 | Ras | 10 | 178 | 297.9 | 1.60E−86 |
| 1 | 84 | Glyoxalase | 27 | 171 | 130.1 | 5.40E−36 |
| 8 | 91 | SRF-TF | 9 | 59 | 121.4 | 2.30E−33 |
| 8 | 91 | K-box | 75 | 176 | 151.7 | 1.70E−42 |
| 7 | 90 | K-box | 4 | 104 | 145.6 | 1.20E−40 |
| 83 | 166 | SRF-TF | 9 | 59 | 99.2 | 1.10E−26 |
| 83 | 166 | K-box | 75 | 172 | 92.4 | 1.20E−24 |
| 82 | 165 | GAF | 219 | 404 | 105.6 | 1.30E−28 |
| 82 | 165 | Phytochrome | 415 | 595 | 407.6 | 1.60E−119 |
| 82 | 165 | PAS | 622 | 738 | 88.9 | 1.40E−23 |
| 82 | 165 | PAS | 753 | 878 | 101.1 | 2.80E−27 |
| 82 | 165 | HisKA | 898 | 957 | 27.6 | 4.00E−05 |
| 82 | 165 | HATPase_c | 1012 | 1124 | 66.9 | 5.80E−17 |
| 9 | 92 | Homeobox | 97 | 158 | 68 | 2.80E−17 |
| 10 | 93 | AP2 | 5 | 68 | 127.5 | 3.30E−35 |
| 11 | 94 | GATA | 196 | 231 | 71.3 | 2.70E−18 |
| 12 | 95 | AT_hook | 57 | 69 | 7.4 | 1.1 |
| 12 | 95 | DUF296 | 84 | 208 | 183.6 | 4.30E−52 |
| 24 | 107 | Synaptobrevin | 128 | 215 | 137.6 | 2.90E−38 |
| 31 | 114 | Pyridoxal_deC | 28 | 381 | 194.6 | 2.10E−55 |
| 36 | 119 | Metallophos | 63 | 258 | 161 | 2.80E−45 |
| 21 | 104 | Pkinase | 12 | 267 | 346 | 5.40E−101 |
| 21 | 104 | Pkinase_Tyr | 12 | 265 | 88.5 | 1.80E−23 |
| 21 | 104 | NAF | 310 | 369 | 98.6 | 1.60E−26 |
| 26 | 109 | MtN3_slv | 9 | 98 | 96.7 | 6.10E−26 |
| 26 | 109 | MtN3_slv | 132 | 218 | 116.8 | 5.70E−32 |
| 27 | 110 | Lactamase_B | 94 | 252 | 125.1 | 1.80E−34 |
| 33 | 116 | HSP20 | 53 | 157 | 159.9 | 5.80E−45 |
| 28 | 111 | RTC | 3 | 353 | 275.2 | 1.10E−79 |
| 28 | 111 | RTC_insert | 184 | 300 | 120.8 | 3.40E−33 |
| 37 | 120 | PDZ | 200 | 284 | 37.6 | 3.80E−08 |
| 37 | 120 | Peptidase_S41 | 320 | 483 | 244.5 | 1.90E−70 |
| 35 | 118 | E2F_TDP | 167 | 232 | 131 | 2.90E−36 |
| 41 | 124 | Pkinase | 63 | 341 | 199.5 | 7.00E−57 |
| 41 | 124 | Pkinase_Tyr | 63 | 341 | 243 | 5.60E−70 |
| 43 | 126 | zf-C2H2 | 72 | 94 | 25.6 | 0.00016 |
| 43 | 126 | zf-C2H2 | 149 | 171 | 20.5 | 0.0054 |
| 4 | 87 | zf-C2H2 | 85 | 107 | 22.1 | 0.0018 |
| 17 | 100 | PRA1 | 10 | 161 | 181.8 | 1.50E−51 |
| 22 | 105 | AAA | 154 | 352 | 85 | 2.10E−22 |
| 14 | 97 | CBFD_NFYB_HMF | 31 | 96 | 134.4 | 2.80E−37 |
| 34 | 117 | Peptidase_C15 | 11 | 219 | −72.2 | 3.50E−07 |
| 20 | 103 | Pkinase | 13 | 267 | 345.5 | 7.80E−101 |
| 20 | 103 | Pkinase_Tyr | 13 | 265 | 75.2 | 1.80E−19 |
| 20 | 103 | NAF | 312 | 371 | 104.7 | 2.50E−28 |
| 32 | 115 | HSF_DNA-bind | 49 | 225 | 212.2 | 1.00E−60 |
| 19 | 102 | Pkinase | 37 | 291 | 353.9 | 2.30E−103 |
| 19 | 102 | RIO1 | 50 | 208 | −88.1 | 0.0038 |
| 19 | 102 | NAF | 375 | 432 | 101.8 | 1.80E−27 |
| 40 | 123 | Aldo_ket_red | 7 | 284 | 448.1 | 1.00E−131 |
| 42 | 125 | FBPase | 13 | 337 | 691.6 | 5.30E−205 |
| 6 | 89 | SRF-TF | 9 | 59 | 119.7 | 7.20E−33 |
| 18 | 101 | DNA_photolyase | 6 | 173 | 163.3 | 5.70E−46 |
| 18 | 101 | FAD_binding_7 | 205 | 476 | 425.8 | 5.50E−125 |
| 30 | 113 | Pkinase | 41 | 327 | 326.6 | 3.80E−95 |
| 23 | 106 | NIF | 95 | 291 | 90.6 | 4.10E−24 |
| 15 | 98 | Got1 | 30 | 130 | 237 | 3.60E−68 |
| 16 | 99 | RRM_1 | 21 | 89 | 67.1 | 5.00E−17 |
| 29 | 112 | Di19 | 13 | 206 | 365.4 | 8.00E−107 |
| 25 | 108 | CorA | 90 | 467 | 408.2 | 1.00E−119 |
| 39 | 122 | SPC25 | 12 | 190 | 252.3 | 9.00E−73 |
| 44 | 127 | Response_reg | 18 | 139 | 151.1 | 2.60E−42 |
| 44 | 127 | HisKA | 320 | 385 | 101.5 | 2.30E−27 |
| 44 | 127 | HATPase_c | 432 | 565 | 138.4 | 1.70E−38 |
| 44 | 127 | Response_reg | 740 | 862 | 128 | 2.40E−35 |
| 44 | 127 | Hpt | 922 | 1013 | 63.4 | 6.60E−16 |
| 45 | 128 | Response_reg | 18 | 139 | 151.1 | 2.60E−42 |
| 45 | 128 | HisKA | 320 | 385 | 101.5 | 2.30E−27 |
| 45 | 128 | HATPase_c | 432 | 565 | 138.4 | 1.70E−38 |
| 45 | 128 | Response_reg | 740 | 862 | 128 | 2.40E−35 |
| 45 | 128 | Hpt | 922 | 1013 | 63.4 | 6.60E−16 |
| 46 | 129 | NAM | 9 | 135 | 313.7 | 2.90E−91 |
| 47 | 130 | Aminotran_1_2 | 183 | 576 | 55.7 | 1.40E−13 |
| 48 | 131 | Catalase | 18 | 401 | 960.1 | 7.80E−286 |
| 49 | 132 | BRO1 | 10 | 172 | 177.8 | 2.40E−50 |
| 69 | 152 | Got1 | 30 | 130 | 211.8 | 1.40E−60 |

TABLE 26-continued

| NUC SEQ ID | PEP SEQ ID | Pfam domain name | begin | stop | score | E-value |
|---|---|---|---|---|---|---|
| 70 | 153 | Got1 | 30 | 130 | 174.9 | 1.80E−49 |
| 71 | 154 | Cystatin | 36 | 124 | 87.6 | 3.40E−23 |
| 72 | 155 | Cystatin | 36 | 124 | 87.6 | 3.40E−23 |
| 73 | 156 | RRM_1 | 22 | 87 | 32.4 | 1.40E−06 |
| 74 | 157 | Pkinase_Tyr | 55 | 304 | 86.2 | 9.10E−23 |
| 74 | 157 | Pkinase | 55 | 306 | 362 | 8.40E−106 |
| 75 | 158 | SPX | 1 | 167 | 88.9 | 1.30E−23 |
| 75 | 158 | zf-C3HC4 | 238 | 286 | 17 | 0.0024 |
| 76 | 159 | Pkinase_Tyr | 19 | 271 | 70.8 | 4.00E−18 |
| 76 | 159 | Pkinase | 19 | 273 | 359.7 | 4.10E−105 |
| 76 | 159 | NAF | 324 | 381 | 105.6 | 1.30E−28 |
| 77 | 160 | SRF-TF | 9 | 59 | 100.8 | 3.60E−27 |
| 77 | 160 | K-box | 73 | 173 | 95.3 | 1.60E−25 |
| 50 | 133 | Peptidase_S10 | 1 | 227 | −42.7 | 6.00E−11 |
| 51 | 134 | Ank | 44 | 76 | 47.3 | 4.70E−11 |
| 51 | 134 | Ank | 77 | 109 | 33.5 | 6.40E−07 |
| 51 | 134 | Ank | 111 | 144 | 15.7 | 0.14 |
| 51 | 134 | Ank | 185 | 217 | 39.7 | 9.00E−09 |
| 51 | 134 | Ank | 228 | 260 | 30.7 | 4.50E−06 |
| 52 | 135 | Pkinase_Tyr | 51 | 341 | 158.7 | 1.40E−44 |
| 52 | 135 | Pkinase | 63 | 341 | 104.4 | 3.00E−28 |
| 54 | 137 | GATase_2 | 2 | 162 | 11.8 | 6.10E−12 |
| 54 | 137 | Asn_synthase | 211 | 479 | 334.3 | 1.80E−97 |
| 55 | 138 | HSP20 | 56 | 164 | 168.2 | 1.90E−47 |
| 78 | 161 | Lactamase_B | 93 | 251 | 129 | 1.20E−35 |
| 56 | 139 | UPF0057 | 11 | 62 | 102.9 | 8.40E−28 |
| 57 | 140 | Oxidored_FMN | 6 | 341 | 302.1 | 9.10E−88 |
| 58 | 141 | Pkinase | 39 | 325 | 309.2 | 6.40E−90 |
| 59 | 142 | Pyridoxal_deC | 33 | 381 | 546 | 3.40E−161 |
| 60 | 143 | Pyridoxal_deC | 33 | 381 | 546 | 3.40E−161 |
| 61 | 144 | HSP20 | 57 | 160 | 178.8 | 1.20E−50 |
| 38 | 121 | PDZ | 200 | 284 | 37.6 | 3.80E−08 |
| 38 | 121 | Peptidase_S41 | 320 | 483 | 244.5 | 1.90E−70 |
| 62 | 145 | Cpn60_TCP1 | 59 | 562 | 578.6 | 5.40E−171 |
| 63 | 146 | DSPc | 50 | 188 | 142.9 | 7.70E−40 |
| 64 | 147 | Isoamylase_N | 61 | 149 | 94.9 | 2.10E−25 |
| 64 | 147 | Alpha-amylase | 209 | 589 | −36.4 | 1.30E−07 |
| 79 | 162 | Pkinase | 45 | 299 | 360.3 | 2.80E−105 |
| 79 | 162 | NAF | 384 | 441 | 105.2 | 1.70E−28 |
| 65 | 148 | DUF1685 | 38 | 146 | 184.5 | 2.40E−52 |
| 80 | 163 | GAF | 219 | 404 | 108.4 | 1.90E−29 |
| 80 | 163 | Phytochrome | 415 | 595 | 409.1 | 5.70E−120 |
| 80 | 163 | PAS | 622 | 737 | 96.6 | 6.50E−26 |
| 80 | 163 | PAS | 752 | 877 | 107.4 | 3.80E−29 |
| 80 | 163 | HisKA | 897 | 956 | 26.7 | 7.10E−05 |
| 80 | 163 | HATPase_c | 1011 | 1123 | 64.4 | 3.30E−16 |
| 66 | 149 | Glyco_hydro_1 | 74 | 558 | 1024.9 | 0 |
| 67 | 150 | ArfGap | 17 | 133 | 174.4 | 2.50E−49 |
| 81 | 164 | AP2 | 6 | 69 | 132 | 1.50E−36 |

TABLE 27

| pfam domain name | accession number | gathering cutoff | domain description |
|---|---|---|---|
| AAA | PF00004.17 | 10 | ATPase family associated with various cellular activities (AAA) |
| AP2 | PF00847.9 | 0 | AP2 domain |
| Aldo_ket_red | PF00248.10 | −97 | Aldo/keto reductase family |
| Alpha-amylase | PF00128.11 | −93 | Alpha amylase, catalytic domain |
| Aminotran_1_2 | PF00155.9 | −57.5 | Aminotransferase class I and II |
| Ank | PF00023.17 | 21.6 | Ankyrin repeat |
| ArfGap | PF01412.8 | −17 | Putative GTPase activating protein for Arf |
| Asn_synthase | PF00733.10 | −52.8 | Asparagine synthase |
| BRO1 | PF03097.6 | 25 | BRO1-like domain |
| CBFD_NFYB_HMF | PF00808.12 | 18.4 | Histone-like transcription factor (CBF/NF-Y) and archaeal histone |
| Catalase | PF00199.8 | −229 | Catalase |
| CorA | PF01544.8 | −61.3 | CorA-like Mg2+ transporter protein |
| Cpn60_TCP1 | PF00118.13 | −223.4 | TCP-1/cpn60 chaperonin family |
| Cystatin | PF00031.10 | 17.5 | Cystatin domain |
| DNA_photolyase | PF00875.7 | −10 | DNA photolyase |
| DSPc | PF00782.9 | −21.8 | Dual specificity phosphatase, catalytic domain |

TABLE 27-continued

| pfam domain name | accession number | gathering cutoff | domain description |
|---|---|---|---|
| DUF1685 | PF07939.1 | 25 | Protein of unknown function (DUF1685) |
| DUF296 | PF03479.4 | −11 | Domain of unknown function (DUF296) |
| Di19 | PF05605.2 | 25 | Drought induced 19 protein (Di19) |
| E2F_TOP | PF02319.9 | 17 | E2F/DP family winged-helix DNA-binding domain |
| FAD_binding_7 | PF03441.3 | 25 | FAD binding domain of DNA photolyase |
| FA_desaturase | PF00487.13 | −46 | Fatty acid desaturase |
| FBPase | PF00316.9 | −170.3 | Fructose-1-6-bisphosphatase |
| GAF | PF01590.14 | 23 | GAF domain |
| GATA | PF00320.15 | 28.5 | GATA zinc finger |
| GATase_2 | PF00310.10 | −106.2 | Glutamine amidotransferases class-II |
| Glyco_hydro_1 | PF00232.8 | −301.8 | Glycosyl hydrolase family 1 |
| Glyoxalase | PF00903.14 | 12.1 | Glyoxalase/Bleomycin resistance protein/Dioxygenase superfamily |
| Got1 | PF04178.2 | 25 | Got1-like family |
| HATPase_c | PF02518.13 | 22.4 | Histidine kinase-, DNA gyrase B-, and HSP90-like ATPase |
| HSF_DNA-bind | PF00447.7 | −70 | HSF-type DNA-binding |
| HSP20 | PF00011.9 | 13 | Hsp20/alpha crystallin family |
| HisKA | PF00512.13 | 10.2 | His Kinase A (phosphoacceptor) domain |
| Homeobox | PF00046.17 | −4.1 | Homeobox domain |
| Hpt | PF01627.11 | 25 | Hpt domain |
| Isoamylase_N | PF02922.7 | −6.5 | Isoamylase N-terminal domain |
| K-box | PF01486.7 | 0 | K-box region |
| Lactamase_B | PF00753.15 | 22.3 | Metallo-beta-lactamase superfamily |
| Metallophos | PF00149.16 | 22 | Calcineurin-like phosphoesterase |
| MtN3_slv | PF03083.5 | −0.8 | MtN3/saliva family |
| NAF | PF03822.4 | 25 | NAF domain |
| NAM | PF02365.5 | −19 | No apical meristem (NAM) protein |
| NIF | PF03031.7 | −81 | NLI interacting factor-like phosphatase |
| Oxidored_FMN | PF00724.8 | −147.7 | NADH: flavin oxidoreductase/NADH oxidase family |
| PAS | PF00989.12 | 20 | PAS fold |
| PDZ | PF00595.11 | 12.1 | PDZ domain (Also known as DHR or GLGF) |
| PRA1 | PF03208.8 | 25 | PRA1 family protein |
| Peptidase_C15 | PF01470.7 | −100 | Pyroglutamyl peptidase |
| Peptidase_S10 | PF00450.11 | −198 | Serine carboxypeptidase |
| Peptidase_S41 | PF03572.7 | −25.8 | Peptidase family S41 |
| Phytochrome | PF00360.9 | 11 | Phytochrome region |
| Pkinase | PF00069.14 | −70.8 | Protein kinase domain |
| Pkinase_Tyr | PF07714.4 | 65 | Protein tyrosine kinase |
| Pyridoxal_deC | PF00282.8 | −158.6 | Pyridoxal-dependent decarboxylase conserved domain |
| RIO1 | PF01163.11 | −89.1 | RIO1 family |
| RRM_1 | PF00076.10 | 15.2 | RNA recognition motif, (a.k.a. RRM, RBD, or RNP domain) |
| RTC | PF01137.11 | −36.9 | RNA 3'-terminal phosphate cyclase |
| RTC_insert | PF05189.3 | 25 | RNA 3'-terminal phosphate cyclase (RTC), insert domain |
| Ras | PF00071.11 | 18 | Ras family |
| Response_reg | PF00072.11 | −14.4 | Response regulator receiver domain |
| SPC25 | PF06703.1 | 25 | Microsomal signal peptidase 25 kDa subunit (SPC25) |
| SPX | PF03105.9 | −20 | SPX domain |
| SRF-TF | PF00319.8 | 11 | SRF-type transcription factor (DNA-binding and dimerisation domain) |
| Synaptobrevin | PF00957.9 | 25 | Synaptobrevin |
| UPF0057 | PF01679.7 | 25 | Uncharacterized protein family UPF0057 |
| zf-C2H2 | PF00096.14 | 19 | Zinc finger, C2H2 type |
| zf-C3HC4 | PF00097.12 | 16.9 | Zinc finger, C3HC4 type (RING finger) |

EXAMPLE 8

Selection of Transgenic Plants with Enhanced Agronomic Trait(s)

This example illustrates the preparation and identification by selection of transgenic seeds and plants derived from transgenic plant cells of this invention where the plants and seed are identified by screening a having an enhanced agronomic trait imparted by expression of a protein selected from the group including the homologous proteins identified in Example 4, SEQ ID NO: 121, 128, 152-160, 162 and 164. Transgenic plant cells of corn, soybean, cotton, canola, wheat and rice are transformed with recombinant DNA for expressing each of the homologs identified in Example 4. Plants are regenerated from the transformed plant cells and used to produce progeny plants and seed that are screened for enhanced water use efficiency, enhanced cold tolerance, increased yield, enhanced nitrogen use efficiency, enhanced seed protein and enhanced seed oil. Plants are identified exhibiting enhanced traits imparted by expression of the homologous proteins.

SEQUENCE LISTING (10033 sequences)

SEQ ID NO: 1 - DNA, 558 bp, Glycine max
atggctgcggaacccaaggaatcgccttccaacaaccccggtctccatacaactcctgacgaagccaccaagggttacatcatgcaacaaactatgtttagaatcaaagaccccaaagtgagcctcgatttttattctcgagtcttgggcatgtctttgcttaagagattggattttccggagatgaagttcagcctgtacttcatgggctatgagaatacggcagaagctccaagtaatccaattgataaagtggtttggaccttttctcagaaggctacaattgaactgacacataattggggtactgaaagcgatccagagttcaaagggtaccacaatggcaattctgaacctcgtggctttggacacattggtgtaactgttgatgacacatacaaggcatgtgaaagatttcagaatctgggagttgagtttgttaagaaaccagaagatgggaaaatgaaaggtatagcatttattaaagatcctgatggatactggattgaaatctttgatcggaaaacaataggaaatgtaacacaaactgctgcttag

SEQ ID NO: 2 - DNA, 618 bp, Arabidopsis thaliana
atgccgtcccgtagacgtaccctcctcaaggtcatcatcctcggtgatagcggggtgggaaaaacctctttgatgaatcagtatgttaataaaaagttcagcaaccagtacaaggcaaccattggagccgacttcttgaccaaggaagtacagtttgaagatcgacttttcactttacagatctgggatacagctggacaggaaaggtttcagagccttggtgtagccttttaccgtggtgctgattgctgtgttcttgtatatgatgtcaattccatgaaatcatttgaaaatctgaacaactggagggaagaatttctgatccaggcgagtccatcagatccagagaattttccatttgttcttatcggaaacaaggttgacgtggatgatggaaacagcagagtggtttcagagaaaaaggctaaagcttggtgtgcttcaaaggggaacattccttactttgagacctctgccaaggtaggtactaatgtggaggaagctttccaatgcattgccaaggacgcattgaagagcggagaagaagaagaactatacttgccagacacaatcgatgtagggacgagcaatcaacagaggtctacagggtgtgaatgc

SEQ ID NO: 3 - DNA, 1038 bp, Zea mays
atggggaaccaatgcccaaacgggacccttgggagtgactactacaaccgccccgcttccaggttcgctgatggttgccttgaggacgatcgctactctgacttgaagaagtttgacaagccatggcctgaggtgaactcgtttaagcccactgctgttggtattttgaagaggggattggatccaacgtcaatcactgtccttgaaaggaagacggccgacgtaagggaacattatatcatcggtcggaggcttggtcaaggccagtttggcacaacattcctctgcaccgagatcagtacagggtgtgagtatgcatgcaagacaatcccaaagcgaaagctcatcaccaaggaggatgttgaggatgtgcgccgtgagatccagataatgcaccatttgtcaggccacaagaatgttgtttccatcaaggatgtatacgaggatgggcaggcggtgtatattgtgatggagctctgcgccggtggggagctctttgatcgaattcaggagaaagggcattacagcgaacagaaggctgcagatctcataagaatcattattagccttgtggctatgtgccattcacttggggttatgcaccgtgatctaaagccagaaaacttcctcctttgggataaagaagatgacctgtcaataaaagcaatcgattttggtctatctgtgttcttcaaaccaggtcaggttttcactgagctggttggaagtccatactacgttgctcctgaggtactacacaaacggtacggaccagaagcggatgtgtggtcagctggagtgatactgtatgttttgcttagcggggtgccacctttttgggcagagacgcaacaaggtatatttgatgctgtcttgaaggggcacattgattttgactcggacccatggcctaagatatctgaaagtgcaaagaatctcataaggaagatgctctgcccttgtccttcagagcgtctgaaagcccatgaagtactacgccatccttggatctgtgaaaatggagtggctactgattag

SEQ ID NO: 4 - DNA, 720 bp, Glycine max
atggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccacctccgtcaacaaccgccacgtcagccctccaccgccacagccacagccacagccgacaccagatccttccaccaagctcagttacaaatgctccgtttgcgacaagagcttcccctcttaccaagcgctcggtggacacaaggccagtcaccggaaactcgccgccgccgccgaagaccaaccccccagcaccaccacttcctccgccgccgccaccagctccgcctccggaggtaaggcccatgagtgctccatttgccacaaatccttccccaccggacaggcccttggcggacacaaacgttgtcactacgaaggtaacggtaacggaaataacaacaacagtaacagcgttgtcaccgtcgcctcggaaggcgtggggtccacccacactgtcagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaa

SEQ ID NO: 5 - DNA, 1023 bp, Synechococcus elongatus
atggcttctatgatatcctcttccgctgtgacaacagtcagccgtgcctctagggggcaatccgccgcagtggctccattcggcggcctcaaatccatgactggattcccagtgaagaaggtcaacactgacattacttccattacaagcaatggtggaagagtaaagtgcatgcctgcaggtcgacatatgacccttgctatccgacccaagcttgccttcaactggccgaccgccctgttcatggtcgccattcacattggagcactgttagcgttcctgccggccaactttaactggcccgctgtgggcgtgatggttgcgctgtattacattaccggttgttttggcatcaccctaggctggcaccggctaatttcgcaccgtagctttgaagttcccaaatggctggaatacgtgctggtgttctgtggcaccttggccatgcagcacggcccgatcgaatggatcggtctgcaccgccaccatcacctccactctgaccaagatgtcgatcaccacgactccaacaagggtttcctctggagtcacttcctgtggatgatctacgaaattccggcccgtacggaagtagacaagttcacgcgcgatatcgctggcgaccctgtctatcgcttctttaacaaatatttcttcggtgtccaagtcctactgggggtacttttgtacgcctggggcgaggcttgggttggcaatggctggtctttcgtcgtttgggggatcttcgcccgcttggtggtggtctaccacgtcacttggctggtgaacagtgctacccacaagtttggctaccgctcccatgagtctggcgaccagtccaccaactgctggtgggttgcccttctggcctttggtgaaggctggcacaacaaccaccacgcctaccagtactcggcacgtcatggcctgcagtggtgggaatttgacttgacttggttgatcatctgcggcctgaagaaggtgggtctggctcgcaagatcaaagtggcgtctccaaacaac

SEQ ID NO: 6 - DNA, 216 bp, Arabidopsis thaliana
atgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagct

SEQ ID NO: 7 - DNA, 498 bp, Oryza sativa
atggcaaacagtgacacctccaactctggcacagttgcagaagtcaatgcccagcactaccagcaggagtcctccaaactgcgccaacaaatcagtagcttacagaacgcaaacagtaggaccatagtgggggattctatcaacaccatgagcctcagggaccttaaacaggtagagaacaggctggagaaaggcatagctaagataagggctagaaagaatgagctgttatatgctgaagttgagtacatgcagaaaagggaagttgagctgcagaatgacaacatgtacctgaggagcaaggttgttgagaatgagaggggacagcagccactgaacatgatgggggcagcatcaacaagtgaatacgatcatatggttaataacccatatgattccaggaactttcttcaagtgaacatcatgcagcagcctcagcattacgcccatcagctgcagccaactacccttcaactcgggcagcagccggccttcaat

SEQ ID NO: 8 - DNA, 732 bp, Zea mays
atggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccc

SEQ ID NO: 9 - DNA, 807 bp, Arabidopsis thaliana
atggctatggaatgggataatcagctacaacccaataaccatcactcttctaatcttcaagggatcgacgttaatggcggctccggcgccggaggaggaatgtacgtgaaggtgatgaccgatgagcagtatgaaactctcaggaaacagattgctatttacggcaccatttgtgagcgtcttgttgagatgcataaaactctcactgctcaacaagatcttgcaggagggagaatgggaggactatatgcagacccaatgatgtcatctttaggtcataagatgacagctagacagaggtggactcctacgccagtccagcttcagattctggaacgtatattcgatcaaggcacgggaacaccgagcaagcagaagatcaaagacataacagaagagctgagccaacacggccagattgctgaacaaaatgtctataactggttccagaaccgacgtgctcgatccaagaggaagcagcatggtggaggttcttctggaaataataatggtgagtctgaggtagagactgaagttgaagcattgaatgagaagagagtagtgaggccagagagtcttcttggtcttccagatggaaatagcaacaataatgggttagggacaacaacagcaacaactactgctcctaggcctgaagatctttgctttcagagccctgagattagctcagaccttcacttgctagatgttctatcaaacccaagggatgagcatcttgttggaaagatgggactggcggaaagttacaacctttatgatcatgttgaagattatggcatgtcaggc

SEQ ID NO: 10 - DNA, 567 bp, Arabidopsis thaliana
atggtacattcgaggaagttccgaggtgtccgccagcgacaatggggttcttgggtctctgagattcgccatcctctattgaagagaagggtgtggcttggaactttcgaaacggcagaagcggctgcaagagcatacgaccaagcggctcttctaatgaacggccaaaacgctaagaccaatttccctgtcgtaaaatcagaggaaggctccgatcacgttaaagatgttaactctccgttgatgtcaccaaagtcattatctgagcttttgaacgctaagctaaggaagagctgcaaagacctaacgccttctttgacgtgtctccgtcttgatactgacagttcccacattggagtttggcagaaacgggccgggtcgaaaacaagtccgacttgggtcatgcgcctcgaacttgggaacgtagtcaacgaaagtgcggttgacttagggttgactacgatgaacaaacaaaacgttgagaaagaagaagaagaagaagaagctattattagtgatgaggatcagttagctatggagatgatcgaggagttgctgaattggagt

SEQ ID NO: 11 - DNA, 822 bp, Arabidopsis thaliana
atggaaatggaatcattcatggacgaccttttgaacttctctgtaccggaagaggaagaagacgacgacgaacatacgcaaccaccgaggaatattactcgccggaaaactggattacggccaacagactccttcggtctctttaataccgacgaccttggagtggttgaagaagaggatttggaatggatttcaaacaaaaatgcttttccggtgattgaaacattcgtcggtgtattaccgtcggagcattttcctataacgtctcttctggaaagagaagcgactgaggtaaaacagctgagtccggtttcagtacttgagacgagtagccatagctccacaacgactacctcaaacagtagcggcggaagtaacggaagcacggccgtggctacgaccaccaccactccaacaataatgagctgttgcgttggttttaaagcgccggctaaagcgagaagcaagcgtcgtcgtacaggacgccgtgatttacgagttttgtggacaggaaacgagcaaggaggaatacagaagaagaagacgatgactgtggcggcggctgcgttgattatgggaaggaagtgtcaacactgtggagcggagaagactccgcaatggagggcaggaccagcggggcctaagactctgtgtaacgcttgtggcgtgaggtataagtccgggaggctagttccggagtatcgtccagcgaacagtccaactttcacggcggagttacattcgaattctcaccggaagattgtagagatgaggaagcagtatcagtccggtgacggtgacggtgatcggaaagattgtgga

SEQ ID NO: 12 - DNA, 831 bp, Arabidopsis thaliana
atggctaaaggtgaatacagagagcaaaagagtaacgaaatgttttccaagcttcctcatcatcaacaacaacagcaacaacaacaacaacaacactctcttacctctcacttccacctctcctccaccgtaacccccaccgtcgatgactcctccatcgaagtggtccgacgtccacgtggcagaccaccaggttccaaaaacaaacctaaaccacccgtcttcgtcacacgtgacaccgaccctcctatgagtccttacatcctcgaagttccttcaggaaacgacgtcgtcgaagccatcaaccgtttctgccgccgtaaatccatcggagtctgcgtccttagtggctctggctctgtagctaacgtcactttacgtcagccatcaccggcagctcttggctctaccataactttccatggaaagtttgatctcctctccgtctccgcaacgtttctccctcctccgcctcgtacttccttgtctcctcccgtttctaacttcttcaccgtctctctcgctggacctcaaggacaaatcatcggagggttcgtcgctggtccacttatttcggcaggaacagtttacgtcatcgccgcaagtttcaacaacccttcttatcaccggttaccggcggaagaagagcaaaaacactcggcggggacaggggaaagagagggacaatctccgccggtctctggtggcggtgaagagtcaggacagatggcgggaagtggaggagagtcgtgtggggtatcaatgtacagttgccacatgggtggctctgatgttatttgggcccctacagccagagctccaccgccatac

SEQ ID NO: 13 - DNA, 1536 bp, Oryza sativa
atggcgaccttcttccgcagcgccaacctcgcctccagggtcttcgaccgccagttcctctccccacgccccggcgctactgttaacactgttagacagttctatgagaacttggttccgagttacactatatgtgacatagattgcccagattattcatttcgtaaattcactgatgatggcaactatcttgtggcttttagccggaaccaccaagatttaatcgtgtaccgtcccatctggccaacattttcatgcaatgagccatgcgactctcatgatcttccacccaaagcaaagaaattcgacagcttctttaagcagctctactcaatttcacttgcatctagcaatgaatacatctgcaaggactttttcctttacatggagtgccatcagtttggcttatttgccacatcaactgcacaaagcaacgattcaagtgccactgagggtgctattcatggggtaccatcaattgagaaaattactttctatcttgtcaggctagacgatggcgcaatactagatgagaaagctttccgcaatgattttatcaatctggctcatagtattggagcttacttgtatgaggacctgctatgcattgtctctcttcgatatcaaacaattcatgtcctacagatacgagattcaggcaaccttgttgaagtacgcaaaattggtgcattttgccaggaagatgatgagctatttctccattcacatggtcaggctgcacgaggtgtttcttttcttcctggcatcaagcaacggttgttgtcatttatttttcgcaagacatggaatgaggaatctgatcagaccttgagagtccagcatctgaagaagaagttctattttcactttcaagactatgttgatcttatcatatggaaggtgcagtttttggatcgtcatcacctatttatcaagtttggtagtgtggatggaggggtttctcgcagcactgaacagaattcagcattctttgctgtgtacaacatggagacgacagatattgtttcactctatcagaattcttcggaggagctctattcattgtttgaatatttttatgaccattttcacacaaatccacaaaattcatcgcatggaaattttatctcgtcacattccaataatgttcatgctctcgatcaacttcggacaattaaaaataaagcaaacagcacctcacagtttgtgaaaaagatgatggcgtcactaccttacacttgtcaatcacaaagtccttcgccatactttgacctatcattgtttcggtatgatgagaagctgatttcagcgattgatcggcacagacactgtacagagcatccaataaaatttatatcagtgaaacagccaaatgttgtcaaattcaagataaaaccaggttcagattctggtgcttctgacagcagggcaaaaagaatatcttccttcttgtttcacccatttttccctctcgcactttctattcagcagacatatatgcagccaactgttgtcaatttacatttcaggagatag

SEQ ID NO: 14 - DNA, 525 bp, Glycine max
atgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatag

SEQ ID NO: 15 - DNA, 423 bp, Arabidopsis thaliana
atgatgtcctttgaaatgaatgaccggaaaaaaatcgggttaggcctgacaggatttggcgtattcttctcgtttttgggaatagtctttgtctttgataagggattacttgccatgggaaatattcttttcatctcgggggttagtctaaccattggcttcaagtctaccatgcagttcttcatgaagcgtcaaaattataagggaaccatctcttttggcgtcggtttcttctttgttatcatcgggtggcctatcttgggaatgatgttggagacctatggctttttcgtactcttcagtggcttctggcctaccttggcagtctttgctcagaagatacccgttctcggttggattattcagcaaccatatattagatcgttctttgacaagtaccggggcaagcgagtgccggtctag

SEQ ID NO: 16 - DNA, 393 bp, Zea mays
atggcggcggcgggcctgaggaaggggaatgcgcgcctcccgccggaggtgaaccgggtgctctacgtgcggaacctgccgttcaacatctcgagcgaggagatgtacgacatcttcggcaagtacggcgcgatccggcagatccgtctgggcaacgccaaggacacgcgcgggaccgcttacgttgtctacgaggacatctacgacgccaagaacgccgtcgaccacctctccggcttcaacgtcgccaaccgctaccttatcgtgctctactaccagcccgccaagatgtccaagaagtcggatatcaagaagaaggaggacgagatcaccaggctccaggagaagtacggaatcgggtccaagacgcccggcccgggctccagcgactag

SEQ ID NO: 17 - DNA, 540 bp, Glycine max
atgtcgtccattaacccctcacgagctaccgctccctccgccttcgccacgcgccggccgtgggaggagttcttcgcgctccactcgttcacgcgcccctacaccctcggcgagaccacgctccgtgtgaagcgcaacctcggccacttccgcgtgaactacgccatggtcgtgctcctcttcgtgttccttagcctcctctggttccctatctccctcgtcgtcttcctcgccgtcttcgccgcgtggttcttcctctactttttccgcgatggccccatcgtcgtgctccgccgcgagcttgacgaccgcctcgtcctcgcggcgctctccgccgtcaccgtcgccgggcttgtccttaccggcgtctggctcaacgttgtggtggcgctgctcttcgcggcggcggcggtggcgctgcatgcggcgcttcggaacaccgaggatttgtacgtggatgaattggaagtttctgatggaggtttggtttcggttgttggtggtagccctacgaaacgaacagggtacgctagaatatag

SEQ ID NO: 18 - DNA, 1440 bp, Agrobacterium tumefaciens
atgtcgctaaaaaccgcccccgtcatcgtctggttccgcaaggatctgcgtctttctgacaatcttgctttgctcgccgcagtggagcatggcgggccagttattccggtctatatcagggaaaaatccgccggtcccttagggggtgcgcaggaatggtggctccaccattcgcttgccgctctctcctcctcgcttgaaaaagccggcggccgcctcgtgctcgcaagcggcgatgcagagaggatactgcgtgacctgatatccgaaaccggggcagacaccgtggtctggaaccgccgttatgatccgaccggcatggccaccgacaaggcgctcaaacagaagctccgggacgacgggctgacggttcgaagcttctccggccagctgctgcatgagccatcgcggctgcagacgaaatcgggcgggccttaccgcgtctatacgcccttctggcgggcgctggaggggagcgacgagccccatgcgccggcggatccgccaaagagcctgacagcaccgaaagtatggccgaagtccgagaaactctccaactggaagctgctacccaccaagccggactgggcaaaggatttcagcgatatctggacccccggcgaaaccggtgcgttggacaaactcgatgatttcatcgatggcgccctgaaaggttatgaagaaggccgggattttccggcaaaacccgcgacgtcgctgctttcaccgcatcttgccgcgggtgagatatcgccggcggccgtctggcacgccacgaaagggctttcgcgacatatcgcctccaatgatatcagccgtttccgcaaggaaatcgtctggcgggaattctgctaccatttgctgttccatttcccggagctgggcgaaaagaactggaacgacagtttcgacgccttttcctggcgggacgatgaaaaatccttcaaggcctggacgcgcggcatgacgggttacccgatcgtcgatgccggcatgcggcaattgtggcaacatggcaccatgcataaccgggtgcgcatgatcgtggcgtccttcctcatcaaacatctgctgatcgactggcggaagggcgagaagtggtttcgcgatacgctcgtcgatgcggacccggcgtccaatgccgccaactggcaatgggtggcaggttcaggggcggacgcctcgccgttcttccgcatcttcaaccccatattgcagggagagaaattcgacggcgatggggattatgtgcgcaggttcgtgcccgagcttgaaaagctcgagcggaaatacatccacaagccgttcgaagcgcccaaagatgcgctgaaaaaggcgggcgtcgaactcggcaagacctatccgctaccgatcgttgaccatggaaaagcgcgggaaagagcgcttgccgcctatgccgcagtgaagaagaccacatag

SEQ ID NO: 19 - DNA, 1527 bp, Oryza sativa
atggccgcgaccccgccgtcgtcgcagcaccggcggccgctgtcctcctccgcctccgccgcctccctcgctggcaagccgcgggggggcgggctcctgctcgggcggtacgagctcggccgcctcctcggccacggcaccttcgccaaggtgtaccaggcgcggagcgcggattccggggagccggtcgcgatcaaggtgctcgacaaggagaaggcgatgcggcacggcctcgtcccgcacatcaagcgggagatcgccatcctccgccgcgtccgccaccccaacatcgtgaggctgttcgaggtgatggccaccaagtccaagatctacttcgtgatggagctcgtccgcggcggggagctgttcggccgcgtcgccaaggggcggctcaaggaggacaccgcgcggcgctacttccagcagctcgtctccgccgtcgggttctgccacgcgcgcggcgtgttccaccgcgacctcaagcccgagaacctcctcgtcgacgagcacggcgacctcaaggtctccgacttcggcctctccgccgtcgccgaccagttccaccccgacggcctcctccacaccttctgcggcacgccctcctacgtcgcgcccgaggtgctcgcgcgccgcggctacgacggcgccaaggcggacatatggtcctgcggcatcatcctcttcgtgctcatggctggctaccttccgttccatgaccagaatctcatggccatgtaccgaaagatttacaggggggaattccggtgcccgagatggttctccaaggatctttccagtctactgaatcgcatccttgacacgaacccagagacaaggatcactgtcaaagaggtcatggagagcaggtggttccagaagggattccggccggtcagattctatgttgaggatgatcaggttcacagcttggcagatggtgataatgatatgccggagttggaacctagtgagcctcctcctcctcctccgtttccgccgccgccgccgcagcaagatgatgacggtgaggagtcgggatgggagtcggactcatccgtggcatcatgtcctgccacattgtcatctgaggagcgtcggcaaagacctctcgggtctctcacacggccagcaagtcttaatgcgttcgatatcatatcgttctcaaagggatttgatttgtcggggttgtttgaggagcgagggagtgaagtgaggttcatatcggcagagcctatgcaaacaatcatcacaaaattggaggagatcgcaaaggtgaagagcttcttcgttcggcgaaaagactggcgagtgagcatagaaggcacgagggaaggtttgaagggtccattgacaatcggcgctgagatatttgagctcacaccaagcctggtggtagtggaggtgaagaagaaggcaggggataaggaagaatatgatgacttctgtaacagggagttgaaacctgggatgcagcatctcgtacaccatatgggatcagttccaaatataccttctgatacggagtag

SEQ ID NO: 20 - DNA, 1356 bp, Zea mays
atggcagagcataaagggaacgttctcttgcacaagtatgagatggggaaattgcttggtcaaggcacctttgccaaggtttaccatgctcgtaacacggcgacttcggaaagtgtcgcgatcaaagtgattgataaggagaaggttatgaaggttggtctcattgatcaaatccagcgagaaatttctgtgatgaagcttgttaggcatccaaacatcgtacagctctatgaggtcatggccaccaaaaccaaaatatactttgtgctggaacatgttaaaggtggagagctgttcaacaagattcagcgaggaaggctcaaggaagacgcagcgaggaagtacttccagcagttgatctgtgcggtggacttctgccacagcaggggtgtctatcatcgagatttgaagccagaaaatcttttgctcgatgagaatagcaacctgaaggtatcagattttggtctaagcgcacttgctgaatgccatagacaagacggcctgctccacacgacttgtggcacgcctgcttatgttgccccagaggtgattaacagaaagggttatgatggtgcaaaggctgacatatggtcttgtggggtcatcctgtttgtgctattggctggttatcttccgttccatgataagaacttgatggacatgtataagaagattgagaaagctgacttcaaatgtccaagttggttttctaccgatgttcggaggcttttgcaaaggattcttgatcctaaccctagtagaaggatctcggtgaaaaaaatcatggagaatccatggtttaggaagggtttaggtgcaaagctacttaggtacgatttacagaataagaatgcccctcatgtggacaagaaggcagattttgattcactgagcaccaacgtaacaactgagagcaagcaacatgaagaaaagaagcctaccaacatgaatgcatttgatataatatctctatcaactggtttggacctctctggtttatttgaagaatctaacaagaagagagaatccaaattcacatctaccaacacaagctcgacaatcatatcgaagatcgaagatattgcaaagaatttgcggttgaatttgacaaaaaaggatggtggcttgttaaagatggaagcttcaaagcccggaaggaaaggggtaatgggtatcgatgccgaagtatttgaggttagccccaacttccatcttgtggagataaagaagacgaatggcgacactctagagtatcaaaaggtcctgaaccaagaaatgaggcccgcactcaaggaaatagtgtgggcttggcaaggtgagcaatcaaagcaaaagcaggaacaacagtcgtgttag

SEQ ID NO: 21 - DNA, 1314 bp, Zea mays
atggatgggaggaggacaattttgatgggacgatatgaaattggtaaacagctgggacaaggaacctttgcaaaggtcttttatgctcgtaatcttactactggcctggctgttgccataaagatgattaacaaggacaaggtcatgaaggttgggctcatggagcagataaagagggagatctcaataatgaggttagtgaagcatccaaatattcttcagctttatgaggttatggctagcaagagcaaaatttattttgttctggagtatgctaaaggtggcgagcttttcaacaaaattgctaaggggggaaagctcagtgaggatgttgcgaggaaatatttccaacagttggtcagtgctgttgatttttgccacagccgaggtgtctatcaccgtgatttgaagcctgaaaaccttctacttgatgagaatgaaaaccttaaagtctcagattttggcctaagtgctctagctgagtccaagaggcaagatggtctcctgcatacaacatgtggaactccagcttatgttgctcctgaagtgctgagtagaaaaggttatgatggtgcaaaggcagatgtttggtcttgtggagtaattctttttgtgcttgtggctggttaccttcctttccatgacacaaatttgatagagatgtacaggaagatttccagagccgagtttagatgccctcgttttttctcaactgagctgaaggatctgctacataaaatccttgttccagatccaagcactagaatttctatctcgaggataaagaggagtgcttggtacagaaaaccggttgaagcacatgcaaagaaaaatgaggcagaaacaagcgagaatacttgtaccggtgaaggtacaacttctgtctcaacagagtgcagtacgtctgagggaaatcaagggccattaagcctcccaaacttgaatgcatttgacatcatctgtctctcaacaggttttaatctttctgggttttttgaggataagtatggtcgcagggaagagagatttactaccagacagcctgtaacaacagtatttacaaagctgaaggagcttgccaaacgcctaaagttgaaggtcaataagaaagaaaatgggaccttgaaattggcagctccgaaggaaggaaagaagggtatgcttgagcttgatgcagagatttttgaggttgctccttctttgctcttagttgagttgaaaaaaaaccaatggggacacgctggagtatcaaaagctagtgaaagaggagataaggccggcactgaaggatattgtttgggtttggcaagatag

SEQ ID NO: 22 - DNA, 1392 bp, Zea mays
atggctgccgctgcagctttctcctccacttccgtcgtcgctgctctcgcggcgagcggcttcctcggcaagaagctcgtcaccagcatcatcatcaggaataagaagaaggggtacgactccctgcatggcgccacgaccaccatcagagtcagagccatggcggtgaacaaggagacggagcaggacaggtggaggggcctggccttggacacctcggacgaccagcaggacatcaccagggggaagggccgcgtggacccgctgttccaggcgcccatgggggacggcacccacgtcgccgtgctcagctcctacgactacatcagccaggggctcaggcactacagcttggacaacatgatggatggctactacatcgctcccgcgttcatggacaagctcgttgtccacatcgccaagaacttcatgcccctgccaaacatcaaggtgcccctcatcctgggtatctggggaggcaagggccaagggaagtccttccaatgtgagcttgtcttggccaagatgggaatcaaccccatcgttatgagcgccggcgagctggagagcggcaacgccggcgagcctgcgaagctgatccgccagcgctaccgcgaggcggccgacatgatcaagaagggcaagatgtgcgtgctgttcatcaacgacctggacgccggcgcggggcggatgggcggcacgacgcagtacacggtgaacaaccagatggtgaacgcgacgctgatgaacatcgccgacaaccccaccaacgtgcagctcccggggatgtacaacaaggaggagaacccccgcgtgcccatcatcgtcacgggcaacgacttctcgacgctgtatgcgccgctgatccgcgacgggcgcatggacaagttctactgggctcccacccgcgaggaccgcgtgggcgtgtgcaagggcatcttccgcagcgacggcgtccccgacgaggacgtggtgaggctggtggacgccttcccgggccagtccatcgacttcttcggcgccctccgcgccagggtgtacgacgacgaggtgcggcggtgggtggccgagaccggcgtggagaacatcgccaggaggctcgtcaactccaaggagggcccgcccacgttcgagcagccgaggatgacgctggacaagctcatggagtacgggcgcatgctggtggaggagcaggagaacgtgaagcgcgtgcagctggcagacaagtacctcagcgaggcggcgctgggcgacgcaaacgacgacgacgacttgtatggcaaggcggcgcagcatgtccgcgtgcccgtgccggaggggtgcactgaccccaaggccggcaacttcgaccctaccgccaggagcgacgacggcagctgcgtgtacaactag

SEQ ID NO: 23 - DNA, 923 bp, Zea mays
atggcggctacggaggtgtactcgccgaccacggcggcggcagcgcagcagcagcgggggaaggcggcatcgcaggcgtggcgagcggtggtagggtggatcggcttcttcctccaagtcctgcttcagatcctccggggcacgccctcctgcgcacagctcctgtccttcgttggtttccgctatccgctcctctccggacctgcggcctcggagccgttgccggaggtggccttcatgccgctccactccgagatccctgctgacgcggcgcctgccccgaaacctgcgtctgagcccctgggccgcctcacggtagtgcttgacttggatgagactttagtttctgcatatgaatcatctagtcttcctgccattgtgcgcacacaagctgttgaagcaggattacattgctttgatatggaatgtatatcgtctgataaggatgttgaaggcaaacaaaaggtcaatcatgtgactgtttttgagcgccctggtttgcatgagttcttgcggaaaactagtgaatttgcagaccttatcctttttacagcaggtttagaaggttatgctagacctttagttgaccgaatagatgttcacaatagattcagacttcgtctctatcgcccatcaactgttaccacggaatatagagaacatgtgaaagatcttactcgcgtgtcaaaagattttggcaggattgtcattgtcgacaacaatccgttcagtttcattcttcagcctttgaatggaataccttgtgttccattttcagctggacaacattctgatgatcagctcatgacggttatatttccactcctgaagcatctttccctccagaaagacgtcagacccgtattgcgtgaaagatttcatatgccagaatggttccaaaaccatgggatcccccaagttag

SEQ ID NO: 24 - DNA, 663 bp, Zea mays
atggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatagggttaaggaggatttcacaaaaaggtatggtggtgggaaagctgctactgctgcagctaacagcctcaatcgagagtttggatcaaaacttaaagaacacatgcagtattgtgtggatcaccctgaagaggttagcaagctggccaaagtgaaggcgcaggtttcagaagtcaagggtgttatgatggaaaacattgaaaaggttctggatcgtggagagaagattgagctgcttgtcgacaagaccgagaatcttcgctcacaggcacaagatttcagacagcagggaacaaatgtcaggagaaagatgtggttacagaacatgaaaatcaagctcatcgtcctgggaataatcatcgcactcattctgatcattatcctctctgtctgtcatggtttcaaatgccattag

SEQ ID NO: 25 - DNA, 1410 bp, Zea mays
atggggaagcgatccggcggccggaagctgccgttcttcaccagatcctcctcgtcctcgtccaagcggaatcgctccgcccgccgcctcccttccctccccaagcaggacaacgcgacgagggctcttctcgcctccccctctgctgcctcgccgtccgcgaccccgggatcggcggcggcggggcagaccgcccagctgccccctcccctctcagttaccgcgggcggcggggttgccgtgtcggggaaggtcaacaagaagaaggccggcacgcgcctatggatgcggttggaccgctggagtgcctccgagatcgtcgagctcgacaaggcctccataatccgccgcgccggactgcccccgcgcgacctacgcatcctcggccccgttttctctcgctcctccagcatcctcgctagggagaaggcgatggtgatcaacctcgaattcatcagggcgatagttactgccgaggaggtgctcctgttggaccctctcatgcacgaagtgctccctttcgttgaccaattgaggcagcacctgcctctgaggagccgggtgggtgagaatggtgagtgtgcccctgatggcaatggggaaaaacagaagggctcgcttaatgaagcgaccggggcagagcatgagctgccattcgagttccatgtgctggaggtagcactcgaggttgtgtgctcatcgttggaccttagcgtgtctgaccttgagaggcatgctactccagtgcttgacgaactgaccaagaatgtaagcacaaggaaccttgagcgagtgcggaaccttaagagtcatcttacccgtttgcttgcccgtgtgcaaaaggtcagggatgaaatagaacatcttctagatgataatgaagacatggaacatctgtatctaacaaggaagcaagtacaaaaccaacaggttgaggctttaatgtcatctgctgcttccaacagcattgttcttgccggaacaggtgtgcccaggctgaactctagcttccggcgtagcctgagcattgctactagcatgcatttggataatgatgtggaggacctagagatgttacttgaggcctacttcatgcagctggatggaattcgcaacagaattttgtcggttcgggagtatattgatgacacagaagactacgtcaacattcaactcgacaaccagcgtaacgaactcattcaactccagcttacacttacgattgcatcctttggcatagctgccaacactttcattgctggagcttttgcgatgaacatcccgggctctctgttcaacaccgatggcagcctcttctggccatttgtcgggagcacctcatctggctgctttgtaatcaccgtcctcttgttggggtatgcctggtggaagaagttgctgggtccttag

SEQ ID NO: 26 - DNA, 735 bp, Zea mays
atgatctccccggacgcagcccgcaacgtagtcggcatcatcggcaatgtcatctccttcggcctcttcctgtccccagtgctgacgttctggcggatctacaaggccaaggacgtggaggagttcaagccggacccttacctggcgacgctgctcaactgcatgctctgggtgttctatggcatccccgtcgtccaccccaacagcattctcgtcgtcaccatcaacggcatcggcctcgtcatcgaggccgtctacctcactatcttcttcctctattccgacagccagaagcgcaagaaggcgttcgcgatcctggccgtggagattctgttcatgctcgccgtggtgctcggtgtgatcctcggcgcgcacactcacgagaaacgttccatgatcgtcggcatcctctgcgtcatcttcggctcgatgatgtacgcctcaccactcactatcatgagtcgagtgatcaagaccaagagcgttgagtacatgcccttcctcctgtcgctggtgagcttcctcaacggctgctgctggacggcctacgcgctcatccgcttcgacctctacgtcacgatcccaaacgccctgggcgcattcttcggactcatccagctgatcctctacttctgctactacaagtcgacccccaagaatgagaagaacgtggagctgcccaccgtctccagcaacgtcggcggcggcaacgtcaccgtcagcgttgagcgatag

SEQ ID NO: 27 - DNA, 1014 bp, Zea mays
atgaggatgctgtcgaaggcgtgctcgattgtggcctcctccctcccgcgctgctcctcctccgccgccgcccccacgatgagggggcagccgtccttgctgccaagcgtgcggaagcaatggcccgggaagccactgctgtatggaatcggcaccctgttggtcatgccactgaggacactgtatggagtgggtcgtgtttttggcgcaggacggtttctctgcaacatgaccaacgtctcttcgtcgctgcaaattgagcttgtaccatgccttcgagataactatgcgtatatcctgcatgatgttgatactggaacagttggagtagtggatccttctgaggctatgcctattataaatgcattggaaaagagaaaccagaacttgacttatatactgaacacccatcatcactatgatcatactggtggaaacttggaattgaaggcaaaatatggtgcaaaggtaattggttctgagaaggataaggacagaatacctggcattgacatcacgcttaaggagggtgacacatggatgttcgctggccatcaagttcttgtactggaaactcctgggcatacaacaggtcatgtgtgctattatttcgctggttctggagctatatttacaggtgacaccttgttcaatctatcatgcggaaagctttttgaagggactccacagcagatgtatgcctcactccagaaaattacagctctacccgatgatacaaaagtatactgtgggcatgaatataccttgagtaatgcaaagtttgccttgagtgtagaaccgggaaataaagcattgcaggaatatgctgcaaatgcagctgagctgcgtaataagaatatacccacggtgccaacaacaattggaagggagaaggaatgcaatcctttcttgcggacctccaatccagaaattaagagaacactgtccgttccagatcatttcgatgaagatcgggtgcttggagttgtccgtcgagcaaaagataacttctag

SEQ ID NO: 28 - DNA, 1134 bp, Zea mays
atggggcgagacaagagccggcgtctatacggcagccgccatttccggcagcggctggtgctggcgacgctcacctctaccgctgtcaccatcgaggacatccgctcaggggacgcttcgccggggctccgcccttacgaggtctccctcctccgcctcctcgacaagatctcagaccatcacaccattgacctcaacgagacaggaacgaagctgaggtaccggccgggggtgattatagggggaaagggccttgagcacgactgcggggtgcaccggggtattggctactttcttgagccactcatactgcttggtctattttcgagggcccctatatcgattcggcttaaaggaatcactaatgatacaaaggatccttctgtggatactttccggacaacaaccttgcatatgctcaagcactttggtgttcctctggatggtttcgatctaaatattgacagccgtggatctcctcctcttggtggtggtgaggtgtttctccgggttcgcaatataaatagcacattgacggcagcaaattgggtagatgaaggtatggtgaagaggataaggggtgtttcgttctccaccagagtatctccacagttggaaaaccgcatcatttatgctgcacgtggaatcttcaatcgtttcattcctgatgttcatatacacacggatcatagatctggttctgctggtgggaggtcaccaggctatggtgtatcgttagttgctgagaccactacgggatgcctgctctctgtagatgtcactgtgagttatcctagtgttgatgaaataaatgaagaatctgagaagcctgagctgacttctccggaggatcttggtgttcaagctgcatcaatgctactagaagaggtggctcaaggaggtgttgttgattctacacatcagggcctcctatttattctgtgtgctttatgcccaccggatgtatcaaaggttcgtgtgggacagttgactccatatggtatagagacacttcgaaacatcagagattttcttgacgtcaagttcatcatcaagcctgatcccaattcaaacaccgttactttaaaatgtgttggcgcgggagtgaagaatcttgctcggaagatttcatag

SEQ ID NO: 29 - DNA, 627 bp, Oryza sativa
atggaagtggaggctcaccatggcttcctaccaccagcagcagggaggcagcacctttatggccatccccactatcaactttcaggagatgatgagtggtgggagtacatcccttgccccttctgctacattgaggtggaggttcatttcctttgtgaccatctccaggaggagcattgctttgacatgaaaaatgctgtgtgtccaatctgcgccgacaaccttgacaaggacactgatgaacatttcagggttcagcactcacatctactcaagaggaggaagtcttcttctttttcttgcaagccaagctcagcagcagctgacaagggatcatatgaagaggactcctactttgaagcaccctcacactgcatgggcaggccggctcctgattcctctcctgaccctcttctctcccagttcatctgctgcagcctcgctcctccggtcgattcgccgcgccgcagcgaagccgatgccgagggccatggttcatcttcctcagatgatcaaaaaaggagagagcagggtgtgatggatgatgcatcaaaggaggagcttgaggagaggttgcagagaatcgagttcgtgaagcagatgctgatgacaacaattgcttattag

SEQ ID NO: 30 - DNA, 1128 bp, Glycine max
atgggtagcaaaggcaaacgcaaagagcaagaatcaataataacgagggttatggctcacggaggtagatacgtgcaatacaacgtgtacggaaacttgttcgaggtctcctccaagtatgtccctcccattcgccctgtcggtagaggcgcatacggcatcgtttgtgctgctgttaattgcgatacgcacgaggaagttgccataaagaagattggtaacgcctttgacaacatcattgacgctaaacgaactttgagggaaatcaagctccttcgccacatggaccatgaaaatataattgccattagggatatcatacgacctcccagaaaggatgccttcaatgatgtttacattgtttatgaattgatggacactgatcttcatcagattattcgttctgaccaacctcttaacgatgaccactgtcagtactttttatatcagctgttacgggggctgaaatatgtgcattctgctaatatcttgcaccgtgatcttaagcccagtaatttgcttctcaattcaaactgtgaccttaaaattgcggactttggtctggcaaggacaacatctgaaacggatttcatgacggagtatgttgtcacacgatggtaccgagccccagaattgcttcttaattgttcagagtacacctccgcgattgatgtttggtctgttggttgcatatttggtgaaattatgaccagagaacccttgtttcctggaaaagattatgttcatcaactgaggcttataacagagttattaggttcacctgatgatgccagccttggatttctccgaagtggaaatgccaaaagatatgttcgacagcttccacaatataggaagcaaaatttctccgctagattcccaaatatgtctcctgaggcattggatctactagaaaagatgcttatctttgatcccaacaaacgcattacagttgatgaagcactatgtcatccatatctttcatcacttcatgacatcaatgatgaaccggttggtcctgggcaattcaattttgattttgagcagccaacatgcactgaagagcacatcaaggagctcatctggagggaatcggtgaagtacaatccagatccacccagtcagtag

SEQ ID NO: 31 - DNA, 1407 bp, Cupriavidus metallidurans
atgtcaacgttacgaggggtatccatgagcgacatgcaagagcacaaggtcacaccgtacgaccagttcaactacgaggtgcctgaaaacgtcttcccgcgcgaaggcatctcggcgaatgcagcggccgcgatcgtgatcagtgacgaatggaccgacaccaaccccatgctcaacatgtcgtcgttcgtcaccacgttcgcggaaccggaagcccgggaagtcgccgcgcgcaatatcttcaagaactatatcgaccacgacatgtatccgcggctcttcgccatggaaggccgcatggtgcgctggctgcatgaactgtggaacggtccgaagggcgtggagccgtacggcacgtgtacggtaggctcatccgaagcctgcatgctcgggggcctggcgcacaagtggaactggcgccagcgccgccaggccgaaggcaaggatgccacccgcccgaacatggtgacgggcggcaacgtgcagatcgtgtggaagaagtttctgcgctacttcgacgtcgagccgcgcatcgtgccgctgaagccgggcaactactgcctgaccgccgaagacctggacaagtacgtcgatgagaacacgatctgcgtcgtggccatcgccgggcagaccttcacgggcgaggatgacgacatccagggcattcacgactggctcgatgcctacgagaagcgcacgggcatctcgatccccatgcatatcgacggcgcctccggcggcttcgtcaacccgttcctctaccccgactacaagtgggacttccgcctgccgcgcgtgcagtcgatcaacgcctcgggccacaagtacgggctgacgccgccgggcctcggctgggtggtgttccgcgaacgcaagatcttcaacgaggaactggtgttctacgtgaactacttgggcggagaaatgcccacggccacgctcaacttcagccgcaacgcattccaggtggccgtgcagtactaccagttcctgcggctcgggttcgacggctacaaacgcgtgatgcagcacacgctggacaacgcgatcttcctgcgccagcagctcgtcgacagcgggtacttcgacatcatgaacaccacgcagcgcattccggtggtggcagtgacgctgaacaagaagtacaagaacttcaacgagttcgatgtctccaacaaggtccgcgagaaaggctgggtgctgtccgcgtacacgatgccgcccaacgccgaatcggtcacgagcctgcgcgtggtggtgcgtccgcatgtgaaccacaacgtggcgcaactgcttgccaacgatatcattaacgcctgcaagttcctcgaggccaacggtggcaatgccaagcctcccgcattgcacaaacatgccgaagcgcaatcgacgtcgttgaagtgctag

SEQ ID NO: 32 - DNA, 1221 bp, Oryza sativa
atgggctctaagaagcggtcgcctcagcatccggccgccgcggcgccccctcccgccgtcggcggcggcggcggcggcgaggtctccggcgatggtggcgcctcgacggcgaacgggccggtggtgccgaagccgtcggaggtggcgccgttcctgacgaaggtgtacgacatggtctcggaccccgcgaccgacaacgttatctcgtgggccgagggcggcggcagcttcgtgatctgggactcgcacgccttcgagcgcgacctccacaggcacttcaagcacagcaatttcaccagcttcatacgccagctcaacacctatggatttcgtaaagttcaccctgatagatgggagtgggccaatgaaggttttattatgggccaaaaacatcttctgaagaccattaagaggaggaagaagtcttctcaggaatcacctagcgagatacagaaggcgcctgtcaaaactgcacctggtactgaaaatattgagataggaaaatatggtggccttgaaaaggaggttgaaacccttaagagggataaagctcttctcatgcagcagcttgtagatctcaggcactaccagcaaacatctaaccttgaagtgcagaatttaattgaacggcttcaagtaatggaacagaaccagcagcagatgatggcacttctagcaatcgttgtccagaatcctagttttctcaaccagcttgtgcagcaacagcagcagcagcgcagatccaactggtggagtcctgatggaagcaagaaaaggagatttcatgctcttgagcagggccctgtaactgatcaggagacctctggccgtggggcacatattgttgaatatctcccacctgtcccagaaacatcaggtcaagtaaatccagtggaaggagccatttgttcggccaactcacaaccagttccaagtcctgcagttgccacacccatggacatgcaaacgtctaacgttgctgatactctcggttcatctgaggagcctttcgctgataactctactctacatgaatgggatgataacgacatgcagcttctgtttgatgataacctagacccaatacttccaccatttgagaatgatggtcaaatgggccctcctttgagtgttcaagattatgattttccgcagttagagcaggattgtctgatggaagcacaatataactccaacaatcctcaatatggtaatgactag

SEQ ID NO: 33 - DNA, 480 bp, Glycine max
atgtcgttgattccaagtttcttcggcaccgggcgaagaaccaacgtcttcgaccccttctccctcgacgtgtgggacccattccatggcttccccggcaccaccgccctctccgctccgcgctccgagacggcggccttcgccaacacgcgcatcgactggaaggagacggcggaggcgcacgtgttcaaggcagacctgccggggctgaagaaggaagaggtgaaggtggagatcgaggaggagggaagggtgctgcagataagcggacagagaacaaaggagaaggaggacaagaacgacacgtggcaccgcctcgaacgctccagcggcagctttctccgccgcttccgcctgccggagaacgcgaaactcgatcaggtgaaggccggcatggagaacggagtgctcactgtcactgttcccaaggtggatgtcaagaagcccgatgtcaagcccgttcagatcactgaaggctag

SEQ ID NO: 34 - DNA, 663 bp, Zea mays
atgggatcagaagggccttcagttgtcactgtccatgttactggatttaagaagttccatggggttgctgagaacccaaccgagaaaattgtgaccaatcttaaatctttcttggaaaagcgagggttgccaaaaaatcttgtcctcggaagctgcacagttctcgaaacagcaggggaaggggcacttgccacattatataaggttttagagtctgctgttgcagacagaggaactgggtcctcggcacagggacaagtaatttggatccactttggggtcaacagtggcgcaataaggtttgcccttgagaaccaagctgttaatgaggctaccttccggtgtccagatgagctaggatggaaaccacagagggtccctattgtgccctctgatggaagcatctcacggacgagagagactaccctgccagtcaatgaattaaccaagtcactccggaagataggctacgacgtggtgccctccggcgacgccggtcggtttgtatgcaactacgtgtactaccactctcttcggttcgcggagcaacacggcatcaaatccctgttcgtgcatgttcccctcttcttgacgatcgacgaggaggtccagatgcacttcgtcgcttccctccttgaagtcatcgctttctcatccaactag

SEQ ID NO: 35 - DNA, 1461 bp, Arabidopsis thaliana
atggccggtgtcgtacgatcttctcccggttcttctcagccgccaccgccgccgccgcaccatccaccgtcatctccggttccggttacatctacgccggttataccacctatacgtcgtcacttagctttcgcctcaacaaaacctccgtttcatccttccgatgattaccatcgatttaacccttcttcgctcagtaataataacgacaggagcttcgttcatggttgtggtgttgtagatcgggaggaagatgctgtcgttgttagatctccttcacgaaagagaaaggcgacaatggatatggttgttgctccatctaataatggattcacgagttctggtttcactagcatacctagcagtccctgtcaaactcctagaaaagggggcagagtcaacatcaagtcaaaggccaaaggcaacaagtcaactcctcaaacacccatctcgacaaacgctggttctcctatcacacttactccatcaggaagttgtcgttatgacagttctttaggtctccttacaaaaaagttcgtcaatctaattaaacaagccaaagatggaatgctggacctaaacaaagctgcagaaacattggaggtgcagaaacgacgtatatatgatattacaaacgttttggaggggatagatctcattgaaaagcctttcaagaatcgaatactttggaagggagttgatgcgtgtcctggcgatgaagatgctgacgtatctgtattacagctgcaggcagaaattgaaaacctcgccctcgaagagcaagcattagacaaccaaatcagacaaacagaggaaagattaagagacctgagcgaaaatgaaaagaatcagaaatggctttttgtaactgaagaggatatcaagagtttaccaggtttccagaaccagactctgatagccgtcaaagctcctcatggcacaactttggaagtgcctgatccagatgaagcggctgatcacccacaaaggagatacaggatcattcttagaagtacaatgggacctattgacgtatacctcgtcagcgaatttgaagggaaattcgaagacacaaatgggagtggtgcagcaccaccagcatgcttgcctattgcttctagctcaggatctacaggacaccatgacatcgaagccttaactgttgacaacccagaaactgctattgtgtctcatgatcatcctcatcctcaacccggcgatacctctgatcttaattatttgcaagagcaagtaggaggaatgcttaagattactccctctgatgttgataatgatgagtcggactactggcttctctcaaatgctgagattagcatgacggatatttggaaaactgactctggtatcgattgggattatggaatagccgacgtgagtactccaccaccaggaatgggcgaaatagcaccaacagctgttgactcaaccccgagatgctag

SEQ ID NO: 36 - DNA, 939 bp, Arabidopsis thaliana
atggcgcaacaagggcagggaagcatggaccctgccgctctcgatgatatcattcgtcgtttgttggattacagaaaccctaagcctggtaccaaacaggctatgctcaacgagtctgagatccgtcagctttgcatcgtctctagagagatttttcttcaacagcctaaccttcttgagctcgaagctcctatcaagatctgcggtgatattcatggacaatactcagatctattgaggctgtttgagtatggaggcttcccacctacagctaactatttattcttaggagattacgtagacaggggcaagcagagtttggagactatttgtcttctgcttgcttacaaaatcaaataccctgagaacttttttcttctaagaggaaaccacgaatgtgcttctattaacagaatctatggattctatgatgaatgtaaacgtcgattcagtgtgagactctggaaagtgtttacagattcttttaactgtctccctgttgctgctgttatagacgataagatattatgtatgcacggtggcctttctcccgatttgaccaacgtggaacagattaagaacattaagcgacctactgatgttcctgactctggtttgctctgtgatctgctttggtctgatccaagcaaagatgtcaaaggttgggggatgaatgaccgtggagtctcttacacgtttggccctgacaaagtcgcggagtttctaataaagaatgatatggatctcatctgccgtgcccaccaggttgtagaggatggatatgagtttttcgccgatagacagcttgttacgatattttctgctcccaactactgtggtgaatttgacaatgctggtgctatgatgagtgttgatgaaagtttaatgtgctctttccaaattcttaagcctgctgatcgaaagccccggttcttatag

SEQ ID NO: 37 - DNA, 1548 bp, Arabidopsis thaliana
atggaggtccttgcgagctcttcattatccccaatttcttttactaagcctaacaaaataaaccctaatttctcaatccaggtgaaattgtgggtaaaacaacctccaaagatttcaaaagctagcaaatttagttatgctcgtagtcgtagtaacatttcaaggagcaatgcagcaaacccaggagtcgtgttcgtctgtaatagatttctgtgtgttatcgaaagaaatgatcagaggaaattatctgggaaggttatgatgaaatcttctgttaatttcagacagaatctctctgttgcattagttcggatcgtttctgttctgcttgtctcttccatttctgttgttaccactgattcaccaccatcatggggtcttactgaagagaatcttctcttcctcgaggcttggagaacaattgatcgtgcttatattgataaaacctttaatggacaaagctggtttcgttacagagagactgctttacgaaatgagcctatgaacactcgagaagagacatacatggctatcaagaaaatggtggcaacactagatgatccttttactcgattcttggagcccggaaagttcaagagtttgcggtcggggactcaaggggcggttacgggtgttgggctgtcgataggttaccccactgcatcagatggaccaccagctgggcttgttgttatatcagctgctccaggaggtcctgcaaatagggcggggatattacctggcgatgttattcaaggaattgataatacaaccacagaaactcttaccatatacgatgctgcacagatgttgcagggacctgaaggaagtgcagtggagctagcgattcgcagtggacctgaaacgagactcttaactttgacgcgagagcgggtttctgtgaatccagtgaagtcaagattatgtgaacttcctggttctgggagtaactcccctaagattggctatatcaagctaacaacattcaatcaaaatgcttctagtgcggtaagggaagctattgaaaccttgagaggcaacaatgtaaacgcattcgtcttggaccttcgagacaatagtggaggttctttcccagaaggaattgagattgctaaattttggttagataaaggagtgattgtgtatatttgcgatagtcgaggtgttagagatatatatgatactgatggaagcaatgctatagcaacctctgagcctcttgccgttcttgttaacaaaggcaccgcgagtgccagcgagatattagcaggtgccttgaaagataataaacgtgctctggtttatggagaaccaacttacggaaaaggcaagatacagtcggtttttgagctttctgatggttcgggcttggcagtaacagttgctcgatatgaaacaccagctcacacagatatagacaaagtcggtgtaactcctgatcatccattgccaaagtcgtttccgaaagatgaagaggcgttctgtggatgccttaaggatcctacagctgcttgttatctcaatcaaggcctacttttttctagatag

SEQ ID NO: 38 - DNA, 1573 bp, Arabidopsis thaliana
ggtaccggcgcgccaccatggaggtccttgcgagctcttcattatccccaatttcttttactaagcctaacaaaataaaccctaatttctcaatccaggtgaaattgtgggtaaaacaacctccaaagatttcaaaagctagcaaatttagttatgctcgtagtcgtagtaacatttcaaggagcaatgcagcaaacccaggagtcgtgttcgtctgtaatagatttctgtgtgttatcgaaagaaatgatcagaggaaattatctgggaaggttatgatgaaatcttctgttaatttcagacagaatctctctgttgcattagttcggatcgtttctgttctgcttgtctcttccatttctgttgttaccactgattcaccaccatcatggggtcttactgaagagaatcttctcttcctcgaggcttggagaacaattgatcgtgcttatattgataaaacctttaatggacaaagctggtttcgttacagagagactgctttacgaaatgagcctatgaacactcgagaagagacatacatggctatcaagaaaatggtggcaacactagatgatccttttactcgattcttggagcccggaaagttcaagagtttgcggtcggggactcaaggggcggttacgggtgttgggctgtcgataggttaccccactgcatcagatggaccaccagctgggcttgttgttatatcagctgctccaggaggtcctgcaaatagggcggggatattacctggcgatgttattcaaggaattgataatacaaccacagaaactcttaccatatacgatgctgcacagatgttgcagggacctgaaggaagtgcagtggagctagcgattcgcagtggacctgaaacgagactcttaactttgacgcgagagcgggtttctgtgaatccagtgaagtcaagattatgtgaacttcctggttctgggagtaactcccctaagattggctatatcaagctaacaacattcaatcaaaatgcttctagtgcggtaagggaagctattgaaaccttgagaggcaacaatgtaaacgcattcgtcttggaccttcgagacaatagtggaggttctttcccagaaggaattgagattgctaaattttggttagataaaggagtgattgtgtatatttgcgatagtcgaggtgttagagatatatatgatactgatggaagcaatgctatagcaacctctgagcctcttgccgttcttgttaacaaaggcaccgcgagtgccagcgagatattagcaggtgccttgaaagataataaacgtgctctggtttatggagaaccaacttacggaaaaggcaagatacagtcggtttttgagctttctgatggttcgggcttggcagtaacagttgctcgatatgaaacaccagctcacacagatatagacaaagtcggtgtaactcctgatcatccattgccaaagtcgtttccgaaagatgaagaggcgttctgtggatgccttaaggatcctacagctgcttgttatctcaatcaaggcctacttttttctagataggcgatcgc

SEQ ID NO: 39 - DNA, 579 bp, Zea mays
atggcgagcgacggcgcggcggctacgccagcgaaggttaccccaaagaaggccaatctcctcgacccgcactccatcaagcaccttctcgacgagaccatctccgaggtcgtgaagagtaagggctacaccgaggacacgcggctgggcaactggaagctggggatcggagccgccgtgattgctgtcgccctcctcgctcagttttaccccaagaagttcccgcagaaccgcgatttcctccttggctgcatcgccctgtatgtggtgctgaatgtggtgctgctgatccttagctacaccaaggagaaggatgccatcctattcacgcaccctcctatgggttctttcagcagcactggcctcactatttcttctaaattaccaagattctcggacatgtacactctcacaatagcaagtgcggatccacagtctatctctgcaaacaagccagttcatttcactaagagcgtaacaaagtggtttacaaaggaaggagttcttgtggagggcctgttctggaaggatgtcgagaagctgattgatgactacaacagtgagcgcaagagtaaatag

SEQ ID NO: 40 - DNA, 936 bp, Oryza sativa
atggcgaagcacttcgtgctcaacaccggcgccaagatcccctccgtgggcctcggcacctggcagtccgaccccggcgtcgtcggcaacgccgtctacgccgccgtcaaggcggggtatcggcacatcgattgcgccagtgcgtacaacaacgaaaaggaggtagggttggctctgaagaagctatttgaagagggtgtggtcaaacgcgaagatctgtttatcacgtctaagctatggtgtgatcatcatgccccagaggatgtgcctgaggcactagatgctaccttgaatgacttacagcttgagtacctggatctttacctcattcattggccattcagaaccaagaagggatccagcattggcaaacctgaaagctacttaccacctgacatcccatctacctgggcagcaatggagaagttatatgattctggcaaaagtcgtgccattggtgtgagtaacttctcatcgaaaaaattgggtgacctgcttgctgcagcccgtgtacctccagctgttgaccaggtggagtgccatcctggttggcagcagatgaagctgcataacttttgccagtcaacgggcattcatctttctgcatactcgccgctaggttcacctggttcaacatttatgaacggcaatgtccttaaggaacccatcattatctcgattgcagagaagcttggcaaaactcctgcacaagtggcgctgcgctggaacattcagatgggtcacagtgtactcccaaaaagtgtgagtgaagaaaggataaagcagaacttagatgtttatgactggtctattccagaggacttgcttgctaagttctcggagattaagcaggttaggctgctcaggggcaacttcattgtcaatccacagagcgtttacaagacccatgaggagctctgggacagggaaatttag

SEQ ID NO: 41 - DNA, 1201 bp, Zea mays
aaagcaggctcctgcaggacctgttggaagccggtccagggccgcgatgacgtcgaccgccgccggcgcgtcgtcgtcggcggcgaagagcgagtcctacctgcgggccgacaagatcgacctcgagagcctggacatccagctggagaagcagctggccaagacctgggagaagcacaaggggtcgtacaaccaggggcccagggaggactgggagatcgacctcgccaagctcgagattcgctacgtcatagcgcagggcacctacggcacggtgtatcgcggcacgtatgatgggcaggacgtcgcagtaaaactattggattggggtgaagatggctttgcgtcagaaactgaaactgccacactgcgagcatcatttaagcaggaggttgctgtctggcatgagctcaaccatccgaatgttacaaagtttgttggtgcatcaatgggtactacagaccttaagattccagccaatagttctaacagtggtgggcgcactgagctgccgccaagagcatgttgtgttgtggtcgaatatctcgctggaggatcactgaagcagtatttaataaagaacaggcgaaggaagcttgcatacaaggttgttgttcagatagcactggatcttgccagaggattgaactatctacattcaagaaagatagtacatcgggatgtaaaaactgaaaatatgctgctcgatacacagcgaaaccttaagattgctgattttggtgttgctcgtgttgaggctcagaatccaaaggacatgacaggcgcgactgggacacttggctacatggccccagaggtgcttgaaggcaagccatacaacagaaagtgtgatgtctacagttttggcatatgcttatgggaaatatactgctgtgacatgccatatccagacctcagttttgcagacgtctcgtccgccgtcgttcaccagaacctgcggcctgacatccctcgctgctgcccaagcccaatggcgaacatcatgcggaagtgctgggacgcaaacccggataagcgccctgacatggacgacgtggtgcggttcctggaggccctcgacacgagcaagggcggtggcatgataccagaaggccaggcaggcgggtgcttgtgtttcttcagagcccgtggtccttagaaccaaccaaccctttccagccatagctcgagacccagcttt

SEQ ID NO: 42 - DNA, 1026 bp, Zea mays
atggaccacgcggcggaggcgcagcggacggacctgatgacgatcacgcggcacgtgctcaacgagcagagccgccacccggagtcccgcggcgacttcaccatcctcctctcccacatcgtcctcggctgcaagttcgtcgccgccgcggtcaacaaggccggcctcgccaagctcatcggcctcgccggagagaccaacgtccagggcgaggagcaaaagaagctggatgtactgtccaacgaggtcttcgtgaaggcgctcgtcagcagcggccgcacctgtgtcctcgtgtctgaagagaacgaggaggccatcttcgtcgacccggccctccgcgggaagtactgcgtctgtttcgacccgctggatggctcctccaacatcgactgtggtgtctcaatcggaacgatctttgggatttacatggtcaaagacaaggacaacgtgaccttggaggatgtgctgcagcctggaacaaacatgcttgctgctggctactgcatgtacgggagttcatgcacgcttgtgctgagcactgggaacggagtcaatggcttcactctcgatccttcccttggagagttcattttgactcatccaaatatcaagataccaaggaaagggaagatctattcagtcaacgaagggaacgccaaaaactgggatgggcctacagccaaattcgtggagaaatgcaagtatcctgaggatggttcaccgcctagatccttgagatatatcggaagtatggttgctgatgtccatcgcaccttactatacgggggcatatttttgtacccagcagaccagaagagtccaaacgggaaactacgcgttctgtatgaagtcttcccgatgtcattcctgatggaacaagctggaggccaggctttcacaggcaaacaacgggcgcttgaacttgctcccgctaaacttcacgacagatccccagtgttcctcgggagctacgatgacgttgaggagatcaaagcactgtacgcttcaatgtcaaacagcggttag

SEQ ID NO: 43 - DNA, 1368 bp, Glycine max
atgtctaatttgacttctgcatccggtgaagctagtgcatcttcaggcaacagaaccgaaattggcactgattactcacaacaatactttgctccaccactaagtcaagcacagcctcctccactaaagaaaaagagaaaccttcctggcaacccagacccggaagctgaagttgtcgccttgtctccaaagactctcttggcaactaataggttcatttgtgagatctgcaacaagggatttcaaagagaccagaatctccaacttcacagaagagggcacaatttaccatggaagctgaagcagagatcaagcaacgagattataaggaagaaggtgtatgtgtgcccagaagccagttgcgtgcaccacgacccttcaagggctcttggggacctcactggcatcaagaagcacttctgcagaaagcacggcgagaagaagtggaaatgtgacaaatgctccaagaagtatgctgttcaatcagattggaaagctcactccaagacctgtggcactagagagtacagatgtgactgtggaaccctcttctcaaggagggacagtttcataacacacagagccttctgtgatgcattagcagaggagagttcaagatcagtgacaggcataggcatagtagccaactcaacttcaactcaaccaactgcagcagcagcctctcatcaacaagacatcatccatggtaatagtaacaatttctcattgaagaaagagcaacaagcaggtttcagaccaccttggattggacaaccatcaccctcttctgcttcatcattcttggtctctcatcaagaaaaccctaaccctagaggtggtggtcctggtcccactcttcttcctccttaccaaacagctcctcacatgtcagccacagcgttgctgcagaaagcatcccaaatgggtgcgacgatgagcaaaaccgggtccatgattgggacccaccaacaacaggctcacgtgtctgccaatgccgctttgaatttgtcctcacgtgaccaccagatgacccccactctccatggcttggtacctttcgggaataaagctgttcctgctgttggtaatggtgtttctccttcactccttcaccatatcatcgactctttctcttcaccctttgaagggacttcttttgaggacacttttggtggtgctggtggcgatgccatgacgaaaacaaccaccgccgatgacggtgccagaggaaacaataatgaagccctgacaagagatttcttgggtcttagacctctctctcacactgatatcctcaacattgctggtatgggaagttgcatcaactcctcccaacataaccaaaccccaaacccttggcaaggttag

SEQ ID NO: 44 - DNA, 3070 bp, Unknown
  Synechocystis sp. PCC 6803
ggtaccggcgcgccaccatgtccccatcccagccccacccacccattgctacttttgagccggagagttttctcattctggtggtggatgacgtaaaagagaatatttatgtgatttcggaactgttggaaggggaaggttacagcactacttttgtgacctccgggccggaagctttgcaacgggtgacccaggcccaaccggatctcattctgctggatttgatgatgcccggcatggatgggctggaggtgtgcgatcgccttaaacaagatccccaaaccagggatattccggtaatttttctcactgctagcaacgaaaaacaagatttgctgcaagcctttgccaagggggcagtggactatgtcaccaaaccctttagcccgccggaactgttggctagggtaaaaacccacctggaactgaaacaaaccagggataatctacaccacactctcctggaacaggccaggaccgccgaagccctggcctgtacttccacccgcctgggtatcctggtgcaaaatatgcaagcaggggtgttgatgaccgacgcccagggcaccattgtggtggtcaatcccgaatttgcccggctgtttaatctgggttttcccgccgaccttctgctgggcaaaaatttaacggcgatcgccccccgcattaatggcttgatatcccatggccagggggtaacccacaactttttggcgatcgagtccccggaacccctgctaaaagtggaacttgccctagaggatgggcgcttttttgagcgagattatgtgccgatcatgttgggggatagctcccagggtcatttttggccttaccgggacatcagccaacgtaaacaggtggaaatgattcagggacagtccctggaaatggaacggcgcatgcggcaacaattggccgaacaaaatcaggaattggtggcggccaccacggcggcggaggcagctaatcggtctaaaagtgaatttttggccaccatgagccacgaaattcgcacccccatgaatgccatcatcggcatgaccggattattactagacacggacctaaccactcaacaaaaatatttcgcccaaaccatccgcaacagcggggaaaccctgctcaccttaattaacgatattttagatttttccaagattgaggccggcaaattagacctggaagtgtatccctttgatttggggcaatgcctggaggaagccttggacgtggtggtgccgagcgcccggcaaaaatccctcactctgatccgacgttttctcacccccattccccccaacctccagggggatgtgactcgcctcaggcaaattttggttaatctcctcagcaatgcggtcaaattcaccgaggcaggacaggtcaaggtgacggtggaagtggtggaccacgacgcagctaagggggaatatcaaatctgttttgcggtgcaggatacgggcattggcattgctcctaaccaacaacaggctttgttccaggcctttagccagggcaattcttccattacccgtcgctttggcggcactgggttaggcttggccatttgtgtgcggttgactgctttgatggggggcaccatctgggctgaaagtaatggctgtgtggtgggaaatccccctgaactttggcagatagggcaaccgacgatcgagggttcgactttctatttcacagtcaatttaacggtgctgcccagttgtgcctattctgtccataatttgcgccactccctcttcattgggcgatcagtgttagtggcagattacgatgagggccggggcaccagaatgcgaaatcttttggccagttggcgtctccaagcggagcaaattaccttttcctcccccgctaaactaggggaagatctcaaaagcagattaactcaaaaaaactatggtgccctcatcctccattgcccctatccagagggccggggaaagcagttcaccgattttgacttagggaaaattacaacctgggcccctacggaacaggacattccagtgttagtagccacggatatttatctatccccaggggagcgctacagcggcgacaaaccaccggtgcaagcctggatcaagagtcccattaaccccgatgagcttgaaaataccttggtggacgtgttggggcaaactgagcccccgaccctggtgtctacggaggcaattagcgggcctttgtttccctattcctcctctaatttaactattttgttggcggaggataacctaatcaatcagcaggtagctaagcttttactgaaaaagttggggtacccagtggatgtggtcaataacggtcaagaagctttatcggctttggcaaaaggtgattatgacgtggtgttgatggatgtggaaatgccagaaatggacggtttaaccgccacggagcatattcgacggtcccagggccggagtgaaaggccttggatcattgcggtgacagcctattccatggaaggcgatcgggaaaggtgtttggccagcggcatgaatgattatgtcagtaagcccattcgcctagaagccttacaacaggccctacaagtggccgccactgcgctccagtccaccagccaagatcggatggctactgtttcctgtgttagtgcttttgaggctaaaccatccccttctagtccctgcccagaagatccggctggcacaactttaccccccattgaccaagacataatctgttctctacgggacttggatcgagagaatggtcagttaattcttcgggagattatcgatatctattgccaaacggcgccggaactattgcaacggatcaaactggcgatcgccaatcaagattggggaaatttgagttcggccgcccatacattgggttctagcagtgctaatttaggggcggtactcctggcacaacaggctaaaactttggaaaatctgacccgccaacgggactcccgggccatggacccagggcatttcccgaccttagcggccagctacgaaagggtgcagggagaactgaaaactatgcttgatcgcctctaggcgatcgc

SEQ ID NO: 45 - DNA, 3045 bp, Unknown
  Synechocystis sp. PCC 6803
atgtccccatcccagccccacccacccattgctacttttgagccggagagttttctcattctggtggtggatgacgtaaaagagaatatttatgtgatttcggaactgttggaaggggaaggttacagcactacttttgtgacctccgggccggaagctttgcaacgggtgacccaggcccaaccggatctcattctgctggatttgatgatgcccggcatggatgggctggaggtgtgcgatcgccttaaacaagatccccaaaccagggatattccggtaatttttctcactgctagcaacgaaaaacaagatttgctgcaagcctttgccaagggggcagtggactatgtcaccaaaccctttagcccgccggaactgttggctagggtaaaaacccacctggaactgaaacaaaccagggataatctacaccacactctcctggaacaggccaggaccgccgaagccctggcctgtacttccacccgcctgggtatcctggtgcaaaatatgcaagcaggggtgttgatgaccgacgcccagggcaccattgtggtggtcaatcccgaatttgcccggctgtttaatctgggttttcccgccgaccttctgctgggcaaaaatttaacggcgatcgccccccgcattaatggcttgatatcccatggccagggggtaacccacaactttttggcgatcgagtccccggaacccctgctaaaagtggaacttgccctagaggatgggcgcttttttgagcgagattatgtgccgatcatgttgggggatagctcccagggtcatttttggccttaccgggacatcagccaacgtaaacaggtggaaatgattcagggacagtccctggaaatggaacggcgcatgcggcaacaattggccgaacaaaatcaggaattggtggcggccaccacggcggcggaggcagctaatcggtctaaaagtgaatttttggccaccatgagccacgaaattcgcacccccatgaatgccatcatcggcatgaccggattattactagacacggacctaaccactcaacaaaaatatttcgcccaaaccatccgcaacagcggggaaaccctgctcaccttaattaacgatattttagatttttccaagattgaggccggcaaattagacctggaagtgtatccctttgatttggggcaatgcctggaggaagccttggacgtggtggtgccgagcgcccggcaaaaatccctcactctgatccgacgttttctcacccccattccccccaacctccagggggatgtgactcgcctcaggcaaattttggttaatctcctcagcaatgcggtcaaattcaccgaggcaggacaggtcaaggtgacggtggaagtggtggaccacgacgcagctaagggggaatatcaaatctgttttgcggtgcaggatacgggcattggcattgctcctaaccaacaacaggctttgttccaggcctttagccagggcaattcttccattacccgtcgctttggcggcactgggttaggcttggccatttgtgtgcggttgactgctttgatggggggcaccatctgggctgaaagtaatggctgtgtggtgggaaatccccctgaactttggcagatagggcaaccgacgatcgagggttcgactttctatttcacagtcaatttaacggtgctgcccagttgtgcctattctgtccataatttgcgccactccctcttcattgggcgatcagtgttagtggcagattacgatgagggccggggcaccagaatgcgaaatcttttggccagttggcgtctccaagcggagcaaattaccttttcctcccccgctaaactaggggaagatctcaaaagcagattaactcaaaaaaactatggtgccctcatcctccattgcccctatccagagggccggggaaagcagttcaccgattttgacttagggaaaattacaacctgggcccctacggaacaggacattccagtgttagtagccacggatatttatctatccccaggggagcgctacagcggcgacaaaccaccggtgcaagcctggatcaagagtcccattaaccccgatgagcttgaaaataccttggtggacgtgttggggcaaactgagcccccgaccctggtgtctacggaggcaattagcgggcctttgtttccctattcctcctctaatttaactattttgttggcggaggataacctaatcaatcagcaggtagctaagcttttactgaaaaagttggggtacccagtggatgtggtcaataacggtcaagaagctttatcggctttggcaaaaggtgattatgacgtggtgttgatggatgtggaaatgccagaaatggacggtttaaccgccacggagcatattcgacggtcccagggccggagtgaaaggccttggatcattgcggtgacagcctattccatggaaggcgatcgggaaaggtgtttggccagcggcatgaatgattatgtcagtaagcccattcgcctagaagccttacaacaggccctacaagtggccgccactgcgctccagtccaccagccaagatcggatggctactgtttcctgtgttagtgcttttgaggctaaaccatccccttctagtccctgcccagaagatccggctggcacaactttaccccccattgaccaagacataatctgttctctacgggacttggatcgagagaatggtcagttaattcttcgggagattatcgatatctattgccaaacggcgccggaactattgcaacggatcaaactggcgatcgccaatcaagattggggaaatttgagttcggccgcccatacattgggttctagcagtgctaatttaggggcggtactcctggcacaacaggctaaaactttggaaaatctgacccgccaacgggactcccgggccatggacccagggcatttcccgaccttagcggccagctacgaaagggtgcagggagaactgaaaactatgcttgatcgcctctag

SEQ ID NO: 46 - DNA, 798 bp, Arabidopsis thaliana
atggaagtaacttcccaatctaccctccctccagggttcagatttcatcctaccgacgaagaactcatcgtttactatcttcgaaaccagaccatgtctaaaccatgccctgtctccatcatcccagaagttgatatctacaaattcgacccatggcaattacccgagaaaacagagtttggagaaaatgagtggtatttcttcagccctagagaaagaaaatatccaaacggagtcagaccaaaccgggcagctgtttccggttattggaaagcaaccggtacagacaaagccattcacagcggttcaagtaacgtaggtgtcaagaaagctctagtcttctacaaaggtagacctcctaaaggaatcaaaactgactggatcatgcatgagtatcgtctccatgattcacgtaaagcatcaacgaaacgtaacggttccatgaggttagatgaatgggtactgtgtaggatatacaagaagagaggagcaagtaagcttctgaatgagcaagagggtttcatggacgaagtactaatggaggatgagacaaaagttgtagttaacgaagcagagagaagaactgaagaagagataatgatgatgacgtcgatgaaacttccaaggacgtgttcgctggctcatttgttggaaatggattacatgggacccgtctctcacattgataattttagtcagttcgatcatcttcatcaacctgattcggagtctagttggttcggggaccttcagtttaaccaagacgagatcttaaaccatcatcgtcaagactatgtt

SEQ ID NO: 47 - DNA, 1838 bp, Saccharomyces cerevisiae
aaaaaagcaggctcctgcaggaccatgttatcactgtctgccaaaaatcacttcacagtgagtaattctataactcacgttattaagtcatatcatataaggactctcacttcaagcgcagaaaaaatgccacatatcactactcctttttctacctcagccagtagtacaaagttaaaagctttcaggaaagttagacccgtcctacagagacatagctcttcctggattgttgctcaaaatcatagacgttcattatctggtcaatcttcgctaaacgacctgcgtcatttgaatcgctttccacaccacacgttgaaaacttcgaataacgagttttatcccgccgaacaattgactttggaagacgtaaatgaaaatgtcttgaaggctaagtacgccgttagaggtgccatcccaatgagagctgaagaattgaaagctcaactggagaaggatcctcaatctctgccatttgacaggattatcaacgccaatattggtaatcctcagcaactacaacagaaacctctgacttactacagacaggtcttgtctctcttacaatacccagaactattaaaccaaaacgaacagcagctagttgattcgaaattgtttaaactagatgccattaaacgtgcaaagagtttaatggaagatatcggtggttctgttggtgcttactcttcttctcaaggtgtagaaggtataaggaaaagtgtcgctgaatttataacgaagagggacgaaggcgagatatcatacccagaggatattttcctaactgctggtgcatccgcagctgtcaattacttgttatcaattttctgtagagggccagaaacgggtgtcttgattccaattcctcaatatccattatataccgctactctagctttgaacaattctcaagctttaccatactatttagatgagaattcaggttggtcaactaatccagaagaaattgaaactgtcgtcaaagaggctatacagaacgaaatcaaacctacagttctagtggttatcaatccaggtaatcctacaggagctgtcctatcacctgagtctatagctcagatttttgaagtcgcagccaagtacggtacagtagtgatagctgacgaagtttatcaagaaaatatcttcccgggcaccaagttccattctatgaagaaaattttgagacatttacagagggaacatccaggtaaattcgataatgttcagctagcttctttgcattcgacttctaagggtgtttctggtgaatgtggtcaaaggggtggctacatggaactcactggattcagccatgagatgagacaagttatcttgaaactagcctcgatttcattgtgtcccgttgtcacaggtcaagctttggttgatttgatggttcgtccaccagtggaaggggaggaatcattcgagtcggaccaagcagaacgtaactccatccatgaaaagttaattacaagagcaatgacactgtatgagacatttaactctttagaaggcattgaatgtcaaaagcctcaaggtgccatgtatttattccctaagatagacttacctttcaaggcagttcaagaagctcgccacttagagttaactccggatgaattttattgtaagaagttgttagaatctactggcatttgcactgttcccggttctgggtttggtcaagaacctggtacttaccatttaagaacaacatttttggcacctggtctggaatggattaagaaatgggaaagtttccataaagaattttttgaccaataccgtgactagctcgagcctgcagggacccagctttcttgtacaaa

SEQ ID NO: 48 - DNA, 1538 bp, Glycine max
aaaaaagcaggctcctgcaggaccatggatccttacaagctccggccatccagcgccttcaattctcccttctggactacaaattctggtgctcctgtttggaacaacaactcctctttaaccgttggagctagaggtccaattctgcttgaggattatcatcttgtggagaagcttgcaaactttgacagggaacgtatcccagaacgtgttgtccatgccaggggagctagtgcaaagggtttctttgaggtcacacatgacatttctcacctgacatgtgcagatttccttcgagcccctggagttcagacgcctgtaattgttcgtttctcaactgtcattcatgagcgtggtagccctgaaaccttgagggaccctcgaggttttgccgtgaagttttacaccagagagggtaactttgaccttgttggaaacaaccttcccgtcttctttgtacgtgacggcatgaaatttccagatatggttcatgctcttaaacccaatcccaagaaccacatccaagagaattggaggatccttgacttcttctctcactttccagaaagccttcacatgttcacctttttatttgatgatttgggtgttccacaagattacaggcatatggatggttttggagttaacacatatacgctgatcaacaaggctgggaaagcagtgtatgtgaaatttcactggaagaccactagtggtataaagtgtctattggaggaagaggccattaaggtgggaggagccaaccacagccatgccactcaagacctccatgattcaattgctgctggtaactatcctgagtggaaactgtttgttcagacaatagatcctgagcacgaagacaaatttgactttgaccctcttgatgttactaagacttggcctgaggacattatacccttgcagcctgttggtcgcttggtcctgaataagaacatagataatttctttgctgagaatgaacaacttgcattttgccctgccattgtggttcctggtgtatactactcagatgataagatgcttcaaaccaggatattctcttatgctgattcacaaaggcacagacttggaccaaactatctgcaacttcctgctaatgctcccaagtgtgctcaccacaacaatcatcatgaaggtttcatgaatttcattcacagggatgaggaggttaattacttcccttcaaggtatgatcctgttcgtcatgcagaaacgttccccatacctcctgctatctgcagtggaaggcgtgaaaagtgtggaattgagaaggagaacaactttaagcagcccggagagagataccgatcttgggcacctgacaggcaagatagatttaatcgccgatgggttgatgctttatctgacccacgggtcacccatgaaatccgcagtgtctggatatcttactggtctcaggctgaccgttctctaggccaaaagatagcatctcgtctgagcatgaggccaaatatttagctcgagcctgcagggacccagctttcttgtacaaa

SEQ ID NO: 49 - DNA, 2695 bp, Zea mays
acaagtttgtacaaaaaagcaggctcctgcaggacccgtccgcctccgatggcgtcggcggcggggtcctcgaacgtgatgctcgcgatcaacgagaagaaaacgatcaccactgacctctaccgcccgctgcgcctctacatcgcctccacctactcggaacgcgaggccgctgcggccgacgacgaccttagcgtggtgtgcgacctccgcgctgctgtcgagaagccctccctcccggatccgtcctccctcgagcagcgccgcgacgcgctcctcgcctacgcgcgggctctggcactcgtggagccccgcttccccatctcccccgatcgcgcccacgtccactccctcaccttcacctggcacgacgcattcaaggggaacaagaagtgcgccctcgcctccatccacctcgagaaggcatccgtgctctttaacctcggcgccgtctactcccagatcgcgctcgccgcggaccgctcgactgacgtcgggatcaggatcgcgtgcggcgccttccagagtgcggcgggggcgttcgcgtggctcagggagagcggggccgcggcgaaggctgtcgctgcggggaccaccaccgtggacatcacgcccgagtgcgccggcatgctggagaaactcatgctcgcgcaggcgcaagaatgcttcttcgagaaggtcataggtggagggaagccacccgcgctgtgctccaaggtggcgcggcaggttggcatactctatgaagaagcatacacagctctcagtgcatctcctctaagtcagcactttgataagacatgggtgtcccatgtccagcttaaagctgctcaattctacgccgatgcttgctacaggtattcactggatcttcatgagaaagaagaaattgctgaggaaattgcacgtttaaagattggtatgagtgccttggcagatgctaagaagactacgaagggagttgctgcccaacttctggattccgtcaacaagctggaaagtaacatgaaaaccaacttggaaagggctatgaaggagaatgatcgtgtttacttgatgcgggttccagctgctggttccttgggtgccctccctgcagcgtcccttgtaaaacctacctctttggctgaagttttagatgccagcaaggaaaggcttttttcatcacttgtgcctgatggcagcatgaaagcactttctaagtacacagagatggtagataatagtatccggacccaggctgagaaattgcagcaagctagtgagatcactagagtcaggctgaaggaaatggacttaccagattctattctttcattggaaggaaatataaccttgcccatggatctgaaggaagacgtagaggctgtgcagataagcggtggccctgctggcttagaatctgagttgcagcaacttagggatttgagcagggtcaatcaggaactacttgtccagactgaagagcttctacagaaggaggcgaatgaagacgctcaatttcgtacacaatttgggagtcgttggactagacctcaatcaagcaccctaacaaagaatattcaggatagattgaatctgtttgcttctaatttgaagagagctgctgatagtgattctctgattgaacgaggcgtgaaggagaactattcattgatgtctatccttgacaaaagaccgatagagtctgcacttccaagtatttccaggcctatcatgtccttggatggaaatgaagatgccattgttggagccctgaaacaaagcttgagacaactggagtctcttggcgcacaaagggcaggtcttgaagacatgctcaaagaaatgaaaagaaaggatgatatattgcctaagttgatggttggcgtgggatcacatgatgatcttttcaagaaggagattgctaagtatgatcctatatgtgctgatattgctgataacattgtggcacaggaacaattgttgctacaaatacaggcacaaaacgagcaatttgctgctgtattcaacctagaggattacaaagctgcccgtgagagatgttacaagcaaatcgctgctgctgttgtgaaataccaggagtttaaaaagaacatcaacgagggcctaaacttttatgtgactttacaggaagcaattggcaaaataaaacagcagtgcagcgacttcataatgacccgaaacattcagtgccgtgaaatgatggaagatgtgcagaggaagctacccggcttcagattctcgtcgtccagccgctcctctatgcagaggaatgctgcttctgtgccacctgacgagagcagcccatcaccgccaccgccgcatgcccaggctccctatgcctctccaccaggggtagactcgaggcatggatattctcaaccggaggcaagacctgcatactcgcagccataccccccatcctatggcgcgacaccgcaacagccgacgtatggtgcacaacaccccgggcagtaccagccgcctcctggccatgactgcggtcagccggcatatcctggatggcgcgggccatacccatactacaatgccccccagccgcagcaatctgtgccatgtccacaggcgccgtacaatgccactggggcttaccctccgcaccagagcaactattaccgacctcaataagtgctgcaatagctcgagacccagctttcttgtacaaagtggt

SEQ ID NO: 50 - DNA, 719 bp, Zea mays
atgggacttgtatccgatgaactttacaagaatgctagggagaactgtggtggaaagtatagtgctccactgaatgctgtatgtgcagaggctgtccaagctatcaacaattgcacacgggatatcaataagcaatacatcttggatcctgcttgcccggatgatgatctgttgagccccaagactgtagcagagacagatggaacgagcaggttgatgctagagtctgcagattttctacttggttccaaatgtgcagaagctttatacattctatcctacgcttgggggaatgatgatacagttcaggagagcctcggtatccgcaaggggacaattggagcatggaaacgatgcagccatgcattgccttacaattatgatatccagagtgtagtggattaccattcaaggctagccacaaaaggatacagggcgctgatatacagcggcgaccacgatgctgttgtaccccatgttggcacacaagcatggattagatacctcaacttgacaatcgttgatgattggcgaccatggtacgttggaggccaagttgctggattcacaaggagttatgcgagcggcctaacatttgccactgtgaagggtgctggacatgttgcgccgttgtataagaccttggaatgccaaaaaatgtttataacatggatttcagggaatcctctttagctcgagacccagctttcttgtacaaa

SEQ ID NO: 51 - DNA, 1658 bp, Zea mays
acaagtttgtacaaaaaagcaggctcctgcaggacctcctctctgccggcgccggcgatgggcaactcgctggggtgctcggcctccggcgagcggctcgtctcggcggcgcgcgacggggacgccatcgaggcgcggatgctgctggagctcagccccgcgctcgcgcgctactccaccttcggcggcctcaacactccgctacacttcgccgccgccaagggccatctcgacattgtcacgatgctgctggagaaaggcgctgacgttaacgcccgcaactactgcggccagactgcgctgatgcatgcttgtcggcatgggcactgggaggtggtgcagatgcttcttctatttagatgcaatgttactagggcagattacttgagtggtcgaacagcactgcattttgctgcacatgatggatttgttcggtgtattagacttttagttgcagactttgtcccgagtgtggccttggaggatattgcttcttctgtggtggatggtggtgattgccagacaaacagtgggagcagtcctaattcatcgtcggggcagaagtttaatgaatcggcccgtgtgaggtacatcaacaaacctgcagatggtggtgttacagcacttcacatggcagcattgaacggtcacttagattgcatgcagttgttgattgacttgggcgctaatgtctcagctgtctcattcccctatggcactactgcaaatttgataggagctggcagtacaccgttgcattatgcagcaggtggggggaaacaagaatgctgtgagctactaatatcaaaaggcgctagcaggttgacactcaattgcaatgggtggcttcccgttgatgttgctagaatatttggacggcgctctttggagccattactttctccaaattcacactcgaatgtccctgtatttcaaccgtccagttatcttgccttgccactcatgagtatacttaatatagccagagaatttgggttgcagcataccacaccctcgattgatgataatgatctatgttcagtttgtctagaaaggtcttgttctgttgttgctgaaggttgcagtcatgaattctgcatcaaatgtgctctctacctctgctcaaccagcaacatccgtgtcgagttcacaggcccacctgggtccatcccgtgccctctttgtcggaacggcataatgtctttcaccaagttaccaagcacaccaacagaagggcttaaatcaggttcagcgctcacattctgcaacccatgcatactgaacacccggtccatggactcgccagccactttctccaaagccgaaatcagacggaaccgtgtggcagctgtctcttcggagctggtctgtccaatcacctgcagcccattcccgtcgtccgccctcccaacctgcaggtgcagcgacgacgatccatgcggcgatacagacgtgcaggatggtcccgagttccagtctccccggccctcgcacagcgcaagcatggagctggacaagaggggggagggggatctagaccgggccagctgctcaggcatgttctggagccgaagaagctgccacagggagcagcagtgtgatgcggagatcaacgcttgattcttagctcgagacccagctttcttgtacaaagtggt

SEQ ID NO: 52 - DNA, 1121 bp, Zea mays
atgcgccggtggttttgctgcacgaggtttaatgcttcataccgtgaacatgaaaatgaacgtcccatcactccagaggagaaagaaggaaatggtttttctgttaaaagtgatcccatcaaggcaccaccttccattgaagtccctgaattatcatttgaagaattgaaagaaaagaccgacaattttggttcaaaggctttgattggtgaggggtcatatggaagagtatattatgctattctggacagcggaaaacatgttgctgttaaaaagcttgacgcttcaacagaccctgaacttgataatgagtttttgacacaggtatccattgcctcaaaactaaaacatgataattttgtggagatgcttggatattgtgtggaaggaaatcagcgtctagtggtctatgaatttgcgacaatgggttctctgcatgatatcttgcatggaagaaagggtgttccaggtgcacagcctggcccagcacttgattggatgcagcgggttaagattgctattgatgctgctaaagggctagagtatcttcatgaaaaggtgcagccttcaatagtccaccgggacatacggtctagcaatattcttctgtttgaggactacagagcgaaaattgcagatttcaatctttcgaatcagtctccagatatggctgctcgtttgcattctactcgtgtccttggaaccttcggctaccatgctcccgagtatgccatgactggccagctaactcagaagagtgatgtatatagctttggggttgttcttttagagcttctaacaggaaggaaaccagtagatcatacaatgcctagaggtcagcagagtctggttacatgggcaacacctagattgactgaggacacagttaaacaatgtgttgatccaagattgaagggagaatatcctccaaagggagttgccaagcttgcggctgtggcggcactgtgtgtgcaatatgaatctgaatttagacccagcatgagcatcgtagttaaggcactctctccccttcttcaacataaaccgcaaccaccggcagccactactgacgctacagcaccgtcagatgcctagctcgagacccagctttcttgtacaaa

SEQ ID NO: 53 - DNA, 941 bp, Zea mays
aaaaaagcaggctcctgcaggaccatggagacctctgcagcaaccccgacccggccgccacaccaggcggccacttccccatcgccatcgccctcgtcgtcgctgaggctgtggaggccagcggcgcagcgcaacatgcgcaatcagtggtcccatctgagcgccgccaaggagcagtggctggccgccgttgctgacggccgtgcccacgcctccgcgctcgtcaacgtccacctctcctgcaggaacatgccgacgatggatttgggggtgctcaaggatatgccggggatccgcgataaggcgaactccaagttggcgcttagagaggagcaatacagcggcatgcttctgtcggcctacaaggagatggtccgtcagctgtcctacttggttgaagcttcccattctatgcgccgtttttctaaagcggctccaaattgccccatcacacagttttctgaccgccaagataatttgaatgattcaggggatggtggaggagccccagtattcaaatggttctctgtattagaatttgagagtcttgcccaggagcttgttcagatgtttgtttcagagcaaaagttgaagaggctgctactcttggaatttctctcgattgctttaaaggaaggtgtagaactccagacatcattaaattggggtgatgaactatatgatggtgaatcaaataaacttcagagtattggccttcagtcaggagatgcctactcaccgcctgaaaattggtgtgcagaacgtttagggagtcagagacctggcaatctccctctgcacgaagttttacaggtttatttaaccacttggcatgctaatatgaacatcaaccggagtagaattgatgaaatatttgagcttgttgaggaggagatgaagattaaactgtcttagctcgagacccagctttcttgtacaaa

SEQ ID NO: 54 - DNA, 1769 bp, Saccharomyces cerevisiae
aaaaaagcaggctcctgcaggaccatgtgtggtattttcgccgctttcaggcacgaagacgtgcatagatataagccaaaggctctacaactatcaaaaagaatcagacaccgtggtccagattggtccggtaatgctatcaagaactccactatatttgttcatgaaagactagccattgtcggtgtggaatccggtgctcaaccaattacttcttcagacggagagtacatgctatgtgttaacggtgaaatctacaaccacattcaattaagagaagaatgcgcagactacgagtttggaacactgagtgactgtgagcctatcatcccaatgtacttaaagcacgatatcgacgctcctaagtacttggatggtatgtttgcttggactctttacgacgctaaacaagatcgtattgtggcagccagagacccaatcggtattacgacattatatatgggacgctcttccgcttctccaaagaccgtttattttgcatccgaactaaaatgtttgactgacgactgtgacactatcactgcattcccaccgggccacgtatacgattctaagactgacaagatcacccgttacttcacaccagattggctggacgaaaaacgcattccttccaccccaatagattacatggcaattagacactccttagaaaaagccgttagaaagagattaatggccgaagtcccatacggtgttctattgtcgggtggtttggactcctctttaatcgcttccattgctgcccgtgaaactgcaaaggccactaacgatgtcgaaccatcaacttacgatagtaaggcaagacatctagcaggtatcgacgatgacggtaagctacacactgctggttggacaagtctccattcctttgccatcggtttaccaaatgctccagatttgcaagccgcaagaaaggttgccaaattcatcggctctattcatcatgaacacacctttacattacaagaaggtttggatgctttggacgacgtgatctaccatttggaaacttacgacgttaccactatcagagcttccactccaatgttcttactatccagaaagattaaggcccaaggggtcaagatggttctttccggtgaaggttccgatgaaatcttcggtggttatctatatttcgcacaagctccttctgcggcagaatttcacactgaatccgtgcaacgtgtcaagaacttgcatttggcagattgtttgagagctaacaagtctacgatggcttggggtctagaagctcgtgttccattcttagacagagaatttttgcaattgtgtatgaacatcgatccaaatgaaaagatgattaaaccaaaggaaggacgtattgaaaagtacattctaaggaaggcattcgacaccacaggagaaccagatgctaagccatatttaccagaagaaattttatggagacaaaaagaacaattttccgacggtgttggttactcctggatcgacggattaaaagataccgccgaagcagtcatttcagatgaaatgtttgccagtccaaaggccgaatggggtagtgacattccaaccacaaaagaggctttctggtacagactaaaattcgatgctttgttccctcaaaagaccgtggctgacaccgttatgagatggattccaaaggccgactggggttgtgctgaagatccttctggtagatatgcccaaattcatgaaaaacatatcgaatagctcgagacccagctttcttgtacaaa

SEQ ID NO: 55 - DNA, 568 bp, Oryza sativa
acaagtttgtacaaaaaagcaggctcctgcaggaccatggagagcgccatgttcgggctggagacgccgctgatgacggcgctgcagcacctgctcgacatccccgacggcgagggcggcgccgccgggaagcagggcgcgaccggtggcccgacgcgtgcgtacgtgcgcgacgcccgcgccatggcggcgacccccgccgacgtgaaggatctgcccggggcgtacgcgttcgtggtggacatgcctgggctcaagtcctccgacatcaaggtgcaggtggaggaggagaggctgctggtgatcagcggggagcggcggcgcggcggcggggaggaggagaaggaggagtcgtgcaagtacctgcggatggagcggcggatgggcaagttcatgcgcaagttcgtgctccccgacaacgccgacgtcgacaagatctccgccgtgtgccaggacggcgtgctcaccgtcaccgtcgagaagctcccgccgccggagcccaagaagcccaagaccatcgaggtcaaggtcgcgtagctcgagacccagctttcttgtacaaagtggt

SEQ ID NO: 56 - DNA, 473 bp, Saccharomyces cerevisiae
aaaaaagcaggctcctgcaggaccatgtgttgctactgtgtttgttgtaccgtttctgactttatactgtatattgttgcgttttttttccccccagctgcagtccttcttcgatctgggccttgttcatctgatttcctcctgaatgtattgctaacgctactgggatttttgcccggtatgttacacgcattctactacatcacaattacaagtcctttaaggaacgctgaatacgtctattattaccagcaaggctgggtggatagcgaaagaaacgttccttcgaatcgtcctcaaaactcgcagaccccccaaaaccgcccacaacaaggaagctccgctagaaacgtatacccgagcgttgaaactcctctgttacaaggcgcagctccccatgacaacaaacagtctctggttgagtctcctcctccttatgtgccatagctcgagacccagctttcttgtacaaa

SEQ ID NO: 57 - DNA, 1154 bp, Oryza sativa
aaaaaagcaggctcctgcaggaccatgagcagcacagctccactcctcacaccctacaagatgggaagatttgatctttcccacagggtagttctcgcaccactgacaaggcagcgatcctatggtaatgttcctcagcctcatgccattctgtactatcagcagagaacaaccaaaggaggccttttgattgctgaggccactggaatctcggacactgctcaagggtacaaagatactcctggtatttggacaaaggagcaagtggaagcgtggaagccaatcgtagacggcgttcatgccaaaggaggaatatttttctgtcagatttggcacgtaggaagagtctctaataacacttttcagcctaatgggcaggctccaatttcgagcaccaataagtcactaaaacctgcagtaagagccaacggcatagatgtggctactttctcaactcctaggcgattagagactgatgagatcccttttgtcgtgaatgattacagggttgctgctagaaatgcaattgaagcaggatttgatggtgttgaaatccatggagctcatggttatttgatcgatcagtttctaaaagaccaagtcaatgatcgttctgacaaatatggtgggagcttagagaatcgctgccggtttgcgctagaagtggtccaagccgtaactgatgaaattggagctgacaaggttgggataaggctgtcaccctttgccagctattcagaggcagcagactcaaacccagaagctctaggcctatacatggcaaatgcactaaacaagtttggtatcctctattgtcacatggtggagccacggatggtaaagcttggtgaaaagtttgaaaccccccatagtcttcgtccaatcagggatgctttcaagggaacgtttattgctgctggtggctacaataaggaggatggaaataaagcagtctccactggatatactgatttggttgcttatgggcgcttgtttttgtctaatcctgatttgcctgagaggtttgaaatagatgctcctctcaacaaatacaacagagagactttctacatctctgatccagttattggatacactgactacccatttcttccatcagatgtctagctcgagacccagctttcttgtacaaa

SEQ ID NO: 58 - DNA, 1172 bp, Glycine max
aaaaaagcaggctcctgcaggaccatggctcttgagtcagctcctgcttcagctgacatcagaggagttcacactcatggtggaggctatgttcagtataatatctatggaaacctctttgaggtctctaggaagtatgtccctcctattcgccctgtgggaagaggagcatatggaattgtttgtgctgctgtaaatgcagagacgcatgaagaagttgccattaagaaggttggcaatgcatttgacaacagaatagatgccaaaaggaccctacgagaaattaaacttcttcggcacatggaacatgaaaatgtgatagcccttaaagacattattcgaccaccacaaaggtataacttcaatgacgtgtacattgtttatgagttaatggatactgatctgcatcaaataattcaatccaatcaacaattgactgatgatcattgtcggtattttctgtatcagttgttacgaggactcaaatatgtacactcagcaaatgttctgcaccgtgatctaaagcctagcaacttgctactgaatgccaactgtgatcttaagattgcagactttggtctcgctagaactacatctgagactgatttcatgactgagtatgtggttactcggtggtaccgagctccagagttacttcttaattgctcagaatatactgccgccattgatatttggtctgttggttgcatccttggtgaaatcataacaagacaacccctatttctggggaaagattatgttcatcagctcaggctgattacggagctcataggctcacctgatgacactagccttggatttctacgaagtgataatgctcgtagatatgtgagacagcttccacaatatccaaggcaacaatttgctgctagatttccaagtatgtctcctggtgctgttgatttgttagagaagatgcttgtctttgatccaaataggcgcatcacagttgaagaagctctgtgtcacccatacttggctcctcttcatgatattaatgaggaacctgcttgcgttagacctttcagttttgattttgagcaaccatctttcactgaagaagatatcaaggaactcatctggagagaatctgtgttattcaatcctgatccacctatttattagctcgagacccagctttcttgtacaaa

SEQ ID NO: 59 - DNA, 1559 bp, Arabidopsis thaliana
aaaaaagcaggctcctgcaggaccatggtgctctcccacgccgtatcggagtcggacgtctccgtccactccacattcgcatcacgttacgtccgtacttcacttcctaggttcaagatgccggaaaactcgattcctaaggaagcggcgtatcagatcatcaacgacgagctgatgcttgacgggaatccacggttgaacttagcctcctttgtgacgacatggatggagcctgagtgtgataaactcatcatgtcctccatcaacaagaactatgttgacatggacgagtaccccgtcaccaccgaacttcagaaccgatgtgtgaacatgattgcacatctattcaatgcaccgttagaagaggcggagaccgccgtcggagtaggaaccgttggatcatcggaggccataatgttggccggtttggccttcaagcgtaaatggcagaacaagcgcaaagctgaaggcaaacccgtcgataaacccaacattgtcaccggagccaatgttcaagtgtgttgggagaaattcgctaggtactttgaggttgaacttaaggaagtgaaattgagtgaaggatactatgtgatggaccctcaacaagctgttgatatggttgatgagaacaccatttgtgttgcggccattcttggttccactcttaatggagaattcgaagatgttaaactcttgaacgatctcttggtcgaaaagaacaaagaaaccggatgggatacaccaatccacgtggatgcggcaagtggaggattcattgcaccgtttttgtatccggaattggaatgggactttagacttcccttggtgaagagtatcaatgtgagtggtcacaagtatggacttgtgtacgcagggattggttgggtgatctggagaaacaaagaggatttgcctgaggaactcatcttccatatcaattatcttggtgctgaccaacccacctttactctcaatttctccaaaggttcaagtcaagtcattgctcaatactaccaacttatccgattgggccacgagggttacagaaatgtgatggagaattgcagagagaatatgatcgtcctaagggaaggacttgagaagacagaaaggttcaacatcgtctcaaaggacgagggagtgccacttgtcgctttctccttgaaagatagcagctgtcacactgagttcgaaatctccgacatgcttcgcaggtatggatggatagtgccggcctacacaatgcctccaaatgcacaacacatcactgttcttcgtgtggttatcagagaagatttctcgagaacactcgctgagagacttgtgatcgatatagagaaagtgatgcgtgagctcgatgagcttccttcgagagtgattcacaaaatatcacttggacaagagaagagtgaatctaacagcgataacttgatggtcacggtgaagaagagcgatatcgacaagcagagagatatcatcactggctggaagaagtttgtcgccgacaggaagaagacgagtggtatctgctagctcgagacccagctttcttgtacaaa

SEQ ID NO: 60 - DNA, 1594 bp, Arabidopsis thaliana
ggaagttcatttcatttggagaggaccaggtggtaccatggtgctctcccacgccgtatcggagtcggacgtctccgtccactccacattcgcatcacgttacgtccgtacttcacttcctaggttcaagatgccggaaaactcgattcctaaggaagcggcgtatcagatcatcaacgacgagctgatgcttgacgggaatccacggttgaacttagcctcctttgtgacgacatggatggagcctgagtgtgataaactcatcatgtcctccatcaacaagaactatgttgacatggacgagtaccccgtcaccaccgaacttcagaaccgatgtgtgaacatgattgcacatctattcaatgcaccgttagaagaggcggagaccgccgtcggagtaggaaccgttggatcatcggaggccataatgttggccggtttggccttcaagcgtaaatggcagaacaagcgcaaagctgaaggcaaacccgtcgataaacccaacattgtcaccggagccaatgttcaagtgtgttgggagaaattcgctaggtactttgaggttgaacttaaggaagtgaaattgagtgaaggatactatgtgatggaccctcaacaagctgttgatatggttgatgagaacaccatttgtgttgcggccattcttggttccactcttaatggagaattcgaagatgttaaactcttgaacgatctcttggtcgaaaagaacaaagaaaccggatgggatacaccaatccacgtggatgcggcaagtggaggattcattgcaccgtttttgtatccggaattggaatgggactttagacttcccttggtgaagagtatcaatgtgagtggtcacaagtatggacttgtgtacgcagggattggttgggtgatctggagaaacaaagaggatttgcctgaggaactcatcttccatatcaattatcttggtgctgaccaacccacctttactctcaatttctccaaaggttcaagtcaagtcattgctcaatactaccaacttatccgattgggccacgagggttacagaaatgtgatggagaattgcagagagaatatgatcgtcctaagggaaggacttgagaagacagaaaggttcaacatcgtctcaaaggacgagggagtgccacttgtcgctttctccttgaaagatagcagctgtcacactgagttcgaaatctccgacatgcttcgcaggtatggatggatagtgccggcctacacaatgcctccaaatgcacaacacatcactgttcttcgtgtggttatcagagaagatttctcgagaacactcgctgagagacttgtgatcgatatagagaaagtgatgcgtgagctcgatgagcttccttcgagagtgattcacaaaatatcacttggacaagagaagagtgaatctaacagcgataacttgatggtcacggtgaagaagagcgatatcgacaagcagagagatatcatcactggctggaagaagtttgtcgccgacaggaagaagacgagtggtatctgctaggcgatcgcgggccctgatcacctgtcgtacagtatttctacatttgat

SEQ ID NO: 61 - DNA, 553 bp, Glycine max
acaagtttgtacaaaaaagcaggctcctgcaggaccatgtctctaatcccaaacttcttcggtggccggagaaacaatgtgttcgatcctttctcactggacgtgtgggatcccttcaaggattttcctttcccaaatacgctttcttcagcttccttccctgaattttctcgggaaaattcagcatttgtgagcacccgtgtggactggaaggagaccccagaggcgcacgtgttcaaggcagatattccaggactgaagaaggaggaagtgaaggtgcagattgaagacgataaggttcttcagataagcggagagaggaacgttgagaaggaagataagaacgacacgtggcatcgagtggagcgtagcagtggcaagttcatgagaaggttcagattgccggagaacgctaaagtggagcaagtgaaggcttctatggaaaatggggttcttactgtcactgtccccaaggaagaggttaagaagcctgatgttaaggccatagaaatctctggttagctcgagacccagctttcttgtacaaagtggt

SEQ ID NO: 62 - DNA, 1840 bp, Zea mays
acaagtttgtacaaaaaagcaggctcctgcaggaccacaccgccgaccatgtaccgggcggcggctgtcatctcgaggtcctcatcagcactgcggaggcagctcgcgcggggcgtggccggggagctgccgcgtctgttggcgcgagggtatgcggccacggcgaaggaggtgtccttcggcgttggcgcccgcgccgccatgctgcagggcgtcaacgacctcgccgacgccgtcaaggtcaccatgggccccaaggggcgcactgtgatcatcgaggggtcccataaaggtcccaaggtcacgaaggacggggtcactgttgcaaaaagcgtggagttcgaggatagcgcgaagaatgttggggcgaatctggtgaagcaagttgctgatgctacgaacaaagctgcaggggatggtaccacctgtgcaactgtgcttacacaggcaattcttactgaaggatgcaaggccgtggcagccggtgtcaacgttatggacttgcggaatggtataaacaaggcaataaatgctatcactgctcacctcaaaagtaaagcgtggaagattaattctccagaagaaattaaccaggtagcaaccatttctgcaaacggtgaaaaggaaattggagatctaatatcaaaagccatggaaaaagttggaaaggatggagtcattactattgttgatggcaaaacattggacaatgagcttgaagcagtacagggaatgaagctgtccagaggatacatatctccttactttgtgactgatcaaaagactcagaaatgtgagatggagaaccctcttattcttatccatgacaagaaaatctcaaacatggattctctccttccagcattagaaatttctatcaagaatcgcaagcctcttctcattgttgctgaggatgttgaaggagatgctctgtcaatgcttgtactgaacaagcatcgtgctggactcaaggtatgtgctgtcaaagctcctggatttggtgaaaatagaaggcacaatctagatgacatggctgtgatgactggaggagaggttattagcgaggaacgcggtcttgatcttggcaaagttcaattacaaatgcttggcactgctaaaaaggtaactgtatcccttgatgatactatcatcctagatggtggaggtgacaaacagcagatagatgagaggtgccaacagcttagagaatcaattgacacaagcactgctgtattcgacaaagaaaaggcccaagagcgtttatctaagttatctggaggtgttgctgtactcaagattggtggagctagtgaagctgaagttggtgagaaaaaagatagggtgacagatgctctaaatgctgcaagggctgctgtggaggagggcattgtgccaggtggtggagttgcccttctttatgccaccaaggagcttgacaagattagcacagcaaacgaggacgaaaagattggagttcaaattatcaagaattctttgaaggctcccttgatgaccatagctgcaaatgctggcattgatggagctatagtcatagggaagctgattgaacaagaggacctcagtttgggctatgatgcagcaaaaggggagtacgtagacatgatcaaggccggcatcatcgatcccgtgaaggtgatccgcaccgcacttcaagacgctgcaagtgtttccctgctgatggcaaccacggaggccgctgtctccgagctcccggcaaccaagtccagaatagccagccgtatgccgcagatgagcgggatggacttctgaggaaattcaggcgcctagctcgagacccagctttcttgtacaaagtggt

SEQ ID NO: 63 - DNA, 1847 bp, Glycine max
ccgccgccgccgcgccggtaaccaccccgcccctctcctctttctttctccgttttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaccgcgggatatcacaagtttgtacaaaaaagcaggctcctgcaggacctctcttctctcctccaaaaatgatgaaaactactatgaatatctcaaatgctaaccacgagaaagtggagaaagcgtttgcgttcttgactggcaatcatttcatcaaccatcattatggagccatcctcagcaagtgcttgaaaggtcttcctgtgagagattttgatgcacaagagatcattcccggtttatatttaggggatgtatatgctgcacataacacaaaagaattgaaatcacgtaacttcacccacattgtgacctgcactgtaggagttgtccctccctttcccgatgctttcaagtacatgcatttgaaaattttggattttgcaggagagaccattgacgtacactttacttcaacaactgatttcattggggatgctattgctaatggaggaaaagtgttggttcactgtattcgtggagtgtcaagatcagccactattgtttcagcttatttaatgaagagtatgagtttatctgcagaggatgctgttgagcatgttagaagagttcgtgctattgctcgtcccaactatggttttatgatgcaattacaattgtatcacaaagaattgaataaaggaatgatgaatgtggaaatttcagatgagcaaaatttaccagctgccgaatggtaacatagctcgagacccagctttcttgtacaaagtggtgatggggatcccccaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcat

SEQ ID NO: 64 - DNA, 2182 bp, Saccharomyces cerevisiae
acaagtttgtacaaaaaagcaggctcctgcaggaccatgtacaacattccagataatgtcaaaggggctgtagaatttgatccatggttgaaaccgtttgccgatgtactttctgaaagaagatacctagctgacaagtggttgtacgacataactcatgctacgcctgatggttcgtatcagtcactcagtaagtttgctagagattcatacaagtcatatgggttgcatgccaatccggaaaccaaagaaatcacttacaaagagtgggcacccaatgcggaacgtgcatttctagtgggagatttcaataactgggataccacatctcatgagctcaagaacaaggacgaatttggaaattttacaatcacacttcatcctttacctaacggcgatttcgccatccctcatgattcgaagattaaagtcatgtttattttgccagatggttccaagatctttcgtttacctgcgtggatcacaagggctacacagccttctaaggaaacttctaaacagttcgggcccgcatatgaaggtaggttttggaatccagagaacccctacaaatttgtacatccaaggccaaagtttagtgaatctgtagattccttaaggatttatgaagcccacgtcggtatttcgagtccagaaccaaagataaccacatataaagaatttactgagaaggtcttacccagaatcaaatatcttggctacgatgcaattcaattaatggctattatggaacatgcttattatgcatcatttggctaccaagtgaccaatttttttgcggcgagctcccgtttcggcacccctgaggaattaaaggagctgattgatactgcacattctatgggcatcctagttttattggatgtagttcatagccatgcttctaaaaacgtcgaggatgggttgaacatgtttgacggttctgatcatcagtatttccattctataagctccggtaggggtgagcatccgctgtgggattcccgtctttttaattacggaaaatttgaagtgcagcgattcttattagcaaacctggcattttatgttgacgtttatcagtttgatgggtttagattcgatggtgtcacatcaatgttatacgttcatcatggtgttggtgccggtgggtcttttagcggtgactataacgaatatctttctcgtgacaggtccttcgtcgatcatgaagccttagcttatttaatgttagccaatgatttggttcacgaaatgttgccaaatctggctgtaactgttgcagaagatgtctctggttatccaactttatgtttaccccgctccataggtggtactggtttcgactacagattagcaatggctttgcctgatatgtggatcaaactaatcaaggagaagaaagatgatgaatgggagatgggaagtattgtatacactttaactaatagacgatatggtgaaaaagtggttgcttattgtgagtcgcacgaccaagctttagttggtgataagacattagcgttttggttgatggatgccgctatgtacaccgatatgactgtattgaaggaaccatccatcgttattgaccgtggtattgctctacacaagatgattaggctgatcactcactcgctgggaggcgaggcttatttgaacttcgaaggtaatgagttcggtcatccagaatggttggatttccctaatgttaacaatggcgatagctacaagtatgctcgtaggcagtttaatttggctgatgatcccttactgcgttaccagaatttaaatgagtttgatagatcaatgcaattatgtgagaaaaggcataagtggctgaacacgaaacaggcttatgtttcattaaaacatgaaggtgacaaaatgattgtgtttgaaagaaataatctgttgtttattttcaacttccatcctacaaacagctacagcgattatagagttggtgtcgaaaaagctggtacttatcacatcgtgttgaactcagatcgtgctgaatttggtggacataacagaatcaacgaaagttccgaattctttaccaccgatttggaatggaacaacaggaagaacttcctccaagtttatattcctagtagagtcgctttggtgcttgccttaaaagaatagctcgagacccagctttcttgtacaaagtggt

SEQ ID NO: 65 - DNA, 637 bp, Arabidopsis thaliana
acaagtttgtacaaaaaagcaggctcctgcaggaccatgggttgtgttcgctgcaaatcatcagatccatggcaaacatctgccaatgcctttgaatccgtcgatgaatccggaatcaacgaagcctgggttgagatctccagccgcagatcatttgtcgccggcgaaggtagtcggaagaagctagagaggaagaagagccaagtgttactggaaggttacgttgagactgcttcttcttcctcggtggatgatcaaaaggacgatctgacgagatccaagagtttgacggatgacgacctcgaagatcttagaggttgtttagatctagggtttggttttagctacgacgagatccctgagctctgcaacactttacctgctttggagctttgctattcaatgagccagaagttcttagacgataagcaaaataaatcaccggaaacttcgtcggtggaagattgtccgtcgcctccactggtcaccgccactccgattgccaattggaagatctctagtcccggtgataatccggatgatgtgaaagctaggctcaaatactgggcacaagccgttgcctgtactgtccaattgtgcagctagctcgagacccagctttcttgtacaaagtggt

SEQ ID NO: 66 - DNA, 1768 bp, Zea mays
acaagtttgtacaaaaaagcaggctcctgcaggaccatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgtaccaaattgaaggtgcttggaatgaagatggaaagggggaaagcaactgggatcacttctgccacaatcatccggaaaggatactggacgggagcaattcagacattggagcgaattcgtaccatatgtacaaaacggacgtcagattgctcaaggaaatgggcatggacgcatataggttctctatctcttggcccagaatactgccgaagggaaccaaagaaggaggtattaacccggatggcatcaagtactacagaaacctcatcaacttgttgctggaaaacggcatagagccatatgtaacaattttccactgggatgtacctcaagcactagaagagaagtacggcggcttcctagataagagtcataagagcattgtagaagattacacctacttcgctaaggtgtgctttgataacttcggcgacaaggtgaagaattggttgacctttaatgagccccagacatttacttccttttcctacggaactggggtctttgccccagggcggtgctcacctggactagactgtgcctacccaactgggaattcactcgtcgagccttacactgctggccataacattctcctagcccacgctgaggctgttgatctttacaacaagcattacaagcgcgacgacacccgcatagggcttgcgtttgacgtaatgggtcgtgtgccatacggaacatcgtttctggataaacaggccgaagaaaggtcatgggacatcaacctaggatggttcttagagccagtggttcgtggtgactaccccttctccatgagatcattggctagggaacgactacccttcttcaaggacgagcagaaggagaagctcgccggttcctataacatgttggggttaaactactacacctcacggttctccaaaaacatcgacatctcaccaaactactcacctgtgctcaacactgacgacgcctacgccagtcaagaagttaacgggcctgacgggaagcccattggtcctcctatgggaaatccatggatctacatgtaccctgagggcttgaaggatctccttatgataatgaagaacaaatacggaaacccacctatctacatcaccgagaacggaatcggggatgttgataccaaagagacacctctacccatggaggctgccttaaatgactacaaaaggctagattacatccagcgccacatcgctactcttaaggaatcaatagacttgggatcaaatgtgcaaggctacttcgcttggtctctgctggacaactttgaatggtttgccggcttcaccgaacgttatggcattgtctacgtcgaccgcaacaataactgcacgcgctacatgaaggagtctgccaagtggttgaaagagttcaacaccgcgaaaaagcccagcaagaagattcttacgccagcttagctcgagacccagctttcttgtacaaagtggt

SEQ ID NO: 67 - DNA, 1347 bp, Zea mays
acaagtttgtacaaaaaagcaggctcctgcaggaccagaagcagctagccatggcggcggcggcggcggcggcggccttcgatgcctacaccgacaagaacgccatcttccgccgcctcaaggccaagcccgagaacaagatgtgcttcgactgcaacgccaagaaccccacctgggcctccgtcacctacggcatcttcctctgcctcgactgctcggccgtccaccgcagccttggggtccacatcaccttcgtcaggtcaacgaacctcgactcatggactccagatcagctgaaaatgatggcgttcggaggcaacaaccgggcacatgctttcttcaagcagcatggatggactgatggtggcaaggttgaggcgaaatacacatcaagagctgctgaactgtacaggcagatgctcaacaaggaggtcgctaagagtgccattaccgataatgccctgccgtcctcacctgtcactgcgtctgaggcttccaagccatctgatgactttcctgaattcaagctctcagacgcaccagcaccgccggcggagaatctgaatgggaagcatgaacccaagtcccccaaagctgctccacgttcaccaaaagctgctactcatcccacctttgccacttccgtgaagaagcccattggcgcaaagaaggttggaggcaagactggagggcttggtgttcgtaaactcacaacaaagccaaatgaaagcctgtatgagcagaaaccagaagagccaaaacctgctatacctgccttgactgctccaactgcaaaaggtggtccatccttgcattcacgttttgaatatgtggataacgaacaatcatctgtttcaagaaccgggggatctggatctcgtgtaaccggtcatgtagcaccaccaaaatcatctgacttcttccaagagtatgggatgggtaatggattccaaaagaaatcaagcaacgcctcaaaagctcagattgaggaaactgatgaagcaaggaaaaaattctctaatgctaaggcaatttcgtcatctcagttttttggtactcaaaacagagaagagaaagaggctcagctatcccttcagaaattcgcgggttcttcatccatttcaagctctgatctttttggccgtaccaatgtggacgattctaacctggacctaagcgctgcagatctcatcaacagaatatctttccaggcgtcacaggatctgtcttcactcaaggacatagctggagagactggaaagaagctgacatctttcgcctccaatttcatcagcgacctggacagaatcctttagctcgagacccagctttcttgtacaaagtggt

SEQ ID NO: 68 - DNA, 259 bp, Zea mays
acaagtttgtacaaaaaagcaggctcctgcaggaccatgagggaggccatcagggccgccaggaaggaattctcggtctgcactggtccagcgaactccgccatcacgttccagatggacgtgccggcaacgatgcctgtcgtcaaggagctctgcggcctggatgtcgttgagaggtacctggagagcgtgtcggctgccagcccaacaaacaccgctaaagcatagctcgagacccagctttcttgtacaaagtggt

SEQ ID NO: 69 - DNA, 423 bp, Zea mays
atggtttctttcgagatgaatgacctcaagaagattgggctaggcctaacaggctttggaatattcttctccttcctgggaatcattttcttctttgacaagggtcttattgcaatgggcaatatcctctttctatctggtttgggtttgacaattggtttgaaatccactatgcagttcttcaccaagcctaagaactacaagggtactatctcatttggtgctggcttttttctggttcttattgggtggccctttcttggcatgctcttagaagcatatggctttgttgtactcttcagtggattttggccaacccttgctgttttcctccaaaggattcctattattggatggatttttcaacaaccgtttgtcacatcgttccttgaccgctacagaggaaaacgagttccggtttag

SEQ ID NO: 70 - DNA, 423 bp, Zea mays
atggtttccttcgagatgaacgacctcaagaagattgggctgggcttgactggatttggagttctattcacattgctcgggatcattatgttgtttgacaagggattcctggcgatggggaatattctcttcgtttctggcgtcttactgaccattgggttgaagccaactgtgcagttcttcaccaagcctaagaatcacaagggttcaatatttttcgggtttggctttttcctggttctcattggatggcctgtctcaggaatgctggtggagtcgtatggcttcatcacgctcttcagcggcttctggccaacagctgctgtttacctgcaaaagagcccctccttcggttggatattccaccaccctcttgtgacttcgctgatcactcggttcagaggaagacgggtcccggtgtag

SEQ ID NO: 71 - DNA, 437 bp, Arabidopsis thaliana
aaaaaagcaggctcctgcaggaccatggaatcaaagacgttctggatcgttactcttcttctctgtggaacaattcaattagcgatttgcagatcagaagagaaaagcacagagaagacgatgatgctaggaggcgttcatgatctccgaggaaatcagaacagtggagagatcgagagtctcgctcgatttgccattcaagaacataacaaacaacagaacaaaattcttgagttcaagaagattgtcaaagcaagggagcaggtagttgcaggaacgatgtaccacttaaccctagaagcaaaagaaggtgatcagactaagaattttgaagccaaagtgtgggtgaagccatggatgaacttcaaacagttgcaggagttcaaggaatcatcttcttagctcgagcctgcagggacccagctttcttgtacaaa

SEQ ID NO: 72 - DNA, 442 bp, Arabidopsis thaliana
ggtaccggcgcgcctcagcagtcgctgtcgttaccatggaatcaaagacgttctggatcgttactcttcttctctgtggaacaattcaattagcgatttgcagatcagaagagaaaagcacagagaagacgatgatgctaggaggcgttcatgatctccgaggaaatcagaacagtggagagatcgagagtctcgctcgatttgccattcaagaacataacaaacaacagaacaaaattcttgagttcaagaagattgtcaaagcaagggagcaggtagttgcaggaacgatgtaccacttaaccctagaagcaaaagaaggtgatcagactaagaattttgaagccaaagtgtgggtgaagccatggatgaacttcaaacagttgcaggagttcaaggaatcatcttcttagaacccagcggtactcgctgaggcgatcgc

SEQ ID NO: 73 - DNA, 365 bp, Arabidopsis thaliana
aaaaaagcaggctcctgcaggaccatgcctcctcgcacgggaaaggataaacaaaaccccaggctcccaccggaggtgactcgcctactctacatttgtaaccttccctttagcataacaagcgaagatacgtacgatcttttcggaaggtacagtacgattcgtcaggttcgaatcggttgtgaaaagggcacaaaaggtacggctttcgtcgtatacgaggatatctacgatgctaagaaagctgtcgaccatctctggcttcaacatagcgaaccggtaccttatcgtgcactattaccaacatgcgaagatgagcaagaagtttagctcgagcctgcagggacccagctttcttgtacaaa

SEQ ID NO: 74 - DNA, 1928 bp, Saccharomyces cerevisiae
atgagcagtaacaacaacacaaacacagcacctgccaatgcaaattctagccaccaccaccaccatcaccaccatcaccaccaccatcacggtcatggcggaagcaactcgacgctaaacaatcccaagtcgtccttagcggatggtgcacatatcgggaactaccaaatcgtcaaaacgctgggagaggggtcctttggtaaagttaaattggcatatcataccactacgggccaaaaagttgctctaaaaatcattaataagaaggttttggcaaagagtgatatgcagggcagaattgaaagagaaatatcttatctgagactcttaagacacccccacatcatcaaactgtatgatgttatcaaatccaaagatgaaatcattatggttatagagtacgccgggaacgaattgtttgactatattgttcagagagacaaaatgagcgagcaagaggcaagaagatttttccagcagatcatcagtgccgtcgagtactgccataggcacaaaattgtccatagagatctgaagcctgaaaacttactactagatgagcatctgaatgtaaagattgccgattttggtttgtcaaacatcatgactgatggtaatttcttaaagacttcttgtggttctcccaattatgcggctcctgaagttatcagcggtaagctgtacgcaggcccagaagtggacgtgtggtcatgtggggttatcctttatgttatgctttgtcgtcgtctaccgtttgacgatgaaagcatcccagtgcttttcaagaatatcagcaacggtgtttacaccttgcctaaatttttatctcctggagctgctgggctaatcaaaagaatgttaatcgttaatccattgaacagaataagcattcatgaaattatgcaagacgattggttcaaagttgacctgccagaatatctacttccaccagatttgaaaccacacccagaagaagagaatgaaaataatgactcaaaaaaggatggcagcagcccagataacgatgaaattgatgacaaccttgtcaatattttatcatcgaccatgggttacgaaaaagacgagatttatgagtccttagaatcatcagaagacactcctgcattcaacgaaattagggacgcgtacatgttgattaaggagaataaatctttgatcaaggatatgaaggcaaacaaaagcgtcagtgatgaactggatacctttctgtcccagtcacctccaacttttcaacaacaaagcaaatcccatcaaaagagtcaagtagatcatgaaactgccaagcaacacgcaagaaggatggcaagtgctatcactcaacaaaggacatatcaccaatcacccttcatggatcagtataaagaagaagactctacagtttccattttgcctacatctttacctcagatccacagagctaatatgttagcacaaggttcgccagctgcctctaaaatatctcctcttgtaacgaaaaaatctaaaacgagatggcattttggtatacgatctcgctcatatccattagacgttatgggtgaaatttatattgccttgaagaatttgggtgccgaatgggccaagccatctgaagaggatttatggactatcaaattaaggtggaaatatgatattggaaacaagacaaacactaatgaaaaaatacctgatttaatgaaaatggtaattcaattatttcaaattgaaaccaataattatttggtggatttcaaatttgacggctgggaaagtagttatggagatgatactactgtttctaatatttctgaagatgaaatgagtactttttcagcctacccatttttacatttaacaacaaaactaattatggaattagccgttaacagtcaaagcaattagctcgagacccagctttcttgtacaaa

SEQ ID NO: 75 - DNA, 1088 bp, Glycine max
aaaaaagcaggctcctgcaggaccatgaagttcggcgccacatatgaggagtatctccgggcagagcgggacaaattcctagggcaatgctcccatgtagaatacaaacgcctcaaaaaggtattgaagaaatgtagagttggtcgctcactgcaagcagatggcacaaatggtgatgagcagcaggaggggagagacgaatcttcaaacatttgtgaatgcaactcatgcacattgtgtgatgagatgttctttacagaactcaacaaggaagcatcagaaatagcaggttgtttcagatctagagtacaacgtctcctccatcttcatgttccttcaggactacaacgctgtatatggcgttttaggcagtgtttcatagatgatcagcaaataatggttcaagaaggcagaatgcttctcaattatgtgaccatgaatgctattgctattcgcaaaattctcaagaaatatgacaagatacatggttctgtgagtggcagagatttcaagagcaagatgcaaactgagcatattgaactgttgcagtcaccttggctgatagagctatgcgctttccatcttaactgcgatgattcagatgctgatgaacctagagctggagagttcttcaagaatggattcttcaagaatttttcctgtgacctgagtggagcacagccactactaacaatgaccatttctgaaactctgaagtatgagtacagcctaacttgtccaatttgcttggacactttgttcaacccttatgcgcttagctgtgggcatctgttctgcaaagcctgtgcatgtggtgctgcttctgtctacatcttccagggtgtcaagtcggcacctccggaggccaagtgccctgtctgccgagcggttggtgtgtttgatcgtgctgtgcgtatgactgaactagaattgctcctcaagagaagggacaaagattactttctgcagagactgcgcgaagagcgaagtgtgatggtgaagcaggccaaagaatactgggactcacaggcaatgctatcgatggggatttagctcgagcctgcagggacccagctttcttgtacaaa

SEQ ID NO: 76 - DNA, 1580 bp, Glycine max
atggcagaggtggcgccgccgaagaaggaaaacccgaaccttctcctggggcggttcgagctcgggaagctcctcgggcacggaaccttcgcgaaggtccaccacgcgcgcaacatcaaaaccggagaaggagtcgccatcaagatcatcaacaaggagaaaatcctaaaggggggtttggtctcccacataaagcgcgagatctccattctccggcgcgtgcgccaccccaacatcgtgcaactcttcgaagtgatggccaccaagaccaagatctacttcgtcatggagtacgtgcgtggcggcgaactcttcaacaaggtcgcaaagggaagattaaaagaagaagttgcgagaaattactttcagcagttagtttccgcggtggagttttgccacgcgcgcggcgtgttccacagggacctgaagcccgagaacctgttgctggacgaggatgggaaccttaaagtctccgactttggtctcagtgccgtgtcggatcagataaggcaggacgggctgttccacacgttttgtgggacacctgcgtatgttgctcctgaggtcttgtcgcggaaaggctacgatggtgcaaaggttgatatttggtcttgtggggttgttttgtttgttctgatggccggctatttgcccttcaatgaccgtaacgttatggctatgtataagaagatttacaagggtgagtttcggtgtcccaggtggttttcttctgaacttacaagacttctctctaggcttcttgatactaaccctcagacaaggatttctattcctgaagtcatggagaatcgctggttcaagaagggtttcaagcagattaagttttatgtggaggatgatagagtttgtagttttgacgagaaactgttacttcatcatgatgatgatttggcaacatcggattctgaggttgagattaggaggaagaatagtaatggttcgttgccgaggcctgcgagtttgaatgcgtttgacatcatatcgttttctcagggctttgatctatcagggttgtttgaggaaaagggtgatgaggcgaggtttgtgtcatctgctccggtgtcgaagattatatcaaaattggaggaggttgctcagttggttagtttcagtgtgaggaagaaagattgcagggtgagcttggaggggtgtagagaaggtgtgaaggggcctttgactattgctgctgaggtttttgagttgacaccttccttggtggtggtggaggtcaagaaaaagggaggggataaggccgagtatgagaagttttgtaactctgagttgagacccgcgttggagaatttagggatggaggaatctgcttcttcttcttcttcttgtcatcaatctacacacactcaatctgaattccaacaacatcgaacactttctgactctgcccttaacagacattcagataatgaatgtttgttcgaacgagagttaggtctagcagatgagactagtatctcacaacatggtgaatcaaagttcgaatgtcaacaggaaaatatggccatgtttactatctagctcgagacccagctttcttgtacaaa

SEQ ID NO: 77 - DNA, 1508 bp, Glycine max
acaagtttgtacaaaaaagcaggctcctgcaggaccatggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcattagctcgagacccagctttcttgtacaaagtggtacaagtttgtacaaaaaagcaggctcctgcaggaccatggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcattagctcgagacccagctttcttgtacaaagtggt

SEQ ID NO: 78 - DNA, 1061 bp, Oryza sativa
aaaaaagcaggctcctgcaggaccatgcggatgctgtccaaggcgtgctcgctcgtggcctcctccctcccgcggtgctcatcctccgctgcccccacgatcagagggcagccgtcgttgctgccaagcgtgcgcaaggaatggcttggcaagccgctgctgtacggaatcggcacgctgctcgtcatgcctctgaggacgctgcacggggtgggacggatgtttggcgctgggcggttcctctgcaacatgaccagcgtctcgtcgtcgctgcaaattgagctcgtaccctgccttcaagataactatgcttacatcctacatgatgttgatactggaacagttggagttgtggacccttctgaagcaacgccaatcataaatgcactagaaaaaagaaaccagaacttgacctacatactgaacacccatcatcactatgaccatactggtggcaacttggaactgaaggcaaaatatggtgcaaaggtgattggttctgcaaaggatagggatagaattccaggcattgacataactcttagtgagggtgacacatggatgtttgctggtcatcaagttcttgtaatggaaactcctggtcatacatcaggtcatgtgtgctaccacttccctggatctggagcaatatttacaggggacacattgtttagtttgtcatgtggaaagctttttgaagggactccacaacagatgtactcttcactccagaaaattatagcacttccggatgagacaagagtgtattgcggacatgaatatacattgagcaattcaaagtttgccttgagcatagaaccaggaaataaagacttacaggaatacgctgcaaatgccgctgatctccgcaagaggaatacacccacggtgccaacaacaattgggagagagaagcagtgcaatccttttctgaggacctcaagtccagagataaagaataccctgtccatcccagaccattttgatgatgcacgcgttcttgaagttgttcgacgagcgaaggataacttttagctcgagacccagctttcttgtacaaa

SEQ ID NO: 79 - DNA, 1661 bp, Zea mays
acaagtttgtacaaaaaagcaggctcctgcaggaccccgcgcttgttttcccaccgcccgatggccgccatcacgccgccgacgcagtcggagccgtcgccgcagacggggcgcccggcctcgtctgccgccgccgcggccaagcgtggagggggcggggctggtgccgccggcgggccgctgatggggaagtacgagctggggcgcctcctggggcacggcaccttcgcgaaggtgtaccacgcgcggcacgtcgacacgggggacaacgttgccatcaaggtgctcgacaaggagaaggccgtgaagagcgggctcgtcccgcacatcaagcgcgagatcgctgtgctacgccgcgtgcgccacccgaacatcgtgcacctgttcgaggttatggccacaaagactaagatctacttcgtcatggagctcgtccgcggcggcgagctcttctcccgcgtctccaagggccgactcagggaggacaccgcgcgccgctacttccagcagctcgtctccgccgtggggttctgccacgcccgcggcgtcttccaccgcgacctgaagcccgagaatctactcgtcgacgagcaggggaacctcaaggtatcggattttgggctctccgccgtcgccgagcagttccgtcccgacggcctgctccacaccttctgcggcacgccggcctatgtggcccccgaagtgctcggccgccgcgggtacgacggcgccaaggcagacgtgtggtcgtgcggtgtcatcctctttgtgctcatggccggatatctccctttccatgacaaaaacatcatggccatgtacaagaagatttacaagggcgagttccgctgtgcgaggtggttctccaaagaccttaccagcttgctgatgcgcattcttcacactaatcccaacactcggatcactttgccggagatcatggagtcccgctggttcaagaaaggattcaagcctgtcaagttctatatcgaggatgaccagctgcataacgttatagatgacgaagatggcctgttagatatgggacctgctggtcctgttcctccaccattgccacctccaccgccacctctacctccaccaaaggttgatggtgatgaatcagggtctgactcagactcgtcgatctcatcctgccctgcttcaatgttatctgatgagagccaaaggccccgtggctctctaccacgtccagcaagtcttaatgcctttgatatcatatcattttcaaggggatttaacttatcagggttatttgaggagaaaggggatgaagtgaggttcatctcggctgagcccatgtcagatatcataaccaaattggaggacatagcgaagctgaagagcttcaagttgcggaggaaggactggcgcatctgcctggagggtacaagggaaggagttaaggggccattaacaattggcgcggagatatttgaactcacacctccccttgtaatggtggaggtaaaaaagaaggcaggggataatgaagagtacgagaacttctgtgacaaggaattgaagccagggatgcagcaccttgtccaccatatggtccgagctccaagtatgctgcttactgatgccaagtagatcgaaaggctagctcgagacccagctttcttgtacaaagtggt

SEQ ID NO: 80 - DNA, 3412 bp, Oryza sativa
ggtaccggcgcgccaccatgtcttcttcaagacctactcaatgttccagttcatccagcaggacccgccaaagctcccgggcaaggatattagcacaaacaactcttgatgctgaactcaatgctgaatatgaagaatatggcgactcctttgattactccaaattggttgaagcacagagaactactggacctgagcagcaagctcgttctgagaaggtcatagcttacttgcatcacattcagagagcaaagctaatccaaccatttggttgcttgttggcccttgatgagaagaccttcaatgttatagcgctcagcgagaatgcaccagagatgcttacaactgtcagccatgcagtgccaagtgttgatgatcccccaaagctacgcattggcaccaatgtatggtctcttttcactgacccaggtgccacagcactgcagaaggcactgggatttgctgatgtttccttgctgaaccctatcctagttcaatgcaagacctcaggcaagcctttctatgccattgttcatcgggcaactggttgtttggtggtagactttgagcctgtgaaacctacagaatttccagcaactgccgctggggctttgcaatcttacaaacttgctgccaaggcaatctctaagatccagtcactgccaggtggaagcatggaggtgctatgcaatacggtggtcaaggaactctttgacctcacaggatatgatagagttatggcttataagttccatgaagatgaccatggtgaagtctttgctgagatcacaaagcctggtcttgaaccttatcttggcctgcattatccagctactgatatccctcaggcagccaggtttcttttcatgaagaacaaagtccggatgatttgtgattgccgtgcaagatctatcaagattatcgaagatgagtcgctccacttggatattagcttatgtggttcaacactgagggcaccacacagttgtcatcttcagtatatggagaacatgaactcgattgcatcccttgtcatggctgttgtggttaatgagaatgaggatgatgatgaagttggggctgatcaacctgcacaacagcagaagaggaagaaactatggggactccttgtttgccaccatgagagccccagatatgttcctttcccattgcggtatgcctgtgagttcttagcacaagtgtttgctgtccatgttaacaaggagtttgaattagagaggcaagtacgcgagaaaagcatattgaggatgcaaacaatgctctctgacatgcttctcagggaatcctctcctctgagtatagtatcagggactcccaacatcatggaccttgtgaaatgtgatggtgctgctcttttgtatgggggaaaagtgtggcggctacagaatgctccaactgagtctcagatacgtgatattgccttctggctgtcagatgtccacagggattccactggcctgagtactgatagcctacatgatgctggatatccaggagctgctgctcttggtgatatgatttgtggaatggcagtagctaaaataaattccaaggatatcctgttctggttcaggtcacatacagctgctgaaatcagatggggaggtgcaaaacatgatccatcagacaaggatgacagcagaagaatgcaccctaggctgtccttcaaggcattccttgaggttgtcaagatgaagagcttgccttggaatgactatgagatggatgctattcactcattacaacttatacttagagggacactgaatgatgacatcaagccaacaagggccgctagtttagataatcaggttggtgatctcaagcttgatgggcttgctgaattgcaggcagttacaagtgaaatggttcgtctcatggaaacagcaactgtcccaatcttggctgtagatagcaatggattggtcaatggatggaatcagaaggttgctgagttgacagggttgagagtagatgaggctattggaagacacatacttaccgttgtagaggaatcttctgtaccagttgtccagaggatgctgtatttagctttgcaaggcaaagaagagaaggaagtgaaatttgaggtgaaaactcatggctccaagagagatgatggccctgttatcttggttgtgaatgcctgtgccagccgggaccttcacgaccatgttgttggtgtgtgctttgttgcacaagatatgactgttcataagttggtcatggacaaatttactcgggttgagggagactacaaagcaattattcacaatccaagcccgcttattcctcccatatttggtgctgacgaatttggatggtgctctgagtggaatgctgccatgacgaaattgaccgggtggcatagagatgaggtgatcaataagatgcttcttggtgaggtgtttgatagcaccaacgcctcctgtcttgtgaagaataaagatgcatttgtaagtctctgcattcttatcaacagtgcattagctggtgatgaaacagaaaaggctccattcagcttcttcgaccggaacgggaagtatatcgagtgccttctttctgttaacagaaaagtaaatgcagatggtgtcatcactggagtattttgtttcattcaagttcctagtcatgagctgcaacatgcactacatgtgcagcaagcctcacagcagaatgcactaacaaagttgaaagcttactcctacatgagacatgcaatcaacaaccctctctcaggtatgctttactctaggaaagcactgaagaacacaggtctgaatgaagagcagatgaaggaggtcaatgttgcagatagttgtcaccgccagctgaataaaatactttctgacttggatcaagatagcgtcatgaacaagtctagttgcttggatttggagatggttgagtttgtattgcaagatgtgtttgtggctgctgtaagtcaagtactcataacttgccagggaaaagggattagagtctcttgcaacctaccggagagatatatgaagcaaacagtctacggggatggtgttcgactacagcagattctctctgacttcctattcgtctcagtgaagttctctcctgttgggggttctgttgagatctcttgtagcctgaccaagaacagcattggggaaaaccttcatctcatagacctagaacttaggatcaagcaccagggcaaaggagtcccagcagatctgctgtcacaaatgtacgaggatgacaataaggagcagtcggatgaaggcatgagtcttgcggtttctagaaacctgctgaggctcatgaatggcgatgtccgacatatgagggaagctggcatgtcaaccttcatcctcagcgtcgaacttgcttctgctccagcaaaataggcgatcgc

SEQ ID NO: 81 - DNA, 653 bp, Oryza sativa
gcagtcgctgtcgttaccatggtacagccaaagaagaagtttcgtggagtcaggcagcggcactggggctcctgggtctctgagatcagacaccccctccttaaaaggagggtgtggctgggcacctttgagacggccgaggaggctgcgcgagcctacgatgaggctgctgtgctgatgagtggccgcaacgccaagaccaacttccccgtgcagaggaactccaccggtgatctcgccacggccgcagaccaggacgcccgtagcaatggcggtagcaggaactcctccgcgggcaacctgtcacagattctcagtgctaagctccgcaagtgctgcaaggcgccatctccgtccttaacctgcctccgcctcgaccccgagaagtcccacattggcgtgtggcaaaagcgcgcaggggcccgtgctgactccaactgggtgatgacggtggagctcaacaaagaggtagaaccaactgaacctgcagctcagcccacatcaacagcaacagcttcgcaagtgacaatggatgatgaggaaaagattgcgctgcaaatgatcgaggagttgctgagcaggagcagtccagcttcaccctcacatggagagggagagggtagctttgtcatctagaacccagcggtactcgc

SEQ ID NO: 82 - DNA, 3840 bp, Zea mays
atgtcttcctcgaggcctgcccactcttcaagttcatccagcaggactcgccagagctcccgggcaaggatattagcacaaacaacccttgatgctgaactcaatgcagagtacgaagaatctggtgattcctttgattactccaagttggttgaagcacagcggagcactccacctgagcagcaagggcgatcgggaaaggtcatagcctacttgcagcatattcaaagaggaaagcttatccaaccatttggttgcctgttggcccttgacgagaagagcttcagggtcattgcattcagtgagaatgcacctgaaatgcttacaacggtcagccatgctgtgccaaacgttgatgatcccccgaagctaggaattggtaccaatgtgcgctcccttttcactgaccctggtgctacagcactgcagaaggcacttggatttgctgatgtttctttgctgaatcctatcctggttcagtgcaagacctcaggcaagccattctatgccattgttcacagggcaactggttgtctggtggtagattttgagcctgtgaagcctacagaatttcctgccactgctgctggggctttgcagtcctacaagcttgctgccaaggcaatctccaagatccagtcactactaggtggaagcatggaggccttatgcaataccgtggttaaggaagtctttgacctgacaggttatgacagggttatggcttacaagttccatgaagatgagcatggggaggtctttgctgagatcaccaaacctggtattgagccctatataggcctgcactatccagccactgatatccctcaagctgccaggtttctcttcatgaagaacaaagtcagaatgatctgtgattgccgtgcaagatccgtgaagattattgaagatgaggcactctccattgatattagcttgtgtggttcaactcttagagcaccacatagctgtcaccttaagtatatggagaacatgaactcgattgcatctcttgtcatggctgttgtggtcaatgaaaatgaagaggatgatgaacccgagcctgaacaaccaccacaacagcagaagaagaagaggctgtggggtctcattgtttgccaccatgagagccccagatatgtcccgttcccactgcggtatgcctgtgaattcttggcccaagtgtttgctgtccatgtaaacaaggagtttgaattggagaagcagatacgagagaaaaacattctgcgaatgcaaacaatgctctctgacatgctgttcaaggaatcatctcccttgagtatcgtgtctgggagtccaaatatcatggacctagttaagtgtgatggcgctgctcttttgtatggggacaaagtatggcggcttcaaacggctccaaccgagtctcagattcgtgatattgccttctggctttcagaagttcatggggattccactggcttgagtactgatagcctccaggatgctggatatccaggagctgcttcccttggtgacatgatttgtggaatggcagtggccaagatcacgtccaaggacattcttttctggttcaggtcacatacagctgctgaaatcaaatggggaggtgcaaagcatgatccatctgataaggatgacaacagaaggatgcaccctaggttatcctttaaggctttccttgaggttgtcaagacgaagagtttgccatggagtgactacgagatggatgctattcactcattgcagcttattcttagaggtacactgaatgatgcctcgaagccagcccaggcatctggtttagataaccagatcggtgatctaaaacttgatgggcttgctgaattgcaagcagtgacaagtgaaatggtccgcctgatggaaacagcaactgttccgatcttggcagtagatggcaatggattggtcaatggatggaaccaaaaggtagcggagttgtcaggtctgagagttgatgaggctataggaagacacatacttacacttgtggaggattcttctgtatcacttgttcagaggatgctatatttagctctgcaaggtgagtggaactaaaaggttttaagcacctttactgtctgcaccatttaattactattcttactgttaatagtcaaccctcagaaaaaatgaataaatttattgtattacgtattggtttctgaatatttcatcaattgagcaggcagagaagagaaggaagttcgatttgagctgaaaacacatggctccaagagggatgatggccctgttatcttggtcgtaaatgcttgtgccagtcgtgatcttcatgaccatgttgttggggtgtgctttgtagcccaggacatgactgttcacaagttggtcatggacaaatttactcgggtcgagggggactacaaggcaatcatccacaacccgaacccactcattcctcctatatttggtgctgaccagtttggatggtgctctgagtggaatgcagccatgaccaagcttaccgggtggcacagagatgaagtggttgataagatgctccttggcgaggtttttaacagcagcaatgcttcctgccttctgaagagcaaagatgcctttgtacgtctttgcattgtcatcaacagtgcattagctggtgaagaggcagaaaaggcttcattcggcttctttgaccgcaatgagaaatatgtcgaatgccttctgtcggtgaacaggaaagtaaatgcagatggtgttgtcactggagtgttctgtttcatccatgttcctagtgatgacctgcagcatgcgctacatgtgcagcaagcctctgagcagacagcacaaagaaagttgaaggctttctcgtacatgcgacatgccatcaacaaacctctctcaggtatgctttattctagggaaacactcaagagcacaggtctgaatgaagagcagatgaggcaggttcgcgtcggagacaattgccatcgccagctaagcaagatacttgccgacttggatcaagataacatcactgacaagtaaccttcttgccaagtcttttaaactgttctattaggttcttgtatttatttccgtcttcctcgtaatttgacaattttctgaacagtaggttgatggtatcacttaattttacttcactagctactgaagcttatagccatattcgttacaaccaacttaatatttctgtatcattatgttcacaggtcaagctgcttggatttggatatggctgaatttgtgttgcaagatgtggtggtgtctgctgtaagtcaagtgctgataggttgccaggctaaaggtatcagagttgcttgcaacctgccggagagatccatgaagcaaagggtttacggggatggtatccgactccagcagatcgtctccgacttcctatttgtttcggtgaagttctctcctgctggtggctctgttgacatctcttccaagctgactaagaacagcattggggaaaaccttcacctcatagacttcgaacttaggtatgctgggcatgctagtttgcaagcatacattcatttctgaactggaaagcatgaggtgtgaaggcttaagttactcttgtgtttatggctttatgattttcaggatcaagcaccgaggagcaggagtcccagcggaaatattgtcgcaaatgtatgaggaggacaataaagagcagtcagaggagggcttcagccttgctgtttctagaaaccttctgaggctcatgaatggtgacattcgtcacctcagggaagctggcatgtcaaccttcattctcactgctgaacttgctgctgctccttcagcagttggacgatgatgaat

SEQ ID NO: 83 - DNA, 687 bp, Arabidopsis thaliana
atgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataa

SEQ ID NO: 84 - protein, 185 aa, Glycine max
MAAEPKESPSNNPGLHTTPDEATKGYIMQQTMFRIKDPKVSLDFYSRVLGMSLLKRLDFPEMKFSLYFMGYENTAEAPSNPIDKVVWTFSQKATIELTHNWGTESDPEFKGYHNGNSEPRGFGHIGVTVDDTYKACERFQNLGVEFVKKPEDGKMKGIAFIKDPDGYWIEIFDRKTIGNVTQTAA

SEQ ID NO: 85 - protein, 206 aa, Arabidopsis thaliana
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFENLNNWREEFLIQASPSDPENFPFVLIGNKVDVDDGNSRVVSEKKAKAWCASKGNIPYFETSAKVGTNVEEAFQCIAKDALKSGEEEELYLPDTIDVGTSNQQRSTGCEC

SEQ ID NO: 86 - protein, 345 aa, Zea mays
MGNQCPNGTLGSDYYNRPASRFADGCLEDDRYSDLKKFDKPWPEVNSFKPTAVGILKRGLDPTSITVLERKTADVREHYIIGRRLGQGQFGTTFLCTEISTGCEYACKTIPKRKLITKEDVEDVRREIQIMHHLSGHKNVVSIKDVYEDGQAVYIVMELCAGGELFDRIQEKGHYSEQKAADLIRIIISLVAMCHSLGVMHRDLKPENFLLWDKEDDLSIKAIDFGLSVFFKPGQVFTELVGSPYYVAPEVLHKRYGPEADVWSAGVILYVLLSGVPPFWAETQQGIFDAVLKGHIDFDSDPWPKISESAKNLIRKMLCPCPSERLKAHEVLRHPWICENGVATD

SEQ ID NO: 87 - protein, 240 aa, Glycine max
MALEALNSPTTTAPSFPFDDPTIPWAKRKRSKRSRDHPSEEEYLALCLIMLARGGTTSVNNRHVSPPPPQPQPQPTPDPSTKLSYKCSVCDKSFPSYQALGGHKASHRKLAAAAEDQPPSTTTSSAAATSSASGGKAHECSICHKSFPTGQALGGHKRCHYEGNGNGNNNNSNSVVTVASEGVGSTHTVSHGHHRDFDLNIPAFPDFSTKVGEDEVESPHPVMKKPRLFVIPKIEIPQFQ

SEQ ID NO: 88 - protein, 341 aa, Synechococcus elongatus
MASMISSSAVTTVSRASRGQSAAVAPFGGLKSMTGFPVKKVNTDITSITSNGGRVKCMPAGRHMTLAIRPKLAFNWPTALFMVAIHIGALLAFLPANFNWPAVGVMVALYYITGCFGITLGWHRLISHRSFEVPKWLEYVLVFCGTLAMQHGPIEWIGLHRHHHLHSDQDVDHHDSNKGFLWSHFLWMIYEIPARTEVDKFTRDIAGDPVYRFFNKYFFGVQVLLGVLLYAWGEAWVGNGWSFVVWGIFARLVVVYHVTWLVNSATHKFGYRSHESGDQSTNCWWVALLAFGEGWHNNHHAYQYSARHGLQWWEFDLTWLIICGLKKVGLARKIKVASPNN

SEQ ID NO: 89 - protein, 72 aa, Arabidopsis thaliana
MGRGKIEIKRIENSTNRQVTFCKRRNGLLKKAYELSVLCDAEVALIVFSTRGRLYEYANNNIRSTIERYKKA

SEQ ID NO: 90 - protein, 166 aa, Oryza sativa
MANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGQQPAFN

SEQ ID NO: 91 - protein, 244 aa, Zea mays
MGRGRVELKRIENKINRQVTFAKRRNGLLKKAYELSVLCDAEVALIVFSNRGKLYEFCSGPSITRTLERYEKNSYAGPDTAVQNKENELVQNSRNEYLKLKAKVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLP

SEQ ID NO: 92 - protein, 269 aa, Arabidopsis thaliana
MAMEWDNQLQPNNHHSSNLQGIDVNGGSGAGGGMYVKVMTDEQYETLRKQIAIYGTICERLVEMHKTLTAQQDLAGGRMGGLYADPMMSSLGHKMTARQRWTPTPVQLQILERIFDQGTGTPSKQKIKDITEELSQHGQIAEQNVYNWFQNRRARSKRKQHGGGSSGNNNGESEVETEVEALNEKRVVRPESLLGLPDGNSNNNGLGTTTATTTAPRPEDLCFQSPEISSDLHLLDVLSNPRDEHLVGKMGLAESYNLYDHVEDYGMSG

SEQ ID NO: 93 - protein, 189 aa, Arabidopsis thaliana
MVHSRKFRGVRQRQWGSWVSEIRHPLLKRRVWLGTFETAEAAARAYDQAALLMNGQNAKTNFPVVKSEEGSDHVKDVNSPLMSPKSLSELLNAKLRKSCKDLTPSLTCLRLDTDSSHIGVWQKRAGSKTSPTWVMRLELGNVVNESAVDLGLTTMNKQNVEKEEEEEEAIISDEDQLAMEMIEELLNWS

SEQ ID NO: 94 - protein, 274 aa, Arabidopsis thaliana
MEMESFMDDLLNFSVPEEEEDDDEHTQPPRNITRRKTGLRPTDSFGLFNTDDLGVVEEEDLEWISNKNAFPVIETFVGVLPSEHFPITSLLEREATEVKQLSPVSVLETSSHSSTTTTSNSSGGSNGSTAVATTTTTPTIMSCCVGFKAPAKARSKRRRTGRRDLRVLWTGNEQGGIQKKKTMTVAAAALIMGRKCQHCGAEKTPQWRAGPAGPKTLCNACGVRYKSGRLVPEYRPANSPTFTAELHSNSHRKIVEMRKQYQSGDGDGDRKDCG

SEQ ID NO: 95 - protein, 277 aa, Arabidopsis thaliana
MAKGEYREQKSNEMFSKLPHHQQQQQQQQQQHSLTSHFHLSSTVTPTVDDSSIEVVRRPRGRPPGSKNKPKPPVFVTRDTDPPMSPYILEVPSGNDVVEAINRFCRRKSIGVCVLSGSGSVANVTLRQPSPAALGSTITFHGKFDLLSVSATFLPPPPRTSLSPPVSNFFTVSLAGPQGQIIGGFVAGPLISAGTVYVIAASFNNPSYHRLPAEEEQKHSAGTGEREGQSPPVSGGGEESGQMAGSGGESCGVSMYSCHMGGSDVIWAPTARAPPPY

SEQ ID NO: 96 - protein, 511 aa, Oryza sativa
MATFFRSANLASRVFDRQFLSPRPGATVNTVRQFYENLVPSYTICDIDCPDYSFRKFTDDGNYLVAFSRNHQDLIVYRPIWPTFSCNEPCDSHDLPPKAKKFDSFFKQLYSISLASSNEYICKDFFLYMECHQFGLFATSTAQSNDSSATEGAIHGVPSIEKITFYLVRLDDGAILDEKAFRNDFINLAHSIGAYLYEDLLCIVSLRYQTIHVLQIRDSGNLVEVRKIGAFCQEDDELFLHSHGQAARGVSFLPGIKQRLLSFIFRKTWNEESDQTLRVQHLKKKFYFHFQDYVDLIIWKVQFLDRHHLFIKFGSVDGGVSRSTEQNSAFFAVYNMETTDIVSLYQNSSEELYSLFEYFYDHFHTNPQNSSHGNFISSHSNNVHALDQLRTIKNKANSTSQFVKKMMASLPYTCQSQSPSPYFDLSLFRYDEKLISAIDRHRHCTEHPIKFISVKQPNVVKFKIKPGSDSGASDSRAKRISSFLFHPFFPLALSIQQTYMQPTVVNLHFRR

SEQ ID NO: 97 - protein, 174 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 98 - protein, 140 aa, Arabidopsis thaliana
MMSFEMNDRKKIGLGLTGFGVFFSFLGIVFVFDKGLLAMGNILFISGVSLTIGFKSTMQFFMKRQNYKGTISFGVGFFFVIIGWPILGMMLETYGFFVLFSGFWPTLAVFAQKIPVLGWIIQQPYIRSFFDKYRGKRVPV

SEQ ID NO: 99 - protein, 130 aa, Zea mays
MAAAGLRKGNARLPPEVNRVLYVRNLPFNISSEEMYDIFGKYGAIRQIRLGNAKDTRGTAYVVYEDIYDAKNAVDHLSGFNVANRYLIVLYYQPAKMSKKSDIKKKEDEITRLQEKYGIGSKTPGPGSSD

SEQ ID NO: 100 - protein, 179 aa, Glycine max
MSSINPSRATAPSAFATRRPWEEFFALHSFTRPYTLGETTLRVKRNLGHFRVNYAMVVLLFVFLSLLWFPISLVVFLAVFAAWFFLYFFRDGPIVVLRRELDDRLVLAALSAVTVAGLVLTGVWLNVVVALLFAAAAVALHAALRNTEDLYVDELEVSDGGLVSVVGGSPTKRTGYARI

SEQ ID NO: 101 - protein, 479 aa, Agrobacterium tumefaciens
MSLKTAPVIVWFRKDLRLSDNLALLAAVEHGGPVIPVYIREKSAGPLGGAQEWWLHHSLAALSSSLEKAGGRLVLASGDAERILRDLISETGADTVVWNRRYDPTGMATDKALKQKLRDDGLTVRSFSGQLLHEPSRLQTKSGGPYRVYTPFWRALEGSDEPHAPADPPKSLTAPKVWPKSEKLSNWKLLPTKPDWAKDFSDIWTPGETGALDKLDDFIDGALKGYEEGRDFPAKPATSLLSPHLAAGEISPAAVWHATKGLSRHIASNDISRFRKEIVWREFCYHLLFHFPELGEKNWNDSFDAFSWRDDEKSFKAWTRGMTGYPIVDAGMRQLWQHGTMHNRVRMIVASFLIKHLLIDWRKGEKWFRDTLVDADPASNAANWQWVAGSGADASPFFRIFNPILQGEKFDGDGDYVRRFVPELEKLERKYIHKPFEAPKDALKKAGVELGKTYPLPIVDHGKARERALAAYAAVKKTT

SEQ ID NO: 102 - protein, 508 aa, Oryza sativa
MAATPPSSQHRRPLSSSASAASLAGKPRGGGLLLGRYELGRLLGHGTFAKVYQARSADSGEPVAIKVLDKEKAMRHGLVPHIKREIAILRRVRHPNIVRLFEVMATKSKIYFVMELVRGGELFGRVAKGRLKEDTARRYFQQLVSAVGFCHARGVFHRDLKPENLLVDEHGDLKVSDFGLSAVADQFHPDGLLHTFCGTPSYVAPEVLARRGYDGAKADIWSCGIILFVLMAGYLPFHDQNLMAMYRKIYRGEFRCPRWFSKDLSSLLNRILDTNPETRITVKEVMESRWFQKGFRPVRFYVEDDQVHSLADGDNDMPELEPSEPPPPPPFPPPPPQQDDDGEESGWESDSSVASCPATLSSEERRQRPLGSLTRPASLNAFDIISFSKGFDLSGLFEERGSEVRFISAEPMQTIITKLEEIAKVKSFFVRRKDWRVSIEGTREGLKGPLTIGAEIFELTPSLVVVEVKKKAGDKEEYDDFCNRELKPGMQHLVHHMGSVPNIPSDTE

SEQ ID NO: 103 - protein, 451 aa, Zea mays
MAEHKGNVLLHKYEMGKLLGQGTFAKVYHARNTATSESVAIKVIDKEKVMKVGLIDQIQREISVMKLVRHPNIVQLYEVMATKTKIYFVLEHVKGGELFNKIQRGRLKEDAARKYFQQLICAVDFCHSRGVYHRDLKPENLLLDENSNLKVSDFGLSALAECHRQDGLLHTTCGTPAYVAPEVINRKGYDGAKADIWSCGVILFVLLAGYLPFHDKNLMDMYKKIEKADFKCPSWFSTDVRRLLQRILDPNPSRRISVKKIMENPWFRKGLGAKLLRYDLQNKNAPHVDKKADFDSLSTNVTTESKQHEEKKPTNMNAFDIISLSTGLDLSGLFEESNKKRESKFTSTNTSSTIISKIEDIAKNLRLNLTKKDGGLLKMEASKPGRKGVMGIDAEVFEVSPNFHLVEIKKTNGDTLEYQKVLNQEMRPALKEIVWAWQGEQSKQKQEQQSC

SEQ ID NO: 104 - protein, 438 aa, Zea mays
  misc_feature (407)..(407): Xaa can be any naturally occurring amino acid
MDGRRTILMGRYEIGKQLGQGTFAKVFYARNLTTGLAVAIKMINKDKVMKVGLMEQIKREISIMRLVKHPNILQLYEVMASKSKIYFVLEYAKGGELFNKIAKGGKLSEDVARKYFQQLVSAVDFCHSRGVYHRDLKPENLLLDENENLKVSDFGLSALAESKRQDGLLHTTCGTPAYVAPEVLSRKGYDGAKADVWSCGVILFVLVAGYLPFHDTNLIEMYRKISRAEFRCPRFFSTELKDLLHKILVPDPSTRISISRIKRSAWYRKPVEAHAKKNEAETSENTCTGEGTTSVSTECSTSEGNQGPLSLPNLNAFDIICLSTGFNLSGFFEDKYGRREERFTTRQPVTTVFTKLKELAKRLKLKVNKKENGTLKLAAPKEGKKGMLELDAEIFEVAPSLLLVELXKKTNGDTLEYQKLVKEEIRPALKDIVWVWQD

SEQ ID NO: 105 - protein, 463 aa, Zea mays
MAAAAAFSSTSVVAALAASGFLGKKLVTSIIIRNKKKGYDSLHGATTTIRVRAMAVNKETEQDRWRGLALDTSDDQQDITRGKGRVDPLFQAPMGDGTHVAVLSSYDYISQGLRHYSLDNMMDGYYIAPAFMDKLVVHIAKNFMPLPNIKVPLILGIWGGKGQGKSFQCELVLAKMGINPIVMSAGELESGNAGEPAKLIRQRYREAADMIKKGKMCVLFINDLDAGAGRMGGTTQYTVNNQMVNATLMNIADNPTNVQLPGMYNKEENPRVPIIVTGNDFSTLYAPLIRDGRMDKFYWAPTREDRVGVCKGIFRSDGVPDEDVVRLVDAFPGQSIDFFGALRARVYDDEVRRWVAETGVENIARRLVNSKEGPPTFEQPRMTLDKLMEYGRMLVEEQENVKRVQLADKYLSEAALGDANDDDDLYGKAAQHVRVPVPEGCTDPKAGNFDPTARSDDGSCVYN

SEQ ID NO: 106 - protein, 307 aa, Zea mays
MAATEVYSPTTAAAAQQQRGKAASQAWRAVVGWIGFFLQVLLQILRGTPSCAQLLSFVGFRYPLLSGPAASEPLPEVAFMPLHSEIPADAAPAPKPASEPLGRLTVVLDLDETLVSAYESSSLPAIVRTQAVEAGLHCFDMECISSDKDVEGKQKVNHVTVFERPGLHEFLRKTSEFADLILFTAGLEGYARPLVDRIDVHNRFRLRLYRPSTVTTEYREHVKDLTRVSKDFGRIVIVDNNPFSFILQPLNGIPCVPFSAGQHSDDQLMTVIFPLLKHLSLQKDVRPVLRERFHMPEWFQNHGIPQV

SEQ ID NO: 107 - protein, 220 aa, Zea mays
MGQQSLIYAFVARGTVILAEYTEFTGNFTTIASQCLMKLPASNNKFTYNCDGHTFNYLVEDGFTYCVVAVESVGQQIPIAFMDRVKEDFTKRYGGGKAATAAANSLNREFGSKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 108 - protein, 469 aa, Zea mays
MGKRSGGRKLPFFTRSSSSSSKRNRSARRLPSLPKQDNATRALLASPSAASPSATPGSAAAGQTAQLPPPLSVTAGGGVAVSGKVNKKKAGTRLWMRLDRWSASEIVELDKASIIRRAGLPPRDLRILGPVFSRSSSILAREKAMVINLEFIRAIVTAEEVLLLDPLMHEVLPFVDQLRQHLPLRSRVGENGECAPDGNGEKQKGSLNEATGAEHELPFEFHVLEVALEVVCSSLDLSVSDLERHATPVLDELTKNVSTRNLERVRNLKSHLTRLLARVQKVRDEIEHLLDDNEDMEHLYLTRKQVQNQQVEALMSSAASNSIVLAGTGVPRLNSSFRRSLSIATSMHLDNDVEDLEMLLEAYFMQLDGIRNRILSVREYIDDTEDYVNIQLDNQRNELIQLQLTLTIASFGIAANTFIAGAFAMNIPGSLFNTDGSLFWPFVGSTSSGCFVITVLLLGYAWWKKLLGP

SEQ ID NO: 109 - protein, 244 aa, Zea mays
MISPDAARNVVGIIGNVISFGLFLSPVLTFWRIYKAKDVEEFKPDPYLATLLNCMLWVFYGIPVVHPNSILVVTINGIGLVIEAVYLTIFFLYSDSQKRKKAFAILAVEILFMLAVVLGVILGAHTHEKRSMIVGILCVIFGSMMYASPLTIMSRVIKTKSVEYMPFLLSLVSFLNGCCWTAYALIRFDLYVTIPNALGAFFGLIQLILYFCYYKSTPKNEKNVELPTVSSNVGGGNVTVSVER

SEQ ID NO: 110 - protein, 337 aa, Zea mays
MRMLSKACSIVASSLPRCSSSAAAPTMRGQPSLLPSVRKQWPGKPLLYGIGTLLVMPLRTLYGVGRVFGAGRFLCNMTNVSSSLQIELVPCLRDNYAYILHDVDTGTVGVVDPSEAMPIINALEKRNQNLTYILNTHHHYDHTGGNLELKAKYGAKVIGSEKDKDRIPGIDITLKEGDTWMFAGHQVLVLETPGHTTGHVCYYFAGSGAIFTGDTLFNLSCGKLFEGTPQQMYASLQKITALPDDTKVYCGHEYTLSNAKFALSVEPGNKALQEYAANAAELRNKNIPTVPTTIGREKECNPFLRTSNPEIKRTLSVPDHFDEDRVLGVVRRAKDNF

SEQ ID NO: 111 - protein, 377 aa, Zea mays
MGRDKSRRLYGSRHFRQRLVLATLTSTAVTIEDIRSGDASPGLRPYEVSLLRLLDKISDHHTIDLNETGTKLRYRPGVIIGGKGLEHDCGVHRGIGYFLEPLILLGLFSRAPISIRLKGITNDTKDPSVDTFRTTTLHMLKHFGVPLDGFDLNIDSRGSPPLGGGEVFLRVRNINSTLTAANWVDEGMVKRIRGVSFSTRVSPQLENRIIYAARGIFNRFIPDVHIHTDHRSGSAGGRSPGYGVSLVAETTTGCLLSVDVTVSYPSVDEINEESEKPELTSPEDLGVQAASMLLEEVAQGGVVDSTHQGLLFILCALCPPDVSKVRVGQLTPYGIETLRNIRDFLDVKFIIKPDPNSNTVTLKCVGAGVKNLARKIS

SEQ ID NO: 112 - protein, 208 aa, Oryza sativa
MEVEAHHGFLPPAAGRQHLYGHPHYQLSGDDEWWEYIPCPFCYIEVEVHFLCDHLQEEHCFDMKNAVCPICADNLDKDTDEHFRVQHSHLLKRRKSSSFSCKPSSAAADKGSYEEDSYFEAPSHCMGRPAPDSSPDPLLSQFICCSLAPPVDSPRRSEADAEGHGSSSSDDQKRREQGVMDDASKEELEERLQRIEFVKQMLMTTIAY

SEQ ID NO: 113 - protein, 375 aa, Glycine max
MGSKGKRKEQESIITRVMAHGGRYVQYNVYGNLFEVSSKYVPPIRPVGRGAYGIVCAAVNCDTHEEVAIKKIGNAFDNIIDAKRTLREIKLLRHMDHENIIAIRDIIRPPRKDAFNDVYIVYELMDTDLHQIIRSDQPLNDDHCQYFLYQLLRGLKYVHSANILHRDLKPSNLLLNSNCDLKIADFGLARTTSETDFMTEYVVTRWYRAPELLLNCSEYTSAIDVWSVGCIFGEIMTREPLFPGKDYVHQLRLITELLGSPDDASLGFLRSGNAKRYVRQLPQYRKQNFSARFPNMSPEALDLLEKMLIFDPNKRITVDEALCHPYLSSLHDINDEPVGPGQFNFDFEQPTCTEEHIKELIWRESVKYNPDPPSQ

SEQ ID NO: 114 - protein, 468 aa, Cupriavidus metallidurans
MSTLRGVSMSDMQEHKVTPYDQFNYEVPENVFPREGISANAAAAIVISDEWTDTNPMLNMSSFVTTFAEPEAREVAARNIFKNYIDHDMYPRLFAMEGRMVRWLHELWNGPKGVEPYGTCTVGSSEACMLGGLAHKWNWRQRRQAEGKDATRPNMVTGGNVQIVWKKFLRYFDVEPRIVPLKPGNYCLTAEDLDKYVDENTICVVAIAGQTFTGEDDDIQGIHDWLDAYEKRTGISIPMHIDGASGGFVNPFLYPDYKWDFRLPRVQSINASGHKYGLTPPGLGWVVFRERKIFNEELVFYVNYLGGEMPTATLNFSRNAFQVAVQYYQFLRLGFDGYKRVMQHTLDNAIFLRQQLVDSGYFDIMNTTQRIPVVAVTLNKKYKNFNEFDVSNKVREKGWVLSAYTMPPNAESVTSLRVVVRPHVNHNVAQLLANDIINACKFLEANGGNAKPPALHKHAEAQSTSLKC

SEQ ID NO: 115 - protein, 406 aa, Oryza sativa
MGSKKRSPQHPAAAAPPPAVGGGGGGEVSGDGGASTANGPVVPKPSEVAPFLTKVYDMVSDPATDNVISWAEGGGSFVIWDSHAFERDLHRHFKHSNFTSFIRQLNTYGFRKVHPDRWEWANEGFIMGQKHLLKTIKRRKKSSQESPSEIQKAPVKTAPGTENIEIGKYGGLEKEVETLKRDKALLMQQLVDLRHYQQTSNLEVQNLIERLQVMEQNQQQMMALLAIVVQNPSFLNQLVQQQQQQRRSNWWSPDGSKKRRFHALEQGPVTDQETSGRGAHIVEYLPPVPETSGQVNPVEGAICSANSQPVPSPAVATPMDMQTSNVADTLGSSEEPFADNSTLHEWDDNDMQLLFDDNLDPILPPFENDGQMGPPLSVQDYDFPQLEQDCLMEAQYNSNNPQYGND

SEQ ID NO: 116 - protein, 159 aa, Glycine max
MSLIPSFFGTGRRTNVFDPFSLDVWDPFHGFPGTTALSAPRSETAAFANTRIDWKETAEAHVFKADLPGLKKEEVKVEIEEEGRVLQISGQRTKEKEDKNDTWHRLERSSGSFLRRFRLPENAKLDQVKAGMENGVLTVTVPKVDVKKPDVKPVQITEG

SEQ ID NO: 117 - protein, 220 aa, Zea mays
MGSEGPSVVTVHVTGFKKFHGVAENPTEKIVTNLKSFLEKRGLPKNLVLGSCTVLETAGEGALATLYKVLESAVADRGTGSSAQGQVIWIHFGVNSGAIRFALENQAVNEATFRCPDELGWKPQRVPIVPSDGSISRTRETTLPVNELTKSLRKIGYDVVPSGDAGRFVCNYVYYHSLRFAEQHGIKSLFVHVPLFLTIDEEVQMHFVASLLEVIAFSSN

SEQ ID NO: 118 - protein, 486 aa, Arabidopsis thaliana
MAGVVRSSPGSSQPPPPPPHHPPSSPVPVTSTPVIPPIRRHLAFASTKPPFHPSDDYHRFNPSSLSNNNDRSFVHGCGVVDREEDAVVVRSPSRKRKATMDMVVAPSNNGFTSSGFTSIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQLQAEIENLALEEQALDNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVDNDESDYWLLSNAEISMTDIWKTDSGIDWDYGIADVSTPPPGMGEIAPTAVDSTPRC

SEQ ID NO: 119 - protein, 312 aa, Arabidopsis thaliana
MAQQGQGSMDPAALDDIIRRLLDYRNPKPGTKQAMLNESEIRQLCIVSREIFLQQPNLLELEAPIKICGDIHGQYSDLLRLFEYGGFPPTANYLFLGDYVDRGKQSLETICLLLAYKIKYPENFFLLRGNHECASINRIYGFYDECKRRFSVRLWKVFTDSFNCLPVAAVIDDKILCMHGGLSPDLTNVEQIKNIKRPTDVPDSGLLCDLLWSDPSKDVKGWGMNDRGVSYTFGPDKVAEFLIKNDMDLICRAHQVVEDGYEFFADRQLVTIFSAPNYCGEFDNAGAMMSVDESLMCSFQILKPADRKPRFL

SEQ ID NO: 120 - protein, 515 aa, Arabidopsis thaliana
MEVLASSSLSPISFTKPNKINPNFSIQVKLWVKQPPKISKASKFSYARSRSNISRSNAANPGVVFVCNRFLCVIERNDQRKLSGKVMMKSSVNFRQNLSVALVRIVSVLLVSSISVVTTDSPPSWGLTEENLLFLEAWRTIDRAYIDKTFNGQSWFRYRETALRNEPMNTREETYMAIKKMVATLDDPFTRFLEPGKFKSLRSGTQGAVTGVGLSIGYPTASDGPPAGLVVISAAPGGPANRAGILPGDVIQGIDNTTTETLTIYDAAQMLQGPEGSAVELAIRSGPETRLLTLTRERVSVNPVKSRLCELPGSGSNSPKIGYIKLTTFNQNASSAVREAIETLRGNNVNAFVLDLRDNSGGSFPEGIEIAKFWLDKGVIVYICDSRGVRDIYDTDGSNAIATSEPLAVLVNKGTASASEILAGALKDNKRALVYGEPTYGKGKIQSVFELSDGSGLAVTVARYETPAHTDIDKVGVTPDHPLPKSFPKDEEAFCGCLKDPTAACYLNQGLLFSR

SEQ ID NO: 121 - protein, 515 aa, Arabidopsis thaliana; identical to SEQ ID NO: 120

SEQ ID NO: 122 - protein, 192 aa, Zea mays
MASDGAAATPAKVTPKKANLLDPHSIKHLLDETISEVVKSKGYTEDTRLGNWKLGIGAAVIAVALLAQFYPKKFPQNRDFLLGCIALYVVLNVVLLILSYTKEKDAILFTHPPMGSFSSTGLTISSKLPRFSDMYTLTIASADPQSISANKPVHFTKSVTKWFTKEGVLVEGLFWKDVEKLIDDYNSERKSK

SEQ ID NO: 123 - protein, 311 aa, Oryza sativa
MAKHFVLNTGAKIPSVGLGTWQSDPGVVGNAVYAAVKAGYRHIDCASAYNNEKEVGLALKKLFEEGVVKREDLFITSKLWCDHHAPEDVPEALDATLNDLQLEYLDLYLIHWPFRTKKGSSIGKPESYLPPDIPSTWAAMEKLYDSGKSRAIGVSNFSSKKLGDLLAAARVPPAVDQVECHPGWQQMKLHNFCQSTGIHLSAYSPLGSPGSTFMNGNVLKEPIIISIAEKLGKTPAQVALRWNIQMGHSVLPKSVSEERIKQNLDVYDWSIPEDLLAKFSEIKQVRLLRGNFIVNPQSVYKTHEELWDREI

SEQ ID NO: 124 - protein, 370 aa, Zea mays
MTSTAAGASSSAAKSESYLRADKIDLESLDIQLEKQLAKTWEKHKGSYNQGPREDWEIDLAKLEIRYVIAQGTYGTVYRGTYDGQDVAVKLLDWGEDGFASETETATLRASFKQEVAVWHELNHPNVTKFVGASMGTTDLKIPANSSNSGGRTELPPRACCVVVEYLAGGSLKQYLIKNRRRKLAYKVVVQIALDLARGLNYLHSRKIVHRDVKTENMLLDTQRNLKIADFGVARVEAQNPKDMTGATGTLGYMAPEVLEGKPYNRKCDVYSFGICLWEIYCCDMPYPDLSFADVSSAVVHQNLRPDIPRCCPSPMANIMRKCWDANPDKRPDMDDVVRFLEALDTSKGGGMIPEGQAGGCLCFFRARGP

SEQ ID NO: 125 - protein, 341 aa, Zea mays
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMVKDKDNVTLEDVLQPGTNMLAAGYCMYGSSCTLVLSTGNGVNGFTLDPSLGEFILTHPNIKIPRKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 126 - protein, 455 aa, Glycine max
MSNLTSASGEASASSGNRTEIGTDYSQQYFAPPLSQAQPPPLKKKRNLPGNPDPEAEVVALSPKTLLATNRFICEICNKGFQRDQNLQLHRRGHNLPWKLKQRSSNEIIRKKVYVCPEASCVHHDPSRALGDLTGIKKHFCRKHGEKKWKCDKCSKKYAVQSDWKAHSKTCGTREYRCDCGTLFSRRDSFITHRAFCDALAEESSRSVTGIGIVANSTSTQPTAAAASHQQDIIHGNSNNFSLKKEQQAGFRPPWIGQPSPSSASSFLVSHQENPNPRGGGPGPTLLPPYQTAPHMSATALLQKASQMGATMSKTGSMIGTHQQQAHVSANAALNLSSRDHQMTPTLHGLVPFGNKAVPAVGNGVSPSLLHHIIDSFSSPFEGTSFEDTFGGAGGDAMTKTTTADDGARGNNNEALTRDFLGLRPLSHTDILNIAGMGSCINSSQHNQTPNPWQG

SEQ ID NO: 127 - protein, 1014 aa, Unknown
  Synechocystis sp. PCC 6803
MSPSQPHPPIATFEPESFLILVVDDVKENIYVISELLEGEGYSTTFVTSGPEALQRVTQAQPDLILLDLMMPGMDGLEVCDRLKQDPQTRDIPVIFLTASNEKQDLLQAFAKGAVDYVTKPFSPPELLARVKTHLELKQTRDNLHHTLLEQARTAEALACTSTRLGILVQNMQAGVLMTDAQGTIVVVNPEFARLFNLGFPADLLLGKNLTAIAPRINGLISHGQGVTHNFLAIESPEPLLKVELALEDGRFFERDYVPIMLGDSSQGHFWPYRDISQRKQVEMIQGQSLEMERRMRQQLAEQNQELVAATTAAEAANRSKSEFLATMSHEIRTPMNAIIGMTGLLLDTDLTTQQKYFAQTIRNSGETLLTLINDILDFSKIEAGKLDLEVYPFDLGQCLEEALDVVVPSARQKSLTLIRRFLTPIPPNLQGDVTRLRQILVNLLSNAVKFTEAGQVKVTVEVVDHDAAKGEYQICFAVQDTGIGIAPNQQQALFQAFSQGNSSITRRFGGTGLGLAICVRLTALMGGTIWAESNGCVVGNPPELWQIGQPTIEGSTFYFTVNLTVLPSCAYSVHNLRHSLFIGRSVLVADYDEGRGTRMRNLLASWRLQAEQITFSSPAKLGEDLKSRLTQKNYGALILHCPYPEGRGKQFTDFDLGKITTWAPTEQDIPVLVATDIYLSPGERYSGDKPPVQAWIKSPINPDELENTLVDVLGQTEPPTLVSTEAISGPLFPYSSSNLTILLAEDNLINQQVAKLLLKKLGYPVDVVNNGQEALSALAKGDYDVVLMDVEMPEMDGLTATEHIRRSQGRSERPWIIAVTAYSMEGDRERCLASGMNDYVSKPIRLEALQQALQVAATALQSTSQDRMATVSCVSAFEAKPSPSSPCPEDPAGTTLPPIDQDIICSLRDLDRENGQLILREIIDIYCQTAPELLQRIKLAIANQDWGNLSSAAHTLGSSSANLGAVLLAQQAKTLENLTRQRDSRAMDPGHFPTLAASYERVQGELKTMLDRL

SEQ ID NO: 128 - protein, 1014 aa, Unknown; identical to SEQ ID NO: 127
  Synechocystis sp. PCC 6803

SEQ ID NO: 129 - protein, 266 aa, Arabidopsis thaliana
MEVTSQSTLPPGFRFHPTDEELIVYYLRNQTMSKPCPVSIIPEVDIYKFDPWQLPEKTEFGENEWYFFSPRERKYPNGVRPNRAAVSGYWKATGTDKAIHSGSSNVGVKKALVFYKGRPPKGIKTDWIMHEYRLHDSRKASTKRNGSMRLDEWVLCRIYKKRGASKLLNEQEGFMDEVLMEDETKVVVNEAERRTEEEIMMMTSMKLPRTCSLAHLLEMDYMGPVSHIDNFSQFDHLHQPDSESSWFGDLQFNQDEILNHHRQDYV

SEQ ID NO: 130 - protein, 592 aa, Saccharomyces cerevisiae
MLSLSAKNHFTVSNSITHVIKSYHIRTLTSSAEKMPHITTPFSTSASSTKLKAFRKVRPVLQRHSSSWIVAQNHRRSLSGQSSLNDLRHLNRFPHHTLKTSNNEFYPAEQLTLEDVNENVLKAKYAVRGAIPMRAEELKAQLEKDPQSLPFDRIINANIGNPQQLQQKPLTYYRQVLSLLQYPELLNQNEQQLVDSKLFKLDAIKRAKSLMEDIGGSVGAYSSSQGVEGIRKSVAEFITKRDEGEISYPEDIFLTAGASAAVNYLLSIFCRGPETGVLIPIPQYPLYTATLALNNSQALPYYLDENSGWSTNPEEIETVVKEAIQNEIKPTVLVVINPGNPTGAVLSPESIAQIFEVAAKYGTVVIADEVYQENIFPGTKFHSMKKILRHLQREHPGKFDNVQLASLHSTSKGVSGECGQRGGYMELTGFSHEMRQVILKLASISLCPVVTGQALVDLMVRPPVEGEESFESDQAERNSIHEKLITRAMTLYETFNSLEGIECQKPQGAMYLFPKIDLPFKAVQEARHLELTPDEFYCKKLLESTGICTVPGSGFGQEPGTYHLRTTFLAPGLEWIKKWESFHKEFFDQYRD

SEQ ID NO: 131 - protein, 492 aa, Glycine max
MDPYKLRPSSAFNSPFWTTNSGAPVWNNNSSLTVGARGPILLEDYHLVEKLANFDRERIPERVVHARGASAKGFFEVTHDISHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFTFLFDDLGVPQDYRHMDGFGVNTYTLINKAGKAVYVKFHWKTTSGIKCLLEEEAIKVGGANHSHATQDLHDSIAAGNYPEWKLFVQTIDPEHEDKFDFDPLDVTKTWPEDIIPLQPVGRLVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAETFPIPPAICSGRREKCGIEKENNFKQPGERYRSWAPDRQDRFNRRWVDALSDPRVTHEIRSVWISYWSQADRSLGQKIASRLSMRPNI

SEQ ID NO: 132 - protein, 867 aa, Zea mays
MASAAGSSNVMLAINEKKTITTDLYRPLRLYIASTYSEREAAAADDDLSVVCDLRAAVEKPSLPDPSSLEQRRDALLAYARALALVEPRFPISPDRAHVHSLTFTWHDAFKGNKKCALASIHLEKASVLFNLGAVYSQIALAADRSTDVGIRIACGAFQSAAGAFAWLRESGAAAKAVAAGTTTVDITPECAGMLEKLMLAQAQECFFEKVIGGGKPPALCSKVARQVGILYEEAYTALSASPLSQHFDKTWVSHVQLKAAQFYADACYRYSLDLHEKEEIAEEIARLKIGMSALADAKKTTKGVAAQLLDSVNKLESNMKTNLERAMKENDRVYLMRVPAAGSLGALPAASLVKPTSLAEVLDASKERLFSSLVPDGSMKALSKYTEMVDNSIRTQAEKLQQASEITRVRLKEMDLPDSILSLEGNITLPMDLKEDVEAVQISGGPAGLESELQQLRDLSRVNQELLVQTEELLQKEANEDAQFRTQFGSRWTRPQSSTLTKNIQDRLNLFASNLKRAADSDSLIERGVKENYSLMSILDKRPIESALPSISRPIMSLDGNEDAIVGALKQSLRQLESLGAQRAGLEDMLKEMKRKDDILPKLMVGVGSHDDLFKKEIAKYDPICADIADNIVAQEQLLLQIQAQNEQFAAVFNLEDYKAARERCYKQIAAAVVKYQEFKKNINEGLNFYVTLQEAIGKIKQQCSDFIMTRNIQCREMMEDVQRKLPGFRFSSSSRSSMQRNAASVPPDESSPSPPPPHAQAPYASPPGVDSRHGYSQPEARPAYSQPYPPSYGATPQQPTYGAQHPGQYQPPPGHDCGQPAYPGWRGPYPYYNAPQPQQSVPCPQAPYNATGAYPPHQSNYYRPQ

SEQ ID NO: 133 - protein, 230 aa, Zea mays
MGLVSDELYKNARENCGGKYSAPLNAVCAEAVQAINNCTRDINKQYILDPACPDDDLLSPKTVAETDGTSRLMLESADFLLGSKCAEALYILSYAWGNDDTVQESLGIRKGTIGAWKRCSHALPYNYDIQSVVDYHSRLATKGYRALIYSGDHDAVVPHVGTQAWIRYLNLTIVDDWRPWYVGGQVAGFTRSYASGLTFATVKGAGHVAPLYKTLECQKMFITWISGNPL

SEQ ID NO: 134 - protein, 520 aa, Zea mays
MGNSLGCSASGERLVSAARDGDAIEARMLLELSPALARYSTFGGLNTPLHFAAAKGHLDIVTMLLEKGADVNARNYCGQTALMHACRHGHWEVVQMLLLFRCNVTRADYLSGRTALHFAAHDGFVRCIRLLVADFVPSVALEDIASSVVDGGDCQTNSGSSPNSSSGQKFNESARVRYINKPADGGVTALHMAALNGHLDCMQLLIDLGANVSAVSFPYGTTANLIGAGSTPLHYAAGGGKQECCELLISKGASRLTLNCNGWLPVDVARIFGRRSLEPLLSPNSHSNVPVFQPSSYLALPLMSILNIAREFGLQHTTPSIDDNDLCSVCLERSCSVVAEGCSHEFCIKCALYLCSTSNIRVEFTGPPGSIPCPLCRNGIMSFTKLPSTPTEGLKSGSALTFCNPCILNTRSMDSPATFSKAEIRRNRVAAVSSELVCPITCSPFPSSALPTCRCSDDDPCGDTDVQDGPEFQSPRPSHSASMELDKRGEGDLDRASCSGMFWSRRSCHREQQCDAEINA

SEQ ID NO: 135 - protein, 364 aa, Zea mays
MRRWFCCTRFNASYREHENERPITPEEKEGNGFSVKSDPIKAPPSIEVPELSFEELKEKTDNFGSKALIGEGSYGRVYYAILDSGKHVAVKKLDASTDPELDNEFLTQVSIASKLKHDNFVEMLGYCVEGNQRLVVYEFATMGSLHDILHGRKGVPGAQPGPALDWMQRVKIAIDAAKGLEYLHEKVQPSIVHRDIRSSNILLFEDYRAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPQPPAATTDATAPSDA

SEQ ID NO: 136 - protein, 296 aa, Zea mays
METSAATPTRPPHQAATSPSPSPSSSLRLWRPAAQRNMRNQWSHLSAAKEQWLAAVADGRAHASALVNVHLSCRNMPTMDLGVLKDMPGIRDKANSKLALREEQYSGMLLSAYKEMVRQLSYLVEASHSMRRFSKAAPNCPITQFSDRQDNLNDSGDGGGAPVFKWFSVLEFESLAQELVQMFVSEQKLKRLLLLEFLSIALKEGVELQTSLNWGDELYDGESNKLQSIGLQSGDAYSPPENWCAERLGSQRPGNLPLHEVLQVYLTTWHANMNINRSRIDEIFELVEEEMKIKLS

SEQ ID NO: 137 - protein, 572 aa, Saccharomyces cerevisiae
MCGIFAAFRHEDVHRYKPKALQLSKRIRHRGPDWSGNAIKNSTIFVHERLAIVGVESGAQPITSSDGEYMLCVNGEIYNHIQLREECADYEFGTLSDCEPIIPMYLKHDIDAPKYLDGMFAWTLYDAKQDRIVAARDPIGITTLYMGRSSASPKTVYFASELKCLTDDCDTITAFPPGHVYDSKTDKITRYFTPDWLDEKRIPSTPIDYMAIRHSLEKAVRKRLMAEVPYGVLLSGGLDSSLIASIAARETAKATNDVEPSTYDSKARHLAGIDDDGKLHTAGWTSLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSAAEFHTESVQRVKNLHLADCLRANKSTMAWGLEARVPFLDREFLQLCMNIDPNEKMIKPKEGRIEKYILRKAFDTTGEPDAKPYLPEEILWRQKEQFSDGVGYSWIDGLKDTAEAVISDEMFASPKAEWGSDIPTTKEAFWYRLKFDALFPQKTVADTVMRWIPKADWGCAEDPSGRYAQIHEKHIE

SEQ ID NO: 138 - protein, 166 aa, Oryza sativa
MESAMFGLETPLMTALQHLLDIPDGEGGAAGKQGATGGPTRAYVRDARAMAATPADVKDLPGAYAFVVDMPGLKSSDIKVQVEEERLLVISGERRRGGGEEEKEESCKYLRMERRMGKFMRKFVLPDNADVDKISAVCQDGVLTVTVEKLPPPEPKKPKTIEVKVA

SEQ ID NO: 139 - protein, 140 aa, Saccharomyces cerevisiae
MCCYCVCCTVSDFILYIVAFFFPPAAVLLRSGPCSSDFLLNVLLTLLGFLPGMLHAFYYITITSPLRNAEYVYYYQQGWVDSERNVPSNRPQNSQTPQNRPQQGSSARNVYPSVETPLLQGAAPHDNKQSLVESPPPYVP

SEQ ID NO: 140 - protein, 367 aa, Oryza sativa
MSSTAPLLTPYKMGRFDLSHRVVLAPLTRQRSYGNVPQPHAILYYQQRTTKGGLLIAEATGISDTAQGYKDTPGIWTKEQVEAWKPIVDGVHAKGGIFFCQIWHVGRVSNNTFQPNGQAPISSTNKSLKPAVRANGIDVATFSTPRRLETDEIPFVVNDYRVAARNAIEAGFDGVEIHGAHGYLIDQFLKDQVNDRSDKYGGSLENRCRFALEVVQAVTDEIGADKVGIRLSPFASYSEAADSNPEALGLYMANALNKFGILYCHMVEPRMVKLGEKFETPHSLRPIRDAFKGTFIAAGGYNKEDGNKAVSTGYTDLVAYGRLFLSNPDLPERFEIDAPLNKYNRETFYISDPVIGYTDYPFLPSDV

SEQ ID NO: 141 - protein, 373 aa, Glycine max
MALESAPASADIRGVHTHGGGYVQYNIYGNLFEVSRKYVPPIRPVGRGAYGIVCAAVNAETHEEVAIKKVGNAFDNRIDAKRTLREIKLLRHMEHENVIALKDIIRPPQRYNFNDVYIVYELMDTDLHQIIQSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFLGKDYVHQLRLITELIGSPDDTSLGFLRSDNARRYVRQLPQYPRQQFAARFPSMSPGAVDLLEKMLVFDPNRRITVEEALCHPYLAPLHDINEEPACVRPFSFDFEQPSFTEEDIKELIWRESVLFNPDPPIY

SEQ ID NO: 142 - protein, 502 aa, Arabidopsis thaliana
MVLSHAVSESDVSVHSTFASRYVRTSLPRFKMPENSIPKEAAYQIINDELMLDGNPRLNLASFVTTWMEPECDKLIMSSINKNYVDMDEYPVTTELQNRCVNMIAHLFNAPLEEAETAVGVGTVGSSEAIMLAGLAFKRKWQNKRKAEGKPVDKPNIVTGANVQVCWEKFARYFEVELKEVKLSEGYYVMDPQQAVDMVDENTICVAAILGSTLNGEFEDVKLLNDLLVEKNKETGWDTPIHVDAASGGFIAPFLYPELEWDFRLPLVKSINVSGHKYGLVYAGIGWVIWRNKEDLPEELIFHINYLGADQPTFTLNFSKGSSQVIAQYYQLIRLGHEGYRNVMENCRENMIVLREGLEKTERFNIVSKDEGVPLVAFSLKDSSCHTEFEISDMLRRYGWIVPAYTMPPNAQHITVLRVVIREDFSRTLAERLVIDIEKVMRELDELPSRVIHKISLGQEKSESNSDNLMVTVKKSDIDKQRDIITGWKKFVADRKKTSGIC

SEQ ID NO: 143 - protein, 502 aa, Arabidopsis thaliana; identical to SEQ ID NO: 142

SEQ ID NO: 144 - protein, 161 aa, Glycine max
MSLIPNFFGGRRNNVFDPFSLDVWDPFKDFPFPNTLSSASFPEFSRENSAFVSTRVDWKETPEAHVFKADIPGLKKEEVKVQIEDDKVLQISGERNVEKEDKNDTWHRVERSSGKFMRRFRLPENAKVEQVKASMENGVLTVTVPKEEVKKPDVKAIEISG

SEQ ID NO: 145 - protein, 580 aa, Zea mays
MYRAAAVISRSSSALRRQLARGVAGELPRLLARGYAATAKEVSFGVGARAAMLQGVNDLADAVKVTMGPKGRTVIIEGSHKGPKVTKDGVTVAKSVEFEDSAKNVGANLVKQVADATNKAAGDGTTCATVLTQAILTEGCKAVAAGVNVMDLRNGINKAINAITAHLKSKAWKINSPEEINQVATISANGEKEIGDLISKAMEKVGKDGVITIVDGKTLDNELEAVQGMKLSRGYISPYFVTDQKTQKCEMENPLILIHDKKISNMDSLLPALEISIKNRKPLLIVAEDVEGDALSMLVLNKHRAGLKVCAVKAPGFGENRRHNLDDMAVMTGGEVISEERGLDLGKVQLQMLGTAKKVTVSLDDTIILDGGGDKQQIDERCQQLRESIDTSTAVFDKEKAQERLSKLSGGVAVLKIGGASEAEVGEKKDRVTDALNAARAAVEEGIVPGGGVALLYATKELDKISTANEDEKIGVQIIKNSLKAPLMTIAANAGIDGAIVIGKLIEQEDLSLGYDAAKGEYVDMIKAGIIDPVKVIRTALQDAASVSLLMATTEAAVSELPATKSRIASRMPQMSGMDF

SEQ ID NO: 146 - protein, 209 aa, Glycine max
MMKTTMNISNANHEKVEKAFAFLTGNHFINHHYGAILSKCLKGLPVRDFDAQEIIPGLYLGDVYAAHNTKELKSRNFTHIVTCTVGVVPPFPDAFKYMHLKILDFAGETIDVHFTSTTDFIGDAIANGGKVLVHCIRGVSRSATIVSAYLMKSMSLSAEDAVEHVRRVRAIARPNYGFMMQLQLYHKELNKGMMNVEISDEQNLPAAEW

SEQ ID NO: 147 - protein, 704 aa, Saccharomyces cerevisiae
MYNIPDNVKGAVEFDPWLKPFADVLSERRYLADKWLYDITHATPDGSYQSLSKFARDSYKSYGLHANPETKEITYKEWAPNAERAFLVGDFNNWDTTSHELKNKDEFGNFTITLHPLPNGDFAIPHDSKIKVMFILPDGSKIFRLPAWITRATQPSKETSKQFGPAYEGRFWNPENPYKFVHPRPKFSESVDSLRIYEAHVGISSPEPKITTYKEFTEKVLPRIKYLGYDAIQLMAIMEHAYYASFGYQVTNFFAASSRFGTPEELKELIDTAHSMGILVLLDVVHSHASKNVEDGLNMFDGSDHQYFHSISSGRGEHPLWDSRLFNYGKFEVQRFLLANLAFYVDVYQFDGFRFDGVTSMLYVHHGVGAGGSFSGDYNEYLSRDRSFVDHEALAYLMLANDLVHEMLPNLAVTVAEDVSGYPTLCLPRSIGGTGFDYRLAMALPDMWIKLIKEKKDDEWEMGSIVYTLTNRRYGEKVVAYCESHDQALVGDKTLAFWLMDAAMYTDMTVLKEPSIVIDRGIALHKMIRLITHSLGGEAYLNFEGNEFGHPEWLDFPNVNNGDSYKYARRQFNLADDPLLRYQNLNEFDRSMQLCEKRHKWLNTKQAYVSLKHEGDKMIVFERNNLLFIFNFHPTNSYSDYRVGVEKAGTYHIVLNSDRAEFGGHNRINESSEFFTTDLEWNNRKNFLQVYIPSRVALVLALKE

SEQ ID NO: 148 - protein, 189 aa, Arabidopsis thaliana
MGCVRCKSSDPWQTSANAFESVDESGINEAWVEISSRRSFVAGEGSRKKLERKKSQVLLEGYVETASSSSVDDQKDDLTRSKSLTDDDLEDLRGCLDLGFGFSYDEIPELCNTLPALELCYSMSQKFLDDKQNKSPETSSVEDCPSPPLVTATPIANWKISSPGDNPDDVKARLKYWAQAVACTVQLCS

SEQ ID NO: 149 - protein, 566 aa, Zea mays
MAPLLAAAMNHAAAHPGLRSHLVGPNNESFSRHHLPSSSPQSSKRRCNLSFTTRSARVGSQNGVQMLSPSEIPQRDWFPSDFTFGAATSAYQIEGAWNEDGKGESNWDHFCHNHPERILDGSNSDIGANSYHMYKTDVRLLKEMGMDAYRFSISWPRILPKGTKEGGINPDGIKYYRNLINLLLENGIEPYVTIFHWDVPQALEEKYGGFLDKSHKSIVEDYTYFAKVCFDNFGDKVKNWLTFNEPQTFTSFSYGTGVFAPGRCSPGLDCAYPTGNSLVEPYTAGHNILLAHAEAVDLYNKHYKRDDTRIGLAFDVMGRVPYGTSFLDKQAEERSWDINLGWFLEPVVRGDYPFSMRSLARERLPFFKDEQKEKLAGSYNMLGLNYYTSRFSKNIDISPNYSPVLNTDDAYASQEVNGPDGKPIGPPMGNPWIYMYPEGLKDLLMIMKNKYGNPPIYITENGIGDVDTKETPLPMEAALNDYKRLDYIQRHIATLKESIDLGSNVQGYFAWSLLDNFEWFAGFTERYGIVYVDRNNNCTRYMKESAKWLKEFNTAKKPSKKILTPA

SEQ ID NO: 150 - protein, 421 aa, Zea mays
MAAAAAAAAFDAYTDKNAIFRRLKAKPENKMCFDCNAKNPTWASVTYGIFLCLDCSAVHRSLGVHITFVRSTNLDSWTPDQLKMMAFGGNNRAHAFFKQHGWTDGGKVEAKYTSRAAELYRQMLNKEVAKSAITDNALPSSPVTASEASKPSDDFPEFKLSDAPAPPAENLNGKHEPKSPKAAPRSPKAATHPTFATSVKKPIGAKKVGGKTGGLGVRKLTTKPNESLYEQKPEEPKPAIPALTAPTAKGGPSLHSRFEYVDNEQSSVSRTGGSGSRVTGHVAPPKSSDFFQEYGMGNGFQKKSSNASKAQIEETDEARKKFSNAKAISSSQFFGTQNREEKEAQLSLQKFAGSSSISSSDLFGRTNVDDSNLDLSAADLINRISFQASQDLSSLKDIAGETGKKLTSFASNFISDLDRIL

SEQ ID NO: 151 - protein, 63 aa, Zea mays
MREAIRAARKEFSVCTGPANSAITFQMDVPATMPVVKELCGLDVVERYLESVSAASPTNTAKA

SEQ ID NO: 152 - protein, 140 aa, Zea mays
MVSFEMNDLKKIGLGLTGFGIFFSFLGIIFFFDKGLIAMGNILFLSGLGLTIGLKSTMQFFTKPKNYKGTISFGAGFFLVLIGWPFLGMLLEAYGFVVLFSGFWPTLAVFLQRIPIIGWIFQQPFVTSFLDRYRGKRVPV

SEQ ID NO: 153 - protein, 140 aa, Zea mays
MVSFEMNDLKKIGLGLTGFGVLFTLLGIIMLFDKGFLAMGNILFVSGVLLTIGLKPTVQFFTKPKNHKGSIFFGFGFFLVLIGWPVSGMLVESYGFITLFSGFWPTAAVYLQKSPSFGWIFHHPLVTSLITRFRGRRVPV

SEQ ID NO: 154 - protein, 125 aa, Arabidopsis thaliana
MESKTFWIVTLLLCGTIQLAICRSEEKSTEKTMMLGGVHDLRGNQNSGEIESLARFAIQEHNKQQNKILEFKKIVKAREQVVAGTMYHLTLEAKEGDQTKNFEAKVWVKPWMNFKQLQEFKESSS

SEQ ID NO: 155 - protein, 125 aa, Arabidopsis thaliana; identical to SEQ ID NO: 154

SEQ ID NO: 156 - protein, 101 aa, Arabidopsis thaliana
MPPRTGKDKQNPRLPPEVTRLLYICNLPFSITSEDTYDLFGRYSTIRQVRIGCEKGTKGTAFVVYEDIYDAKKAVDHLWLQHSEPVPYRALLPTCEDEQEV

SEQ ID NO: 157 - protein, 633 aa, Saccharomyces cerevisiae
MSSNNNTNTAPANANSSHHHHHHHHHHHHHGHGGSNSTLNNPKSSLADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDLKPHPEEENENNDSKKDGSSPDNDEIDDNLVNILSSTMGYEKDEIYESLESSEDTPAFNEIRDAYMLIKENKSLIKDMKANKSVSDELDTFLSQSPPTFQQQSKSHQKSQVDHETAKQHARRMASAITQQRTYHQSPFMDQYKEEDSTVSILPTSLPQIHRANMLAQGSPAASKISPLVTKKSKTRWHFGIRSRSYPLDVMGEIYIALKNLGAEWAKPSEEDLWTIKLRWKYDIGNKTNTNEKIPDLMKMVIQLFQIETNNYLVDFKFDGWESSYGDDTTVSNISEDEMSTFSAYPFLHLTTKLIMELAVNSQSN

SEQ ID NO: 158 - protein, 342 aa, Glycine max
MKFGATYEEYLRAERDKFLGQCSHVEYKRLKKVLKKCRVGRSLQADGTNGDEQQEGRDESSNICECNSCTLCDEMFFTELNKEASEIAGCFRSRVQRLLHLHVPSGLQRCIWRFRQCFIDDQQIMVQEGRMLLNYVTMNAIAIRKILKKYDKIHGSVSGRDFKSKMQTEHIELLQSPWLIELCAFHLNCDDSDADEPRAGEFFKNGFFKNFSCDLSGAQPLLTMTISETLKYEYSLTCPICLDTLFNPYALSCGHLFCKACACGAASVYIFQGVKSAPPEAKCPVCRAVGVFDRAVRMTELELLLKRRDKDYFLQRLREERSVMVKQAKEYWDSQAMLSMGI

SEQ ID NO: 159 - protein, 517 aa, Glycine max
MAEVAPPKKENPNLLLGRFELGKLLGHGTFAKVHHARNIKTGEGVAIKIINKEKILKGGLVSHIKREISILRRVRHPNIVQLFEVMATKTKIYFVMEYVRGGELFNKVAKGRLKEEVARNYFQQLVSAVEFCHARGVFHRDLKPENLLLDEDGNLKVSDFGLSAVSDQIRQDGLFHTFCGTPAYVAPEVLSRKGYDGAKVDIWSCGVVLFVLMAGYLPFNDRNVMAMYKKIYKGEFRCPRWFSSELTRLLSRLLDTNPQTRISIPEVMENRWFKKGFKQIKFYVEDDRVCSFDEKLLLHHDDDLATSDSEVEIRRKNSNGSLPRPASLNAFDIISFSQGFDLSGLFEEKGDEARFVSSAPVSKIISKLEEVAQLVSFSVRKKDCRVSLEGCREGVKGPLTIAAEVFELTPSLVVVEVKKKGGDKAEYEKFCNSELRPALENLGMEESASSSSSCHQSTHTQSEFQQHRTLSDSALNRHSDNECLFERELGLADETSISQHGESKFECQQENMAMFTI

SEQ ID NO: 160 - protein, 239 aa, Glycine max
  misc_feature (198)..(198): Xaa can be any naturally occurring amino acid
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELQNLENQLEISLHGVRMKKDQLLMGEIQELNRKGNLIHQENVELYKKVYGTQDDNETNRDSVLTNGLGIGEDLQXACESPAKPATATATTLQGIFRNYKIGIAIALARDPAFLYKV

SEQ ID NO: 161 - protein, 336 aa, Oryza sativa
MRMLSKACSLVASSLPRCSSSAAPTIRGQPSLLPSVRKEWLGKPLLYGIGTLLVMPLRTLHGVGRMFGAGRFLCNMTSVSSSLQIELVPCLQDNYAYILHDVDTGTVGVVDPSEATPIINALEKRNQNLTYILNTHHHYDHTGGNLELKAKYGAKVIGSAKDRDRIPGIDITLSEGDTWMFAGHQVLVMETPGHTSGHVCYHFPGSGAIFTGDTLFSLSCGKLFEGTPQQMYSSLQKIIALPDETRVYCGHEYTLSNSKFALSIEPGNKDLQEYAANAADLRKRNTPTVPTTIGREKQCNPFLRTSSPEIKNTLSIPDHFDDARVLEVVRRAKDNF

SEQ ID NO: 162 - protein, 518 aa, Zea mays
MAAITPPTQSEPSPQTGRPASSAAAAAKRGGGGAGAAGGPLMGKYELGRLLGHGTFAKVYHARHVDTGDNVAIKVLDKEKAVKSGLVPHIKREIAVLRRVRHPNIVHLFEVMATKTKIYFVMELVRGGELFSRVSKGRLREDTARRYFQQLVSAVGFCHARGVFHRDLKPENLLVDEQGNLKVSDFGLSAVAEQFRPDGLLHTFCGTPAYVAPEVLGRRGYDGAKADVWSCGVILFVLMAGYLPFHDKNIMAMYKKIYKGEFRCARWFSKDLTSLLMRILHTNPNTRITLPEIMESRWFKKGFKPVKFYIEDDQLHNVIDDEDGLLDMGPAGPVPPPLPPPPPPLPPPKVDGDESGSDSDSSISSCPASMLSDESQRPRGSLPRPASLNAFDIISFSRGFNLSGLFEEKGDEVRFISAEPMSDIITKLEDIAKLKSFKLRRKDWRICLEGTREGVKGPLTIGAEIFELTPPLVMVEVKKKAGDNEEYENFCDKELKPGMQHLVHHMVRAPSMLLTDAK

SEQ ID NO: 163 - protein, 1128 aa, Oryza sativa
MSSSRPTQCSSSSSRTRQSSRARILAQTTLDAELNAEYEEYGDSFDYSKLVEAQRTTGPEQQARSEKVIAYLHHIQRAKLIQPFGCLLALDEKTFNVIALSENAPEMLTTVSHAVPSVDDPPKLRIGTNVWSLFTDPGATALQKALGFADVSLLNPILVQCKTSGKPFYAIVHRATGCLVVDFEPVKPTEFPATAAGALQSYKLAAKAISKIQSLPGGSMEVLCNTVVKELFDLTGYDRVMAYKFHEDDHGEVFAEITKPGLEPYLGLHYPATDIPQAARFLFMKNKVRMICDCRARSIKIIEDESLHLDISLCGSTLRAPHSCHLQYMENMNSIASLVMAVVVNENEDDDEVGADQPAQQQKRKKLWGLLVCHHESPRYVPFPLRYACEFLAQVFAVHVNKEFELERQVREKSILRMQTMLSDMLLRESSPLSIVSGTPNIMDLVKCDGAALLYGGKVWRLQNAPTESQIRDIAFWLSDVHRDSTGLSTDSLHDAGYPGAAALGDMICGMAVAKINSKDILFWFRSHTAAEIRWGGAKHDPSDKDDSRRMHPRLSFKAFLEVVKMKSLPWNDYEMDAIHSLQLILRGTLNDDIKPTRAASLDNQVGDLKLDGLAELQAVTSEMVRLMETATVPILAVDSNGLVNGWNQKVAELTGLRVDEAIGRHILTVVEESSVPVVQRMLYLALQGKEEKEVKFEVKTHGSKRDDGPVILVVNACASRDLHDHVVGVCFVAQDMTVHKLVMDKFTRVEGDYKAIIHNPSPLIPPIFGADEFGWCSEWNAAMTKLTGWHRDEVINKMLLGEVFDSTNASCLVKNKDAFVSLCILINSALAGDETEKAPFSFFDRNGKYIECLLSVNRKVNADGVITGVFCFIQVPSHELQHALHVQQASQQNALTKLKAYSYMRHAINNPLSGMLYSRKALKNTGLNEEQMKEVNVADSCHRQLNKILSDLDQDSVMNKSSCLDLEMVEFVLQDVFVAAVSQVLITCQGKGIRVSCNLPERYMKQTVYGDGVRLQQILSDFLFVSVKFSPVGGSVEISCSLTKNSIGENLHLIDLELRIKHQGKGVPADLLSQMYEDDNKEQSDEGMSLAVSRNLLRLMNGDVRHMREAGMSTFILSVELASAPAK

SEQ ID NO: 164 - protein, 205 aa, Oryza sativa
MVQPKKKFRGVRQRHWGSWVSEIRHPLLKRRVWLGTFETAEEAARAYDEAAVLMSGRNAKTNFPVQRNSTGDLATAADQDARSNGGSRNSSAGNLSQILSAKLRKCCKAPSPSLTCLRLDPEKSHIGVWQKRAGARADSNWVMTVELNKEVEPTEPAAQPTSTATASQVTMDDEEKIALQMIEELLSRSSPASPSHGEGEGSFVI

SEQ ID NO: 165 - protein, 1132 aa, Zea mays
MSSSRPAHSSSSSSRTRQSSRARILAQTTLDAELNAEYEESGDSFDYSKLVEAQRSTPPEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLLGGSMEALCNTVVKEVFDLTGYDRVMAYKFHEDEHGEVFAEITKPGIEPYIGLHYPATDIPQAARFLFMKNKVRMICDCRARSVKIIEDEALSIDISLCGSTLRAPHSCHLKYMENMNSIASLVMAVVVNENEEDDEPEPEQPPQQQKKKRLWGLIVCHHESPRYVPFPLRYACEFLAQVFAVHVNKEFELEKQIREKNILRMQTMLSDMLFKESSPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKTKSLPWSDYEMDAIHSLQLILRGTLNDASKPAQASGLDNQIGDLKLDGLAELQAVTSEMVRLMETATVPILAVDGNGLVNGWNQKVAELSGLRVDEAIGRHILTLVEDSSVSLVQRMLYLALQAGREEKEVRFELKTHGSKRDDGPVILVVNACASRDLHDHVVGVCFVAQDMTVHKLVMDKFTRVEGDYKAIIHNPNPLIPPIFGADQFGWCSEWNAAMTKLTGWHRDEVVDKMLLGEVFNSSNASCLLKSKDAFVRLCIVINSALAGEEAEKASFGFFDRNEKYVECLLSVNRKVNADGVVTGVFCFIHVPSDDLQHALHVQQASEQTAQRKLKAFSYMRHAINKPLSGMLYSRETLKSTGLNEEQMRQVRVGDNCHRQLSKILADLDQDNITDKSSCLDLDMAEFVLQDVVVSAVSQVLIGCQAKGIRVACNLPERSMKQRVYGDGIRLQQIVSDFLFVSVKFSPAGGSVDISSKLTKNSIGENLHLIDFELRIKHRGAGVPAEILSQMYEEDNKEQSEEGFSLAVSRNLLRLMNGDIRHLREAGMSTFILTAELAAAPSAVGR

SEQ ID NO: 166 - protein, 228 aa, Arabidopsis thaliana
MGRGKIVIQRIDDSTSRQVTFSKRRKGLIKKAKELAILCDAEVGLIIFSSTGKLYDFASSSMKSVIDRYNKSKIEQQQLLNPASEVKFWQREAAVLRQELHALQENHRQMMGEQLNGLSVNELNSLENQIEISLRGIRMRKEQLLTQEIQELSQKRNLIHQENLDLSRKVQRIHQENVELYKKAYMANTNGFTHREVAVADDESHTQIRLQLSQPEHSDYDTPPRANE

SEQ ID NO: 167 - protein, 140 aa, Glycine max
  misc_feature (113)..(113): Xaa can be any naturally occurring amino acid
  misc_feature (126)..(126): Xaa can be any naturally occurring amino acid
MEEKKAESTNKNVKKANLLEHNSIKHILDESVSDIVKSRGYKEDVRLSNLKLILGTVIIVVALVAQFYNKKFPENRDFLIGCIASYVVLNGVLQLILYTKEKNAILFTNPPEXSFTSTGLVMSSKXLPRFSDEYTLTIDS

SEQ ID NO: 168 - protein, 369 aa, Pseudomonas aeruginosa
MSNLLLSPLAVGNLALRNRIVMAPMTRSRAQQPGDVPTALNALYYAQRAGAGLIVSEGTQISHLGQGYAYTPGIYSEAQLAGWRQVTEAVHAAGGLIAAQLWHVGRMSHRSLQAGGEAPIAPSPIQAKAQVFIADGQGGGSMAPADAPREMTLEDIRRVRDEFVRAARNALDAGFDLVELHGANGYLIDQFLASASNRRSDAYGGSLENRARFLLEIVDALVAAVGAERVGLRLSPWGTINDMHDDEPEAMTLYLAEALQRRGIAYLHLAEWEWSGGPAYPQGFRERLRERFRAPLIVCGNYDAERAEAILQAGLADAVAIGRPFIANPDLVERIRLGAPLAEANQARFYGGDAAGYTDYPTLGQSATA

SEQ ID NO: 169 - protein, 366 aa, Gibberella zeae
MPDSRLFQPMKIGNIQVQHRVGMAPMTRLRASVDRIPNALMKEYYSQRASTPGTLIITEGTLVSPAAGGGFARTPGIWNQEQVTAWKTITDEVHSKGSYIFVQLFAMGRAATVEVAKEEGIDIISASPVAFEGSNAQPRAMTLAEIHDMIDAFETASKNAVAAGFDGVEIHGANGYLLDQFLQDVSNHRDDEFGANIENRSRFISEIMERVVKAIGPERVGLRLSPWSTFQGMRMKDPIPQFTDIIGKAKTLDLAYLHLVESRICGSTDDINNGQEKLDFAYDIWKSPFLIAGGYKLQGAQDLVDSEHPDKEIMVMFGRDFVSNPDLVLKLQHGLDLTQGERNTYYTSDSAGYIDYPCAAKVAVSA

SEQ ID NO: 170 - protein, 487 aa, Oryza sativa
MLRAAARALTVSSLNPKVLALADHHLGGLVARRAQSMQQELDANPASHPFSEIIYCNHSNPQSQGQQPNKFFREVLALCNHPHLLDRSEASFMFSSDAITRAREIVGFIPGKTTGGYSHCQGIEGLRDAIAAGIASRDGLPSYSEDIFLTDGAAAPVHMMMHLLIRGKKDGILCPIPSHSLYTDSMVLRGATLVPYYLDESRGWSVNISDLKKQLDGARAKGIDVRGLVVVNPGNPTGQVLVEENQCEIVELCKNECLVLLADEVYQENIYTDQKKFNSFKKVARSIGYGEGDISLVSFHSVSNGYYGECGRRGGYMEVTGFSSEVRGEVYKVASLSACSNISGQILMSLVMNPPKVGDESYPSYRAERDSILSSLSCCAEAMVSTFNSMEGMTCNKAEGGISVFPSVRLPPRAIEAAEAMNTEPDVFYALRLLESTGIVVVPGSVFGQVPGTWHFRCTILPQEEKTRQIISRFNVFHEAFMEEFRS

SEQ ID NO: 171 - protein, 557 aa, Magnaporthe grisea
MPRLAAPPLPVPSHNLLRFLRSQTDGLLSFDAASATTCRTSRVVPSAHGPLGPRALTCKAKTLALPPGRRSFCTSNLRPQRTEGDGSRNFIFDMNKILPRVFRRQRGSTSRGTQEGQYPDEDRPNAYPRATKPTWQEKLGWGGVKSLGSDMGGPGSSDDCGPDNNFTFGSRRAQLMRAPMDPRLRCTEVDENGEVILVDGEYKKSELIAKYGLLPRDLRKIDSSNLPHILVRPSAILINLLHLRVLIKSDRVLLFDVFGSKTSYNQSAFMYDLQGRLRQKQPAGSNAVLPYEFRALEAVLISVTSALEADLLTVREPVVRVLRELEDDINRDRLRILLVLSKKVSTFEQKAKLVRDAIDELLEADDDLAAMYLTEKRHDLYRGVDDHTEVEMLLESYHKICDEVVQEASSLVSSIRNTEEIIRAILDANRNSLMLLDLKFSIGTLGLAMGTFLAGLYGMNLENFIEETNWGFAGVTTFSIFFSLLVCRYGLVKLRKVQRVKMHGTDGGTTSSWFRENVQTIEQGNAPGLGGNMGSIDKFRRIKNKSNNTSSNPGKWI

SEQ ID NO: 172 - protein, 268 aa, Burkholderia vietnamiensis
MSKIPAFGLGTFRLQGQVVIDSVRNGLELGYRAIDTAQIYGNEAEVGAAIAASGVRREDLFVTTKIWVDNYAPDKLAASLEDSLRKLRTDYVDLTLIHWPAPDNGVSVDAFMTALADAKSKGLTREIGVSNFNIALTKEAIAAVGSDAIATNQIELSPYLQNRKLVEFLQSERIHVTSYMTLAYGKVLGDPVLDAIARRHRATPAQVALAWALQLGYSVIPSSTKREHLASNLLAQTLRLTDEDLAQIATLERNGREVDPAGLAPQWD

SEQ ID NO: 173 - protein, 371 aa, Burkholderia vietnamiensis
MNHDPLFQPLQFGALTLPNRIVMPPMTRSRATQPGDEANELMAEYYAQRASAGLIVSEGTYIAPLGKGYAWTPGIHTRSQVAGWRKVTDAVHAAQGRIFAQLWHVGRLSHTSLHGGAQPVSSSPIQAKGVNVFIAGDDGSTPGFVQASEPRALTVAEIGEIVAQYRAAARNAMEAGFDGVELHGANGYLVNQFIDSNANTRTDAYGGSLENRLRFLREVAQALIEGTGDASRVGIRLAPLTTLNGCVDDDPETTYLAAATLLGELGVGYLHIAEADWDDAPLMPPAFKQKLRAAFGGVLIYAGKYTAERAREAIAAGWADLIAFGRPFVANPDLPERLRSGAALAPHDRNTLFGGGAKGLTDYPALAQACA

SEQ ID NO: 174 - protein, 340 aa, Geobacillus kaustophilus
MNTMLFSPYTIRGLTLKNRIVMSPMCMYSCDTKDGAVRTWHKIHYPARAVGQVGLIIVEATGVTPQGRISERDLGIWSDDHIAGLRELVGLVKEHGAAIGIQLAHAGRKSQVPGEIIAPSAVPFDDSSPTPKEMTKADIEETVQAFQNGARRAKEAGFDVIEIHAAHGYLINEFLSPLSNRRQDEYGGSPENRYRFLGEVIDAVREVWDGPLFVRISASDYHPDGLTAKDYVPYAKRMKEQGVDLVDVSSGAIVPARMNVYPGYQVPFAELIRREADIPTGAVGLITSGWQAEEILQNGRADLVFLGRELLRNPYWPYAAARELGAKISAPVQYERGWRF

SEQ ID NO: 175 - protein, 252 aa, Arabidopsis thaliana
MAYQSELGGDSSPLRKSGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQSQPFDSRNYFQVAALQPNNHHYSSAGRQDQTALQLV

SEQ ID NO: 176 - protein, 247 aa, Ipomoea nil
MEFQSDQSREMSPQRKMGRGKIEIKRIENTTNRQVTFCKRRNGLLKKAYELSVLCDAEVALIVFSSRGRLYEYANNSVKATIDRYKKACSDSTNTGSISEANTQFYQQEANKLRQQISNLQNQNRNYMGEGLGGFNLRDLKNLESKIEKGISKIRAKKNELLFAEIDYMQKRQEIDLHNNNQYLRAKIIETERAQQQQQQMNLMPGSSSYHELAPPQQFDARNYLQLDGFQSTSSYSKQDHLPLQLV

SEQ ID NO: 177 - protein, 230 aa, Beta vulgaris
  misc_feature (199)..(199): Xaa can be any naturally occurring amino acid
  misc_feature (212)..(212): Xaa can be any naturally occurring amino acid
MGRGKIEIKRIENTTNRQVTFCKRRNGLLKKAYELSVLCDAEVALIVFSSRGRLYEYANHSVKGTIDRYKKACSNQSGAGSVAEANAQYYQQEAAKLRNQIRTATENNRLLSRHMMGEGLSSLSMKELKNLETKLERGISRIRSKKNELLFAEIEFMQKREIELHNNNQFLRARISENERAQQSMSLMPGGSDYDLVPXQSFDSRNYFQVNXLQPSSQYARQDQTPLQLV

SEQ ID NO: 178 - protein, 291 aa, Corynebacterium glutamicum
MTFTLNNGLAIPDIGFGVFQTPPDETRNSVNAALEAGYRHIDTAAAYGNEREVGEAIAASGIGRDEITIETKIWVTDYGFEETLHAFDKATGKLGVDTLDILILHQAVPSSFDRTIAAYKALEKLLFDGAVRAIGVSNFMPEHLDKLLLETSIVPALNQIECHPYFQQRDVLARNEQLGILTQAWSPIGGITFYRDGQLPSTLENEVIAGIAAEVGKTPAQVMLRWHLQRRRHAIPKSVTPSRIVENFEIFDFELSDEQLQQIDALNTDLRGGPEPENITMENYYREIPEA

SEQ ID NO: 179 - protein, 244 aa, Ipomoea nil
MEFPNQALEEEESSHRKSGRGKIEIKRIENTTNRQVTFCKRRNGLLKKAYELSVLCDAEVALIVFSTRGRLYEYANNSVRATIDRYKKHHSDSTNTGSVSEANTQFYQQESAKLRRQIREIQTSNKQILGESLGVLNHKELKNLEGKVEKAIGRVRSKKNELLFSEIELMQKREIELQNANMYLRAKISEFERAQQQMNLMPGSEYQETMTTSQTYDAHNFLPLTLLEPNQHYSRHDQTALQLV

SEQ ID NO: 180 - protein, 446 aa, Oryza sativa
MAAAGAGSSEVAARVLLQRYQPFAPPPGEYHQFGSGGAAAAGDMTEAVLIRTPLKRKHDREENEAAESNDWMMSPGYTNPAGSPVPTPLSGKGSKAFAKSKAAKGQKSCPQTPLCASSPGNPVTPVGGCRYDSSLGLLTKKFLNLLKGAPGGIVDLNNAAETLEVQKRRIYDITNVLEGIGLIEKKLKNNIRWKGIDDSRPGEVSDDMSILQADIEALSLQEHSVDQQISEMRDKLRGLTEDENNQKWLYVTEDDIKSLPCFQNQTLIAIKAPHGTTLEVPDPDEVNDYPQRRYRIVLRSTMGPIDVYLVSQFEEMSGMETPPRTVQPVSMDSLENPRTPLAAEPNKAAESQPNIQDGLLMPSDAPSSSQDIGGMMKIVPSELDTDADYWLLSDAGVSITDMWKTAPEVEWEGIEKFNAEDFLEVSTPRQQDKPSSDIMDGDSCIS

SEQ ID NO: 181 - protein, 237 aa, Oryza sativa
MWRRDDPAASLLPSSAFALRRLSSAANVSRFAQLKRFDRARRFAPAAAMSTSSGPKEAPANNPGLQAPSEKDPATKGYFMQQTMFRVKDPKVSLDFYSRVMGMSLLKRLDFPEMKFSLYFLGYEDVESAPTDPVKRTVWTFGQRATLELTHNWGTENDPEFKGYHNGNSDPRGFGHIGVTVHDVYKACERFERLGVEFVKKPDDGKMKGIAFIKDPDGYWIEIFDLNRIGAVTAEAS

SEQ ID NO: 182 - protein, 542 aa, Methylococcus capsulatus
MAAKEVRFSDDARHRMLAGVNILADAVKQTLGPKGRNVVLEKSFGAPVVTKDGVSVAKEIELKDKFENMGAQMVKEVASKTSDVAGDGTTTATVLAQAIVREGLKSVAAGANPMDIKRGIDQAVGVVVEELKKLSKPCTDSKAIAQVGTISANSDESIGQIIAQAMDTVGKEGVITVEEGSGLQNELDVVEGMQFDRGYLSPYFINKQDTMGVELENPYVLLHDKKISSIRDLLPVLEKTAKAGRSLLIIAEDVDGEALATLVVNNMRGILKVCAVKAPGFGDRRKAMLEDIAILTGGQVISEELGLSLEKVELTDLGQAKKIQINKETTTIVDGAGSADAIKARVEQIRKQIEDTTSDYDREKLQERVAKLAGGVAVIKVGAATEVEMKEKKARVEDALHATRAAVEEGIVPGGGVALIRAQQALKTLEGKNHDQTVGIAILRRAIEEPLRQIVANAGEEPSVVLAKVQEGTGTFGYNAGTAEYGDMIEMGILDPTKVTRSALQNAASVAGLMLTTEAMVAEMPKKEKGGMPAGGGMDDMM

SEQ ID NO: 183 - protein, 442 aa, Gibberella zeae
MTVQSQQQSQAIPVLSSQNGTEPQDANKEVVQNVAAKGVQYFNPEQLPAPGLGINGPNNTLPKVFTPIKIRGMTMPNRIWVSPMCQYSARDGFQQPWHFAHYGGLAQRGPGLIMLEATAVQARGRITPEDSGIWLDSHVEGLRKHVEFAHANNSLIGIQIGHAGRKASCVAPWLDAGLAAEKAAGGWPDDVVGPSNEPFAPGYPTPRAITLEEIEQLKEDFVSGVRRAVEAGFDTIDFHFAHGYLVSSFLSPATNKRTDKYGGSFENRVRLALEIVEAARAVMPEDMPLFTRISGTDWLENNPEYEGETWTLEQSIKLAHQLADRGVDVLDVSSGGIHKMQKVAAGPGYQAPLAKAIKKSVGDKMLISTVGSIKIGTLAEEIIAGGEDDTPLDLVASGRLFQKNTGLVWSWADDLNTSIQIAHQIAWGFGGRAKKNAPKLVL

SEQ ID NO: 184 - protein, 637 aa, Nicotiana tabacum
MMESCDCIEALLPNDDLLVKYQYLSDFFIAFAYFSIPLELIYFVHKSACFPYRWVLMQFGAFIVLCGATHFISLWTFFMHSKTVAVVMTIAKILTAAVSCITALMLVHIIPDLLSVKTRELFLKARAEELDKEMGLIIRQEETGRHVRMLTHEIRSTLDRHTILKTTLVELGRTLDLAECALWMPCQGGLNLQLSHNLNNLLPLGSTVPINLPIINEIFSSPGAIQIPHTNALARMRNTAGRYIPPEVVAVRVPLLHLSNFHINDWPELSARSYAVMVLILPMNGLRKWRDHELELVQVVADQVAVALSHAAILEESMRAHDQLMEQNIALDVARQEAEMAIHARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQTLLNVAGNAVKFTKEGHISIEASVAKPEYARDCHPPEVYPMPSDGQFYLRVQVRDSGCGISPQDIPFVFTKFAETRNTSNRSSGGEGLGLAICRRFIQLMKGNIWIESEGLGKGTTVTFVVKLGVCNHPNALPLLPMAPRGRLNQGSDDLFRYRQFRGDDGGMAVTVQRYQRSL

SEQ ID NO: 185 - protein, 212 aa, Haemophilus influenzae
MNIEIIPVTAFQQNCSLIWDDEKNAAIIDPGGEAERLIQRIEELDLNLKVILITHGHLDHVGAAMQLKQHFGVEIWGSNEKDKFLFESLPEQAQRFGLPNIDAFLPDRWFNQEGEILKLDGFNFEILHLPGHTPGHIGFIEHEKKVAFTGDVLFQGGIGRTDFPRGDYETLISSIRTKLLPLNDDLIIIAGHGSYTTIGQEKRSNPFLNPKS

SEQ ID NO: 186 - protein, 161 aa, Zea mays
  misc_feature (13)..(13): Xaa can be any naturally occurring amino acid
  misc_feature (16)..(16): Xaa can be any naturally occurring amino acid
  misc_feature (30)..(30): Xaa can be any naturally occurring amino acid
  misc_feature (34)..(34): Xaa can be any naturally occurring amino acid
  misc_feature (36)..(36): Xaa can be any naturally occurring amino acid
  misc_feature (40)..(40): Xaa can be any naturally occurring amino acid
  misc_feature (65)..(65): Xaa can be any naturally occurring amino acid
  misc_feature (80)..(80): Xaa can be any naturally occurring amino acid
  misc_feature (92)..(92): Xaa can be any naturally occurring amino acid
  misc_feature (95)..(95): Xaa can be any naturally occurring amino acid
  misc_feature (104)..(104): Xaa can be any naturally occurring amino acid
  misc_feature (109)..(109): Xaa can be any naturally occurring amino acid
  misc_feature (116)..(116): Xaa can be any naturally occurring amino acid
  misc_feature (128)..(128): Xaa can be any naturally occurring amino acid
QKIYYLTGAKGTXDRXAAGEKAENATTAQXEGHXTXQEGXDAGEEANNQNETKDATTNRARTPTXEKTRKTKARGGKRRXPGEGPQEKTGGXPQXHKAPNKKEXQEETXRKKKAQXPQDGTRANKATXAWGGEAGDPIHDKRCNSGTTDMDPERNMRKRGR

SEQ ID NO: 187 - protein, 370 aa, Unknown
  Burkholderia sp. 383
MTALFSPFTLRGVTLPNRIVISPMCQYSAERGEATDWHMIHLGHLALSGAGLLCIEATAVEPDGRITHGDLGLWDDVTEAALKPVLAAIRKHSPVRVAMQLSHAGRKASSNVPWQGGQLVSVADGGWLPHAPSAVPHKDGETPPLALDAAGLNRIREAFAASAKRAARLGIDAIEVHAAHGYLLHQFLSPLANQRTDEYGGSLENRMRFPLEIFEIVRAAFPEGRPVGVRVSATDWVEGGWELDDTIAFAHELKRRGCDWIDVSSGGVSPLQKIPLSAGYQVPFAQAVKRAVGMPTIAVGLINEPAHANRLIEAGDADFVAMARAMLYDPRWPWHAAAELGAQVTAPPQYWRSQPREHKALFGDIAFGQR

SEQ ID NO: 188 - protein, 455 aa, Geobacillus kaustophilus
MSQQRKSIIPDDFLWGGAVTSFQTEGAWNEGGKGLSIVDARPIPKGHSDWKVAVDFYHRYKEDIALFKELGFTAYRTSIAWTRIFPDGEGEPNEAGLAFYDAVFDELRANGIEPVITLYHFDLPLALAKKYNGFASRKVVDLFERYARTVFERYRGKVNYWLTFNEQNLVLEQPHLWGAICPEDEDPEAFAYRVCHNVFIAHAKAVKALREIAPEAKIGGMVTYLTTYPATCRPEDALANVQAKELFIDFFFDVFARGAYPRYVTNQLEKKGICLPLEAGDEELLRSQTVDFLSFSYYQSQIVRHQEQDERIIKGLEPNPYLPKTKWGWAIDPIGLRIALKDVYARYEMPIFITENGIGLEEELNENGTVDDDERIDYLRRHIEQMKMAMEEGVEVIGYLMWGATDLLSSQGEMRKRYGVIFVNRDDENLRDLKRYKKKSFYWFQRVIRTNGEEL

SEQ ID NO: 189 - protein, 292 aa, Arabidopsis thaliana
MEKTLVGGCGGENEEVILGKELDFLGREQVSNIRRDSFVEPLGSILLQLEAFWVFPWLVFINGICITLSYHRNLSHRSFDLPKWLEYLFAYGGVLAFQGDPIEWVSNHRYHHKHCETQRDPHSPTQGFWFSHMAWIFDTSSILENCGGEENVDDLVRQPFYRFLQRTVLLHMMAYSFLFYFCGGMPLLVWGIGITIAVRLHLTFLVNSVCHIWGTRAWNTSDFSKNNWWVAILTLGEGWHNNHHAFEFSARHGLEWWQLDITWCLIRFLEAIGLATNVKLPTETQMKGKALV

SEQ ID NO: 190 - protein, 207 aa, Zea mays
  misc_feature (111)..(111): Xaa can be any naturally occurring amino acid
  misc_feature (135)..(135): Xaa can be any naturally occurring amino acid
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLHNWREEFLIQAXSPSDPDNFPFVLLGNKVDVDGGSXRVVSEKKAKAWCASKGSIPYFETSAKDGTNVEDAFQCIVKNALKNEPEEELYVPDTVDVVGGNRAQRSSGCC

SEQ ID NO: 191 - protein, 524 aa, Solibacter usitatus
MKIRTSLQLALIVGGCTVLAPLYGPAISASAATTQDDLDKNIKSLAGALSILEDNYADKISSEKAIYQGAIPGMLRTLDPHSNFLDPSEYQDMQRKQRAQYFGIGMLISMDGPKVIAMEPFPGSPAWRADLRRGDVIVAVDGNDVTKKDSSAVADLLRGPRGSQVRVSVMREGAPAPVTVTVTRGEIETSLVDAFWIKPGIAFLKVTSFEAQNVARDVEAAMQKLGEANVKGLILDLRENRGGLVTEAVSLAGRFLRDGQVVVSHRGRAEKEQVFRANKANPAAQKYPIVVLVNGNSASASEIVSGALQDHDRALIMGETTFGKGLVQAQFPLSEGALLLTIAHYYTPSGRLIQRDYSKGSFFDYYYARKPIQNSDDIKATDTGRKMYGGGGITPDEKYDPEKSTMFERRVFSSSIIYRFANSYFGAAKPSLPANWTPDADLLSRFKDYLHTKNVAFTDAEFNRDKKWITEQIRDEFYLRAFDKKTSDRAQFLDDPEVHQAVESLPKAEAMHAEAQKVMAARRQ

SEQ ID NO: 192 - protein, 182 aa, Aspergillus nidulans
MSNLQPSSSEPSIFEVGAFLPGGHNTDPALPENSPTAGFKLNHFMLRIRDPKRSLHFYMNLMGMRTVFTMNTGPWTIYYLGYPSTPQDRADLPAWSAKVGGDNRTLTSTLGLLELYHVHGSEKPISEGGYEISTGNEPPNLGFGHLGFTVPDVPKALERLRGAGVRVIKELSVSTRESIPLK

SEQ ID NO: 193 - protein, 348 aa, Antirrhinum majus
LSFDLVEAWIRDNPKASICTPEGAYNFKNIANFQDYHGLPVFRNAVARFMEKVRGNRVRFDPDKIVMSGGATGAQETLAFCLADPGDALLVPTPYYPGNDRDITWRTGIQLLPVVCESSNEFKLTHEALESAYKKAQDSNIKVKGLLLNNPSNPLGIVLDKQTLTDSLNFTNDKNIHLICDEIYSATVFSQPSFTSIAEIVQENENYNRDLIHIVYSLSKDLGFPGFRVGIIYSYNQTVMNCARKMSSFGLVSTQTQHLIATMLSDSDFVDRFIDESAKRLGKRHGVLSRGLAQVGIGSLKSNAGLYCWMDLRRLLKEPTFEAELDLWRVILNEVKLNVSPGASFHCS

SEQ ID NO: 194 - protein, 306 aa, Gibberella zeae
MAPSTFKLNTGQEIPAVGLGTWQSPAGEVEKAVTYALKDGYKLIDCAYCYGNEEEVGAGLKAAFKAGVKREDIFVVTKAWATYNTRVELALDKSLKALGLDYVDLFLVHWPLLLNPDGNDDKFPKKPDGSRDVIRDYNHVDGWKLMEKLPATGKTRAVGVCNYSKKYLEELLPHATIVPAVNQIENHPELPQQEIVDFCKEKGIHIEAYSPLGSTGGPVMSAEPVVKIADKKGVSASTVLLSYHGNTVLAKSVNPERITANKTIVDLDDEDMKALNDYSAELQKNNQVKRYVYPPFGIDFGFPDKS

SEQ ID NO: 195 - protein, 444 aa, Campylobacter jejuni
MMELILKTKRFFAGLAGFATTFILCLFLTSHLQAKVDQKEEQVQKRLEALDKLTKTLAIVEQYYVDDQNISDLVDKSLSGLLSNLDAHSSFLNEKDFNDMKIQTNGEFGGLGITVGMKDGALTVVSPIEGTPADKAGIKSGDIILKINDEATLGINLNDAVDKMRGKPKTQITLTIFRKGATKPFDVTLTREIIKIESVYAKMIENENILYLRVTNFDKNVVDVASKELKKYPNVKGVILDLRNNPGGLLNQAIGLVNLFVDKGVIVSQKGRIASENQEYKADPKNKISNASLVVLVNGGSASASEIVSGALQDLKRGVIVGENTFGKGSVQQIIPINKTEALRLTIARYYLPSGRTIQAVGVKPDIEVFPGKVNTQEDGFSIKESDLKQHLESELEKIDKNKKEDKQENKDNKNLISQKQINDDAQLNSAIDTIKILNIKQGR

SEQ ID NO: 196 - protein, 832 aa, Unknown
  Frankia sp. EAN1pec
MNGRPDSVNLSRFTDTAVVDRPGVVERTGGADRPGGADPAAPNGAPDPAAAARPAGAPEPTGTPDPASAPPLGLPGEVLDRLAGGAHHDPHGVLGAHPTRGWTVIRALRPDATAVTVLVDGTRHPMTRLHSGGIFAVAVPGGIPDYRFEVTYPDSTHVVDDPYQHLPTLGEIDLHLIGEGRHERLWHVLGAHVRRLDRGPGGGGGGGTVAGVSFAVWAPNARGVRVVGDFDFWDGRGFPMRSLGSSGVWELFVPGIGAGTRYKYEILGSDGVWRQKADPLAFATEQPPATASVVHESSYTWDDAAWLERRASIPWHAAPVSVYEVHLASWRRGLSYLELAEQLVEYVRENGFTHVEMLPVAEHPFGGSWGYQVTSYYAPTSRFGSPDEFRHLVDALHAAGIGVIVDWVPAHFPRDAFALGRFDGTPLYEHPDPRRGEQPDWGTYVFDFGRSEVRNFLVANALYWLEEFHVDGLRVDAVASMLYLDYSRPSGEWVPNAHGGRENLEAVSLLQEVNATVYRRVPGAMMIAEESTAWPGVTRPTHLGGLGFGFKWNMGWMHDTLDYSSRAPLFRTYHHHQMTFSLMYAFSENFVLPFSHDEVVHGKGSLLRKMPGDRRAQLANLRALYGYMWAHPGKQLLFMGCEFAQDNEWSEATSLDWHLLGEAGHGGVARLVRDLNHTYREIPALWERDSDPSGFSWIDASDAENNVFAFVRWGEDGERALACVTNFAGVGQVGYRLGFPFPGRWREVLNTDALDYGGGGMGNLGGITAVADPSHGLPASAALSLPPLGTVWFVHEPADGGPAGDGPSADGQTDNELTASEPADGVRSDPEA

SEQ ID NO: 197 - protein, 473 aa, Clostridium longisporum
MSFDLSFPKSFLWGGATAANQFEGAYNEDGKGLSIQDIAPKGVMGPITEVPTEDNMKLIGIDFYHRYKEDIKLFAEMGFKTFRLSIAWSRIFPNGDDEIPNEKGLEFYDKVFDELQRYGIEPLVTLSHYETPLNLSKKYNGWANRDLIGFYERYVRTVFTRYKDKVKYWLTFNEINSAIHAPYMSAGIWTDKSELSKQDLYQAMHHELVASALAVKIGHEINPDFKIGCMILGIPVYPLTPHPDDLIEKMRVERESLFFADVHARGKYPRYMNRLFKENNIEIKWHEDDAEILSNVVDFISFSYYMSSCATADEEKKKAGAGNLLAGVPNPYLKASEWGWQIDPKGLRLILNELYDRYEKPLFIVENGLGAVDELVTDENGNKTVNDDYRIKYLNDHLVQVAEAIEDGVELMGYTTWGCIDLVSASTAELKKRYGFIYVDRHDDGSGTLERYKKKSFNWYKEVIATNGKSLER

SEQ ID NO: 198 - protein, 156 aa, Arabidopsis thaliana
MDLEFGRFPIFSILEDMLEAPEEQTEKTRNNPSRAYMRDAKAMAATPADVIEHPDAYVFAVDMPGIKGDEIQVQIENENVLVVSGKRQRDNKENEGVKFVRMERRMGKFMRKFQLPDNADLEKISPACNGGVLEVTNPKLPPPEPRNPRQNKVQFA

SEQ ID NO: 199 - protein, 552 aa, Glycine max
MALAPPSVFALYIVIDLKIEIYMTISAMCGILAVLGCVDNSQTKRARIIELSRRLRHRGPDWSGIHCYEDCYLAHQRLAIVDPTSGDQPLYNEDKTVIVTYEEHGEEFVNMLDGMFAFILLDTRDKSFIAARDAIGITPLYLGWGHDGSTWFASEMKALSDDCERFISFPPGHIYSSKQGGLRRWYNPPWFSEDIPSTPYDPTLLRETFERAVVKRMMTDVPFGVLLSGGLDSSLVAAVVNRYLAESESARQWGSQLHTFCIGLKGSPDLKAAKEVADYLGTRHHELYFTVQEGIDALEEVIYHIETYDVTTIRASTAMFLMSRKIKALGVKMVLSGEGSDEIFGVFMALMIWQIKALHLYDCLRANKSTAAWGVEARVPFLDKEFINVAMSIDPEWKMIRPDLGRIEKWVLRNAFDDDKNPYLPKHILYRQKEQFSDGVGYSWIDGLKDHANKQVTDATMMAANFIYPENTPTTKEGYLYRTIFEKFFPKNAAKATVPGGPSVACSTAKAVEWDAAWSKNLDPSGRAALGIHDAAYDAVDTKIDEPKNGTL

SEQ ID NO: 200 - protein, 250 aa, Salix discolor
MGRGRVQLKRIENKINRQVTFSKRRTGLLKKAHEISVLCDAEVALIVFSHKGKLFEYSTDDCMEKILERYERYSYEERQLAATDFDSPGNWTLEYNRLKAKVELLQRNHRNYLGEDLDSMSLKELQNLEQQIDTALKHIRARKNHLMSQSISELQRKEKAIQVQNNMLVKQIKEKEKKDKAVAQPALWDDQQNQGPHASSFLLSQPAGLPLPCLNIGGCYQEETDPEVRRNELDHALEPTYSFHLGGYGA

SEQ ID NO: 201 - protein, 261 aa, Triticum aestivum
  misc_feature (208)..(208): Xaa can be any naturally occurring amino acid
AYLGDSIRTSLYKKAGWHRSGIPGISSTHASGFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPSGKLRVMYEVFPMSFLMEGGXGAKSFTGKGRALDLDPHRTSTRESPIFPRRQRRRGRRSRRLYPEEATEGKDLP

SEQ ID NO: 202 - protein, 382 aa, Triticum aestivum
KAKAKPTCSRSVPPTPAQPASLPAPPPVPMAATPPSSRDPSPQPRRPAAAAGRPAASGTGTIGNGKRGGLLLGRYELGRVLGHGTFAKVYHARHADTGETVAIKVLDKEKALRAGLVPHIKREITILRRVRHPNIVRLFEVMATKSKIYFVMEFVRGGELFARVAKGRLKEDTARRYFQQLISAVGFCHARGVFHRDLKPENLLVDERGDLKVSDFGLSAVADQFHPDGLLHTFCGTPSYVAPEMLARRGYDGAKADIWSCGVILFVLMAGYLPFHDQNLMAMYRKIYRGEFRCPRWFSRDLTSLLNRLLDTNPETRITMAEVMQSRWFQKGFRPVRFYVEDDQLHSLGDSESEELGLVEPTEPPLPPPLSAAAAATTAARG

SEQ ID NO: 203 - protein, 347 aa, Antirrhinum majus
VSFDLLEEYLEKHSEATNCDSRNSGFRENALFQDYHGLLSFRKAMASFMEQIRGGRATFDPERVVITAGAPPANELLTFILANPGDALLIPTPYYPGFDRDLRWRTGVNIVPIHCDSSNNFEITPQALEAAYNEAESKNIKVKGVLITNPSNPLGATIKRAILEQILEFVTRKNIHLISDEIYSGSSFSPEEFVSIAEILEAQDYKNSERVHIVYSLSKDLGLPGFRVGTIYSYNDKVVTTARRMSSFTLISSQTQHLLASMLSDKEFTKEYININRSRLRKRYEMIVDGLKEAGIECLKGNAGLFCWMNLKPLLEKPTKEHEVELWKLIMYEVKLNISPGSSCHCS

SEQ ID NO: 204 - protein, 517 aa, Dianthus caryophyllus
MGSYKGVYDREILSKIATNDGHGENLEYFDGWKAYDRDPYHSTKNSNGVIQMGLAENQLCFDLVTEWLLKNPQASICTNEGVNKFMDIAIFQDYHGLPEFRSAVAKFMGKARDEKVIFNPDRIVMSGGASASETLLFCLANPGDAFLIPSPYYPAFNRDLRWRTGVNLIPFTCSSSNNFKITKEALQSAYEDALKKNIKVKGIIVTNPSNPLGTVLDKDTLKMLLTFVNAKNIHLVCDEIYATTVFNSPSFISVAEVIKDMPHVNQDLVHILYSLSKDMGMPGFRVGIIYSYNDRVVSTARRMSSFGLVSSQTQFMIAALLSDDDFVRRFLVESRDRLFRRHQHFTSELAKIGIGCLQGNAALFVWMDLRHLLDEATVERELKLWRVIINEVKINVSPGSSFLCSEPGWFRVCFANMDNATLDVALNRIRSFVTRGRVDNSTMTTTSARAAATTTTTTTTTTTTTTTTTTIKKKRGQMELRLSFNNRRFEDGLMSPHSILLSPHSPMPQSPLVKART

SEQ ID NO: 205 - protein, 1518 aa, Saccharomyces cerevisiae
MTGHVSKTSHVPKGRPSSLAKKAAKRAMAKVNSNPKRASGHLERVVQSVNDATKRLSQPDSTVSVATKSSKRKSRDTVGPWKLGKTLGKGSSGRVRLAKNMETGQLAAIKIVPKKKAFVHCSNNGTVPNSYSSSMVTSNVSSPSIASREHSNHSQTNPYGIEREIVIMKLISHTNVMALFEVWENKSELYLVLEYVDGGELFDYLVSKGKLPEREAIHYFKQIVEGVSYCHSFNICHRDLKPENLLLDKKNRRIKIADFGMAALELPNKLLKTSCGSPHYASPEIVMGRPYHGGPSDVWSCGIVLFALLTGHLPFNDDNIKKLLLKVQSGKYQMPSNLSSEARDLISKILVIDPEKRITTQEILKHPLIKKYDDLPVNKVLRKMRKDNMARGKSNSDLHLLNNVSPSIVTLHSKGEIDESILRSLQILWHGVSRELITAKLLQKPMSEEKLFYSLLLQYKQRHSISLSSSSENKKSATESSVNEPRIEYASKTANNTGLRSENNDVKTLHSLEIHSEDTSTVNQNNAITGVNTEINAPVLAQKSQFSINTLSQPESDKAEAEAVTLPPAIPIFNASSSRIFRNSYTSISSRSRRSLRLSNSRLSLSASTSRETVHDNEMPLPQLPKSPSRYSLSRRAIHASPSTKSIHKSLSRKNIAATVAARRTLQNSASKRSLYSLQSISKRSLNLNDLLVFDDPLPSKKPASENVNKSEPHSLESDSDFEILCDQILFGNALDRILEEEEDNEKERDTQRQRQNDTKSSADTFTISGVSTNKENEGPEYPTKIEKNQFNMSYKPSENMSGLSSFPIFEKENTLSSSYLEEQKPKRAALSDITNSFNKMNKQEGMRIEKKIQREQLQKKNDRPSPLKPIQHQELRVNSLPNDQGKPSLSLDPRRNISQPVNSKVESLLQGLKFKKEPASHWTHERGSLFMSEHVEDEKPVKASDVSIESSYVPLTTVATSSRDPSVLAESSTIQKPMLSLPSSFLNTSMTFKNLSQILADDGDDKHLSVPQNQSRSVAMSHPLRKQSAKISLTPRSNLNANLSVKRNQGSPGSYLSNDLDGISDMTFAMEIPTNTFTAQAIQLMNNDTDNNKINTSPKASSFTKEKVIKSAAYISKEKEPDNSDTNYIPDYTIPNTYDEKAINIFEDAPSDEGSLNTSSSESDSRASVHRKAVSIDTMATTNVLTPATNVRVSLYWNNNSSGIPRETTEEILSKLRLSPENPSNTHMQKRFSSTRGSRDSNALGISQSLQSMFKDLEEDQDGHTSQADILESSMSYSKRRPSEESVNPKQRVTMLFDEEEEESKKVGGGKIKEEHTKLDNKISEESSQLVLPVVEKKENANNTENNYSKIPKPSTIKVTKDTAMESNTQTHTKKPILKSVQNVEVEEAPSSDKKNWFVKLFQNFSSHNNATKASKNHVTNISFDDAHMLTLNEFNKNSIDYQLKNLDHKFGRKVVEYDCKFVKGNFKFKIKITSTPNASSVITVKKRSKHSNTSSNKAFEKFNDDVERVIRNAGRS

SEQ ID NO: 206 - protein, 254 aa, Sinapis alba
MGRGRVELKRIENKINRQVTFAKRRNGLLKKAYELSVLCDAEVALIIFSNRGKLYEFCSSSSMIRTLERYQKCNYGPPEPNVPSREALAVELSSQQEYLKLKERYDALQRTQRNLLGEDLGPLSTKELELLERQLDSSLKQIRALRTQFMLDQLNDLQSKERMLNETNKTLRLRLADGYQMPLQLNPNQEDHHVDYGRHDQQQQQNSHHAFFQPLECEPILQMGYQGQQDHGMEAGPSENNYMLGWLPYDTNSI

SEQ ID NO: 207 - protein, 114 aa, Glycine max
REGLSTMNGKDLKNLETKLEKGISRIRSKKNERLFAEIEHMKKREIHLNNDNQLLRAKIAAGERSHHNVNGLSGSISYESMQSQFDSRGFFQVTGLQPNNNQYAGQDNMSLQFV

SEQ ID NO: 208 - protein, 190 aa, Conocephalum supradecompositum
DEHGEVVAEIRRSDLEPYLGLHYPATDIPQASRFLFMKNRVRMICDCCAQPVQVVQDKELRQPLSLAGSTLRAPHGCHAQYMGNMGSIASLVMAVIINDNDEEYSSRGYQHKGRKLWGLVVCHHTTPRSVPFPLRSACELLMQVFGLQLNMEVELAAQLREKRILRTQTLLCDMLLRDAPIGIVSQSPNI

SEQ ID NO: 209 - protein, 918 aa, Shigella flexneri
MTNYSLRARMMILILAPTVLIGLLLSIFFVVHRYNDLQRQLEDAGASIIEPLAVSTEYGMSLQNRESIGQLISVLHRRHSDIVRAISVYDENNRLFVTSNFHLDPSSMQLGSNVPFPRQLTVTRDGDIMILRTPIISESYSPDESPSSDAKNSQNMLGYIALELDLKSVRLQQYKEIFISCVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSIQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTPTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQRQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLAGENPEGLVDLIHKLHGSCGYSGVPRMKNLCQLIEQQLRSGTKEEDLEPELLELLDEMDNVAREASKILG

SEQ ID NO: 210 - protein, 696 aa, Leptospira interrogans
MNESSHKTFTDKINEFYKRSFELFSKGSYLEEMDKFYSLCKTTLYADFIILLESKDPLSIKIVESQPKFNFSIDQTNINLLSISYSENRPVLPYTLTRQEINFSNFDALEEIDFAQMIAVPIPNENIEDRRKNILLFLYSKNTEHISEFLKLITELSPRIYEIFSIKNKEILLNSVHSRLDSILKTIPQAIIFMDSGTGKTWINESAAKLLSLSEGGEVSSWKVSTSMTELIQSAVNQKEIFLEMNRNLSNMNLEKFSTQWMFTDPEKKVFEVTSLLLPGKTAPGRLWFFEDITSFHSQQETLALLNQALKEKSEIAQQENQAKTVFISNISHEIRTPMTGILGITELLLNTPLNPDQKDSLELIQRSGDKLLKIVNHLLDFSKADTGKIELESIPFNMQELLNDLVSLLRTEILKNKNELNILFPPNFPKLLKGDPVRIGQILTNLVSNATKFTKEGTVEVGFHILEKTNSELSFRTWVFDTGIGIPPTKFNSVFEPFVQSDKSITRHFGGTGLGLSITKKLIELMGGKIHVESQPGIGTRFWFELKLEIPESIDEESFTENSEAEVITDKSDLSRLKVLIVEDNLINQKLLGRILKKKKIEPFLVEDGMKAIEKARKFHYDLIFMDINMPGIDGLSATEIIRKFPKGDSIRIVGLTANAAPEIQKVATQRGMDDLLTKPYNVSQIEKILNLFEK

SEQ ID NO: 211 - protein, 542 aa, Picrophilus torridus
MDLFEPGNIGNLEIKNRMVMAPMISNICNPDGSINENYIYYMERRALGGFGLLITEYAYINDENSKGSPNELGIISKSYLPKMKRLTDVIHGHGSRIFTQLVHAGGKANPDYNKRMIFAPSSLNEYPFLRPDEMTVNDIESVEEDFLRAARLAYRANFDGIEIHGAHGYLIQEFISKDLNKRNDRYGGSLENNVRIANEIIDMIRAELDFPVGIRLSLYEDEGYGPDYGIKAARLIKNADYVHFSAGRSAPPGSSAPFYYERNHIYKRIRERIDKKTMVVGSVIDINDARTVLEGSDLVVFGRAALADPFLPEKFRRNLPLRPCIRCNQACRDLSRGEARCTVNVETGLESRIKYKKYHGEIAIGGAGIKGLEAALYASKLGLNVYIYDNYSFGGQINEIYDEYKKREFMNLLKYYESALKINNVKIEHEGSYDVLCKPDKVYPDIDGDVSIDSNVYKYHDLALKIALKNHVIMSYRSLNSLDRSRADFYTKMATRLGIEFKSDYDFEFVLIDRDQYDIRKAMESGRNAIERYIMERENEFL

SEQ ID NO: 212 - protein, 250 aa, Salix discolor
MGRGRVQLKRIENKINRQVTFSKRRTGLLKKAHEISVLCDAEVALIVFSHKGKLFEYSTDDCMEKILERYERYSYEERQLATTDFDSQGNWTLEYNRLKAKVELLQRNHRNYLGEDLDSMSLKELQNLEQQIDTALKHIRARKNHLMSQSISELQRKEKAIQVQNNMLVKQIKEKEKKDKAVAQPAPIWDDQQNQGPHASSFLLSQPAGLPLPCLNIGGCYQEEAPEVRRNELDHALEPTYSFHLGGYGA

SEQ ID NO: 213 - protein, 328 aa, Prochlorococcus marinus
MIILHIGLFENSFSNIMKSVIFQETANLKKPVPAEKVIELSDKLLEPSSHSKRYPPRLHKTWGTIFFMIAIHLLSLLALQPQFWSMPAVTALFFFYWLTACLGVTLGYHRLLSHRSFVVPKWLERFFATCGAISCQHGPIDWVGLHRHHHSFSDTEVDHHNSKRGFWWSHMGWMFKDVEALKAVPKLSADLIKDPYYRFLNKYFLFLQIPIGLCLYAIGQKLGVGGWALVLWGIPLRLVVVYHITWLVNSATHCWGKAPFESGDGSKNNAWVAALTFGEGWHNNHHAFPNSARQGLFRGQIDLTWEHIKILAKLGFAKKVKLPSRSYY

SEQ ID NO: 214 - protein, 150 aa, Brassica napus
  misc_feature (42)..(42): Xaa can be any naturally occurring amino acid
MAIRLMDLDSPFFNTLHRIMDLTEDAEKNLNAPTRTYVRDAXAMAATPADVKEYPNSYVFVIDMPGLKSGDIKVQVEDDNVLLISGERKREEEKEKEGGKYLRMERRLGKLMRKFTLPENANTDAISAVCLDGVLTVTVNKLPPPQPKKP

SEQ ID NO: 215 - protein, 211 aa, Tulipa gesneriana
MGRGKIEIKRIENSTNRQVTFSKRRNGIIKKAREISVLCDAWVSVVIFSSSGKMSEYCSPTITLPKMLDKYQQNCGNKLWDAKHQNLSEEIDRIKKENDNMQIELRHLKGEDLNSLQPKELIPIEEALENGFRSVREKQDDVLMTRKKNMRLMEEDNKRLNYVLHHQQQQAMDENIRDMELAYHQKHREFNSQMPMTFRVQPIQPNLHENK

SEQ ID NO: 216 - protein, 166 aa, Oryza sativa
MLLCFNKVASIALSPNVPGQIFMGLMVNPPKPGDISYLKFSAESKSILESLRRRARLMTDGFNSCRNVVCNFTEGAMYSFPQIRLPPKAIDAAKRAGKAADVFYCLKLLEATGISTVPGSGFGQKEGVFHLRTTILPAEEDMPAIMTSFKKFNDTFMDQYDGYSRM

SEQ ID NO: 217 - protein, 547 aa, Unknown
  Bradyrhizobium sp. BTAi1
MAAKDVKFAGDARDRMLRGVDILANAVKVTLGPKGRNVVIEKSFGAPRITKDGVTVAKEIELEDKFENMGAQMLREVASKTNDLAGDGTTTATVLAQAIVREGAKAVAAGMNPMDLKRGIDTAVAAVIKDIEKRAKPVASSAEVAQVGTISANGDAAIGKMIAQAMQKVGNEGVITVEENKSLETEVDIVEGMKFDRGYLSPYFVTNAEKMTAELDDVYVLLHEKKLSGLQAMLPVLEAVVQSGRPLLIIAEDVEGEALATLVVNRLRGGLKVAAVKAPGFGDRRKAMLEDIAILTGGQLISDDLGMKLENVTIKMLGRAKKVVIDKENTTIVNGAGKKADIEARVGQIKAQIEETTSDYDREKLQERLAKLAGGVAVIRVGGATEIEVKEKKDRVEDALNATRAAVQEGIVPGGGVALLRAKKAVGRITNPNSDVQAGINIVLKALEAPVRQIAENAGVEGSLVVGKILEEKSETFGFDAQSEDYVDMVAKGIIDPAKVVRTALQDASSVAGLLVTTEAMVAELPKEAAPAMPAGGGMGGMGGMGF

SEQ ID NO: 218 - protein, 448 aa, Arabidopsis thaliana
MASQGCVDWQFSGSDAAEKAAQASLGTYSSEIFSLCDPQGKPILPPLSEEAETSHTAEKAVVKAVLCGTGNAYAPSIGLPVAKRAVAEYLNRDLDNKLTGDDVYMTVGCKQAIELAVSILAKPKANILLPRPGFPWDMVHSIYKHLEVRRYEFIPERDFEIDFNSVREMVDENTFAIFIINPHNPNGNYYTEAHLKQLATLARELGIMVVSDEVYRWSVFGSNPFVPMGKFSSIVPVITLGSISKGWIVPGWRTGWLALHDLNGVFRSTKVPAYLVLYGQVLKAAKEFLEITSKPPTVIQAAIPTILEKTPQDFFEKRGIFLKDKVDFGYSKLKNIPTLTCYMKPESCTFLWFETNFSLWIIRIAQTKLDPLHFVDIEDDHDFCRKLAKEENLVVLPGIAFGQNNWLRHSIDMETPRLEDAFERLKSFCERHSVIVEASSLKDVNGVN

SEQ ID NO: 219 - protein, 563 aa, Xylella fastidiosa
MCSIFGIFNLQPSDNLQILRHQALECSQRQRHRGPDWSGVYVDVGAILVHERLAIVDPAGGAQPLFSEDGTLALAVNGEIYNHAVLKGTLQQPYAFQTHSDCEVINALYREETPTSFLNRLNGIFAFALWDKTTGRGLIARDPMGVVPLYWGHDQDGRLRVASEMKALVEHCPDVAQFPPGHWYDTTTGTLVKYYERPWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHGFEYTFQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSNGPQRMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 220 - protein, 451 aa, Pichia angusta
MGTKSMTDVTAEELSKDSVAMMLAKDRELKNKYLKQKHISEQPWTWENWHRHINWLNFILVLAVPFAGLISTKWVPLKLHTFVTAVILYCFGGISITAGYHRHWAHRAYDCKLPVKIFFALFGASAVEGSIKMWGHQHRVHHRYTDTPRDPYDAKRGFWYSHMGWMLLVPNPRYKARADISDLLDDWVVRVQHRHYLLLMVVMAFLFPAVLTHYLFNDFWGGFIYAGLLRAVVIQQATFCVNSLAHWIGEQPFDDRRTPRDHVLTALVTFGEGYHNFHHEFPSDYRNALKWYQYDPTKVVIYLLSKVGLAYNLKKFSQNAIDQGILQQQQKKLDRMRAKLNWGPQLSELPVWDKSTFFEKAKEQKGLVIISGIVHDCANFLTEHPGGQALLKTSFGKDATMAFNGGVYAHSNAAHNLLATMRVAVIRDGGANGDTFDAQLRYLASKENKKE

SEQ ID NO: 221 - protein, 175 aa, Kluyveromyces thermotolerans
HRLWSHRAYSARWPLRLFFAIFGAASVEGSIKWWGHSHRIHHRYTDTVRDPYDARRGLWYSHMGWMLLQPNPKYRARADIADLTDDWIVRFQHRHYIPIMAFSAFILPALLCKYLFNDFIGGLVYGGVLRVFAIQQTTFCIDSLAHYLGDQPFDDRRTPRDNWITALVTFGEGYH

SEQ ID NO: 222 - protein, 636 aa, Oryza sativa
MDGCDCIEPLWPTDELLIKYQYISDFFIALAYFSIPLELIYFVKKSSFFPYRWVLIQFGAFIVLCGATHLINLWTFTTHTKTVAMVMTVAKVSTAVVSCATALMLVHIIPDLLSVKTRELFLKNKAEQLDREMGLIRTQEETGRHVRMLTHEIRSTLDRHTILKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVKFTKEGHITLVASVVKADSLREFRTPDFHPTASDDNFYLKVQIKDTGCGISPQDLPQVFTKFPQSQPGGNRGYSGSGLGLAICKRFVTLMGGHIWLDSEGTGRGCTVTFVIQLGICDNTNAYQQKLIPLVWPSSGDADFVGPVPNAPNEEKGQASLKSRYQRSI

SEQ ID NO: 223 - protein, 586 aa, Vicia faba
MCGILAVLGCSDDSQAKRVRILELSRRLKHRGPDWSGLHQHGDNYLAHQRLAIVDPASGDQPLFNEDKSIIVTVNGEIYNHEELRKQLPNHTFRTQCDCDVIAHLYEEYGENFVDLLDGIFSFVLLDTRDNSFIVARDAIGVTSLYIGWGLDGSVWIASELKGLNDECEHFEVFPPGHLYSSKEREFRRWYNPPWFNEAIIPSTPYDPLVLRTAFEKAVIKRLMTDVPFGVLLSGGLDSSLVASVTARYLADTKAAKQWGAKLHSFCVGLKGAPDLKAGKEVADFLGTVHHEFQFTIQDGIDAIEDVIYHTETYDVTTIRAATPMFLMSRKIKSSGVKMLISGEGSDEIFGGYLYFHKAPNKEEFHQETCRKIKALHRYDCLRANKSTYAWGLEARVPFLDKDFIKAAMDIDPEFKMIKHDEGRIEKWILRKAFDDEENPYLPKHILYRQKEQFSDGVGYGWIDGIKDHAAKHVTDKMMFNASHIFPFNTPNTKEAYYYRMIFERFFPQNSARLTVPGGPSVACSTEKAIEWDASWSGNLDPSGRAALGVHVSAYENQINPITKGVEPEKIIPKIGVSPLGVAIQT

SEQ ID NO: 224 - protein, 495 aa, Zea mays
TASAVLCAPQTRLVGSSIQLPPEPGGRSATYLTERGSSRTGHSIFRSEGGVRRRGMSTTKVKRRVGKYELGRTIGEGTFAKVRFARDTVTGEAVAIKILDKEKVLKHKMVEQIKREISTMKLIKHPNVVRIYEVMGSKTKIYIVLEFATGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEQYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSKTLKDVVWKSDDLQTQHAS

SEQ ID NO: 225 - protein, 580 aa, Unknown
  Frankia sp. EAN1pec
MLCPREHSRCRRLIPTQGDDPVARGVGAEGGGILWIGKDAIRRVEAVGEGWAVRPVCVADAVNGARCHPGGLTWRPEGRQWAAHRDGRDEAMTATDTVKATETRHQGAAVVGGDQSVADAGGVTSPAPTESHTTTPSMFRARGEQLVLVATILFPFAALVAAVPLLWDHWITWRDVILAAVMYAITGHGVTVGFHRYFTHRGFKTSKPVRAALAIAGNMAIEGPVIRWVADHRRHHAFSDADGDPHSPWRYGTGPAALARGLWHAHVGWLFDVEQTDQRRYAPDLLDDPMIVRVSRSFALCAFVSLALPAVIGGLWGGSFEAALQAFFWASLVRVALLHHVTWSVNSICHVMGSRALPLPRPLGQRVAAGPAFHGRVLAQPAPRRADLGPARRPPLADRHQLLRDQDSGDPRAGPGRPLARPRPPGRQARLTGVVHSQRRWSRLSTSASVSPPRHPPRAPGRVPERPCGGLFDLGGQGKPLVLGLVLLAGEGAELGVEGEDALVVGGGLGQRLVQLGLATSQFLEGPFQPGQLLAGRTQFARAQGRTRVRSRRLPGARGRARPSRTPRAAARATGAGRAA

SEQ ID NO: 226 - protein, 749 aa, Thermobifida fusca
MTARPAVRQPAGLPCPQPCNRYGYPMTNALLAEIDALVAGTHHNPHALLGAHPGPEGVWVRALRPLARSVHVLLANGSRVELPHLHKGVFAGVVPGAEVPDYRLVVRYDDGTELTVDDPYRHLPTLGELDIHLIQEGRHEELWRVLGAHTKRFPSVLGDTEGTAFTVWAPNARGVRVIGDFNHWDGTGHPMRSLGSCGVWELFIPGVGDGTRYKYQVLGADGVWREKADPVAFATQAPPETASVVFTSRYTWQDDEWLTQRAAADLHRKPMSIYEVHLGSWRPGLSYRELADQLVDYVRELGFTHVEFLPVAEHPFGGSWGYQVTSYYAPTARFGSPDDFRYLVDRLHQAGIGVFLDWVPAHFPKDDWALSRFDGTALYEHPDPRRGIHPDWDTLIFNYGRTEVRNFLVANALFWLEEFHIDGLRVDAVASMLYLDYSRESGQWEPNAYGGRENLDAIDFLRELNATAYRRNPGIAMIAEESTAWPGVTRSTDTGGLGFGFKWNMGWMHDTLSYLQHDPVHRQYHHNEVTFSMVYAYSENYVLPLSHDEVVHGKRSLLYKMPGNEWQRCANLRALLAYMWAHPGKQLLFMGNEIAQGDEWSHDAGVQWWLLRYPHHAGMRRLVADLNRLYRNTRALWSQDTVPEGFTWLDGGDASGNTLSFLRWGDDGSVLACLVNFSGRPHPERRVGLPYAGRWREILNTDAVLYGGSGVSQPGIIEASEETPWQGQPASALVTYPPLGVSWLVFDGT

SEQ ID NO: 227 - protein, 464 aa, Vibrio fischeri
MPLHSKNAVRDDLLDDIYSSADLSLSMPKYKMPEQEHDPRHAYQVIHDELMMDGNSRQNLATFCQTWVEDEVHKLMDECIDKNMIDKDEYPQTAELESRCVHMLADLWNSPDAENTLGCSTTGSSEAAMLGGMALKWAWREKMKKLGKPTDKPNMICGPVQVCWHKFARYWDIELREIPMEGDRLIMTPEEVIKRCDENTIGVVPTLGVTFTCQYEPVKAVHEALDKLQEETGLDIPMHIDAASGGFLAPFCDPDLEWDFRLPRVKSINASGHKFGLSPLGVGWVIWRDASALHEDLIFNVNYLGGNMPTFALNFSRPGGQIVAQYYNFLRLGKEGYRKIHQACYDTAVYLSSEIEKLGMFEIIYDGKGGIPAMSWSLKEGVDPGFNLFDLSDRIRSRGWQIAAYAMPPKREDLVIMRILVRHGFSRDQADLLVADLKHCVEFFAKHPISHGSDELESSGFNHG

SEQ ID NO: 228 - protein, 375 aa, Glycine max
EISWSLTNRRYTEKCVSYAESHDQAIVGDKTVAFLLMDEEMYSGMSSLVDASPIVERGIALQKMIHFITMALGGEGYLNFMGNEFGHPEWIDFPREGNGWSYEKCRRQWNLVDTDHLRYKFMNAFDRAMNLLDDKFSFLASTKQIVSSADDDDKVIVFERGDLIFVFNFHPENTYEGYKVGCDLPGKYRVALDSDAWEFGGRGRVGHDVDHFTSPEGIPGVPETNFNNRPNSFKVLSPARTCVAYYRVEESQEDDDNNSLVGVEETSAAADVAKIPDESASTESEDIKLDGVKETLAAADVAKIPDESAPLESEDSNLDVVKEPLAAANAEVTKISGELVSVETEGINLDKLEETIVAASVESEVVRDKPEDAAN

SEQ ID NO: 229 - protein, 526 aa, Bradyrhizobium japonicum
MSRPGRRNSASDLPQSSLLKPPATGHCAAAPASSRGQHHMSDKVSRRQFAALAGLSAAAIANPLDGADAKPAAAASRDSGFPEGFLWGTATSSYQVEGAVNEGGRGASIWDRFVRIPGKIEDGSTGDRANEHYHRYKEDIALIKELGCKAYRFSIAWPRVFPDGDGKPNPGGLDFYNRLVDELLKNGIEPWMTLYHWDLPQSLQDRFGGWRSTETCKIFGDYAAYVAERLTDRVKNVFTLNESGRFVQFGYGLGIDAPGVTLPQGEVNQVRHNSALAHGLAVQAVRAHGRRGTRVGPAENIDVCVPAIDTPEHVRAAEIALREMNAGYLNVIMTGSYTEAFLKYAGANAPKYTDAELKIISSPVDFLGLNIYAPQNYVVPSDQGAGFMPLPIPKSFPHMNSDWLRVAPETIYWVPKLAAKIWKTDAIYISENGTSGDDVVTPDGKIYDTDRIMYLRNYLAQLQRATAEGVPVRGYFLWSLMDNFEWVFGLSKRFGLYHVNFDTQVRTPKLSASYYRNVIARNAAGV

SEQ ID NO: 230 - protein, 586 aa, Securigera parviflora
MCGILAVLGCSDDSQAKRVRVLELSRRLKHRGPDWSGLHQHGDCFLAHQRLAIVDPASGDQPLFNEDQSIIVTVNGEIYNHEELRKQMPNHKFRTGSDCDVIAHLYEEHGENFVDMLDGIFSFVLLDTRDNSFIVARDAIGVTSLYIGWGLDGSVWIASELKGLNDDCEHFETFPPGHLYSSKEREFRRWYNPPWFSESIPSAPYDPLALRQAFEKAVVKRLMTDVPFGVLLSGGLDSSLVASITARHLADTKAAKQWGAKLHSFCVGLEGSPDLKAGKEVADYLGTVHHEFQYTVQDGIDALEDVIYHIETYDVTTIRASTPMFLMSRKIKSLGVKWVISGEGSDEIFGGYLYFHKAPNKEELHKETCRKIKALHKYDCLRANKSTFAWGLEARVPFLDKEFINVAMNIDPENKMIKLDEGRIEKWILRKAFDDEENPYLPKHILYRQKEQFSDGVGYGWIDGLKDHAAKHVTDRMMLNASNIYPFNTPTTKEAYYYRMIFERFYPQNSARLSVPGGASVACSTEKALEWDAEWSKNLDPSGRAALGVHVSAYENQLSSSVSKGVEPEKIIPKMEISPLGVAIQS

SEQ ID NO: 231 - protein, 338 aa, Dechloromonas aromatica
MTQQRTLARYLTEEQRNKGVITGDLKLLIEVVSRACQAISIAIGKGGLGGVLGEAGSDNVQGEAQKKLDVLSNDILLDANEWGGHLAAMASEEMDLPHLVPHRFPKGEYLLTFDPLDGSSNIDVNVSIGTIFSVLKCPEGADLSTPEAAEQAFLQPGTAQVAAGYAVYGPTTLLVLTVGDGVAVFTLDREQGQFILTLENVQIPADTKEFAINMSNQRFWEAPVQRYVAEMQVGKEGPLGKDYNMRWVASMVADVHRIMTRGGIFMYPMDSKIKGQGGKLRLMYEANPMAMLIEQAGGAATTGRQRILDIQPEKLHQRVPVILGSKNEVERVTGYHSA

SEQ ID NO: 232 - protein, 868 aa, Ipomoea batatas
MVYTLSGLRLPAVAPVYKHLGSTSHADRRNTNPSLSLKRNSFSSWKIFARNTSYESEPSSFRVAASEKVLVPGGEGEGSSFPTDQLEVAEALSEDTQVSADVDNVKMEENSNSESNVDFVKVASDSKESVQEQDHTSSLQFEEDGNVEVSQKPETLDDISAESEMVKKRAIPPPGLGQRIYEIDPLLKNFRDHLDYRFSHYRKIREAINQYEGGLEVFSRGYEKLGFTRSVTGITYREWAPGATWATLIGDFNNWNPNADVMTRNEFGVWEIFLPNNADGSPAIPHGSRVKIRMDTPSGIKDSIPAWINFSVQAPGAIPYDGIYYDPPEEERYKFQHPRPKRPKSLRIYECHIGMSSPEPKINTYAEFRDDVLPRIKKLGYNALQIMAIQEHSYYASFGYHVTNFFAPSSRFGTPDDLKSLIDRAHELGLVVLMDIVHSHASNNTLDGLNMFDGTDSCYFHSGTRGYHWMWDSRLFNYGNWEVLRYLLSNARWWLDEYKFDGFRFDGVTSMMYTHHGLSVGFTGNYSEYFGYATDVDAVVYLMLVNDLIHGLFPEAITIGEDVSGMPTFCIPVRDGGVGFDYRLHMAIPDKWIEILKRRDEDWQMGEIVHTLTNRRWLEKCVSYAESHDQALVGDKTIAFWLMDKDMYDFMALDRPATPVIDRGIALHKMIRLITMGLGGEGYLNFMGNEFGHPEWIDFPRGEQRLPDGSVLPGNNFSYDKCRRRFDLGDADYLRYRGMQEFDQAMHHLEEKYGFMTAKHQYISRQDEGDRVIIFERGDLVFVFNFHWTNSYSDYRVGCLKPGKYKVALDSDSPLFGGFGRVQPDAEFFTFEGYHDDRPRSFMVYAPSRTAVVYALAKEEDEAKPVEE

SEQ ID NO: 233 - protein, 657 aa, Unknown
  Orpinomyces sp. PC-2
MKTLTVFSALLAVTAAKKCIVKSDAAVASEAEEVTAELTAPEDSGVESGEDDELLDLSTIDYGDDVDMSTVKKLPADFKWGAATAAYQVEGAWDEEGRGESVWDHFTHLYPKNVESGDRSKDFSTNGNIACDSYHKFDEDVKMLKLMNAKYYRFSISWPRLFPDGQARKVDGKWNVNEKGAEYYDMVINTLLKNDIVPFVTLYHWDLPYALHEKYGGWLDYHSQDDFAKYAEFCFERFGDRVKNWITINEPWVNCVSGYRLGPGKAPYRCTGEAPRKLQNSTDLDLEGGCSYEIGPTQYSKNSEPLPANRVPQKLEDVWCSHNILLGHAKAVKVYREKFQKKQKGLIGITVDGEAQIPWVEPGMTKKEYENNLKYANLAAEFRIGWYSDPPMVGDYPKSVKERMGKDLPEFTEEEKKILKGSSSDFLGWNTYTAHWAAQAKNEDGSYIQPPTAEEANFDNSKKDMWDDNCKGRGDGWTCIPPTLGSQAGSSWNTKFAPTIRVGLNWFSKRYEGLIKNGIVITENGCAQPNYKVARANDEVTKKYFESIGQPKYADTYKEEDIEREDNLEGTLMHDTYRIDWYDQYLKNLRLAYAVDNIDVRGYMAWSLLDNFEWENGYETRFGMTYIDFYNDKEMKRVPKDSLEHLGQWYLENVEQN

SEQ ID NO: 234 - protein, 119 aa, Aspergillus niger
MSEQPSDPYIPSGANGAGAGASAAQNGDPRTREIDKKIQETVDTMRSNIFKVSERGERLDSLQDKTDNLATSAQGFRRGANRVRKQMWWKDMKMRVCLIVCIIILLIVIIVPAVVATKH

SEQ ID NO: 235 - protein, 436 aa, Pseudomonas fluorescens
MLHLSRLTSLALTIALVIGAPQAFAAETAQAATAATTKAPLPLEELRTFAEVMDRIKAAYVEPVDDKTLLENAIKGMLSNLDPHSAYLGPEDFAELQESTSGEFGGLGIEVGAEDGFIKVVSPIDDTPASKAGIQAGDLIVKINGQPTRGQTMTEAVDKMRGKIGQKITLTLVRDGGTPFDVTLARATIQVKSVKSQLLESGYGYIRITQFQVKTGEEVSKALAKLRKDNGKKLNGIILDLRNNPGGVLQAAVEVVDHFITKGLIVYTKGRIANSELRFSATGKDESEAVPMVVLINGGSASASEIVAGALQDQKRAVLMGTTSFGKGSVQTVLPLNNDRALKITTALYFTPNGRSIQAQGIVPDIEVRRAKITSESQDGEYFKEADLQGHLGNGNGGADKPSGAASKAKPMPQDDDYQLAQALSLLKGLSITRGK

SEQ ID NO: 236 - protein, 687 aa, Unknown
  Burkholderia sp. 383
MRYPHLFKPMQLNQLTLRNRIVSTAHAEVYAEPGGLPGDRYIRYYEEKAKGGVGLAICGGSSPVSIDSPQGWWKSVNLSTDKIIDPLTRLADTMHKHGAKIMIQATHMGRRSSFHGEHWPHLMSPSGVREPVHRGNAKIIEIEEIRRIIGDFAAAAKRVKAAGMDGIEISAAHQHLIDQFWSKRSNHRTDEWGGSLENRLRFGIEVLTAVREAVGKDFCVGLRMCGDEFHEDGLDHEALKEIAQAMSETGLIDYLSVVGSGGDTHNTIANCMPPMALPPEPFVHLAAGIKSVVKIPVMHAQSIRDAGQAERLLATGMIDLVGMTRAQIADPHMVIKIRDGREDEIKQCVGANYCIDRQYNGLDVLCIQNAATSRESTMPHIIEKSRGPKRKVVVVGAGPAGLEAARVAKLRGHDVVLFEKNAEVGGQVMIAAKAPQREQMSGIIRWFDMETKRLGVDRRLGVAADEKMIMAEKPDIVVLATGGSSFTWQVPGWGVAEGLAVSSWDILTGKVEPKQNVLLFDGVSTHAGAGVADFMASRGSKVEVVTPDVKVADDCGGTTFPIFYRRLYAFGVIPTPNTMLDRVYEEDGKLIAVLRNEYTEELEERAVDQVVIENGSSPNDELYWKLKPESVNRGQIDPHTLFAAEPQPCLSEELGNGRFLLFRVGDCISMHNVHGAIYDSLRLVKDF

SEQ ID NO: 237 - protein, 215 aa, Yersinia pestis
MKYQIIPVTAFSQNCTLIWCEATGQAALVDPGGEATKIIAEVERQGVTISQVLLTHGHLDHVGAAAEVAAHFQVPIYGPEKEDTFWLEGLPAQSRMFGLSECEAFTPTRWLEEGDKITVGEIELSVLHCPGHTPGHIVFIDPQGRLALVGDVIFKGGVGRSDFPRGDHQQLINSIRTKLLPLGDDITFIPGHGPMSTLGHERQTNPFIREEPAIW

SEQ ID NO: 238 - protein, 493 aa, Oryza sativa
MDDRRTILMDRYEIGRQLGQGNFAKVYYARNLTSGQAVAIKMIDKEKVTRVGLMVQIKREISIMRLVKHPNILQLFEVMASKSKIYFVLEYAKGGELFKKISKGKFSEDVARRYFHQLISGIDYCHSRGVYHRDLKPENLLLDENESLKVSDFGLSALSESKRHDGLLHTTCGTPAYVAPEVLSRRGYDGAKADIWSCGVILFVLVSGYLPFHDTNLIEMYRKIAKAEYKCPRSFSAELKDLLYKILDPDPSTRISIPKIKRSAWYRKSSDVNALKSKHETGDKVYKGEATTSDTTECSIFEGNRASSRDKVYTNGEATTSDSPECSNSDGKQASLSLPNLNAFDIISLSTGFDLSNLFEERYGRREERFTTRQPAAAIFAKLNELARRFKLKIKKKENGVLRLVAPKEGIKGLLELDAEVFELAPSFHLVEFKKSNGDTIEYQKLMKEDIRPALKDIVWAWQGGQHQQPEQSMQGMQGEQQPSRLPSQQPQG

SEQ ID NO: 239 - protein, 279 aa, Triticum aestivum
  misc_feature (212)..(212): Xaa can be any naturally occurring amino acid
  misc_feature (223)..(223): Xaa can be any naturally occurring amino acid
  misc_feature (255)..(255): Xaa can be any naturally occurring amino acid
AYLGDSIEQVCTKKQAGTGPEFPGYRRPTRPLAGGQAVAIKMIDKEKVSRIGLIVQIKREISIMGLVRHPNVLKLFEVMASKSKIYFVLEYAKGGELFNKITKGKLSEDAARKYFHQLISAVDYCHSRGVYHRDLKPENLLLDENENLKVSDFGLSALAESTRQDGLLHTTCGTPAYVAPEVLSRRGYDGAKADIWSCGVILFVLVAGFFPXHDTNLIEMYRXKISRAEYRCPRPFSVELRDLLYKILDPDPSTXAPVSRIKRSAWYRKPLSCKWTGDL

SEQ ID NO: 240 - protein, 259 aa, Gluconobacter oxydans
MRARDVSMQLPHHQDTPRGTVMPLDIKPIPVLSDNYAWLLTATEGQRAVVDPGEAGPIMDEIGDGRLDMILLTHHHADHTAGTDALRERYGAKVYGPRQKREWLPRLDHDVEDGDSLSLGSAQIRVLSTPGHAVGHVSYVVPEVPALFCGDVLFSLGCGRLLEGTAQELFDSLHRYDSLPDQTLVCAGHEYTRSNLAFALHVDPDNAALKARAGEIEQLLEAGRPTLPVSLGVERRTNPFLLAPDVATFARLRREKDTF

SEQ ID NO: 241 - protein, 367 aa, Vibrio cholerae
MSRLFEPTDLKQLTLQNRVVMAPMTRARSSQPGNIPNPMMATYYQQRASAGLIISEATQISDDAQGYSFTPGVYTDEQTSGWKTVTQAVKQQGAAMFCQLWHVGRVSHPVFQKGQLPIAPSALKPVETQVWIADEQGNGQMVDCVEPRAMTQADIDRVVNDFAQAAKCAIEAGFDGVEIHGGNGYLIDQFLRTNSNHRTDSYGGSRENRMRFLLEVVDAVSQAIGASRVGVRLAPFITFKDMDCPDIVPTILEASKQLQARDIAYLHLSEADWDDAPTIPESFRIELRKHFTNAIIVAGRYTLERAEEVLQKGYADLVAFGRPFVANPDLVSRLKHQQPLAQLDGKTLFGGGEQGYTDYPKIPEQPI

SEQ ID NO: 242 - protein, 248 aa, Triticum aestivum
  misc_feature (184)..(184): Xaa can be any naturally occurring amino acid
  misc_feature (194)..(194): Xaa can be any naturally occurring amino acid
  misc_feature (207)..(207): Xaa can be any naturally occurring amino acid
  misc_feature (219)..(219): Xaa can be any naturally occurring amino acid
  misc_feature (230)..(230): Xaa can be any naturally occurring amino acid
  misc_feature (241)..(241): Xaa can be any naturally occurring amino acid
SIVPIEKFVQKSRLVPVRNSRDIVDPRVRIRRYEKQRVANDSTYWVLFELIWRDYFRFLSAKYGNSIFHLGGPRKVVSKWSQDQALFESWKDGRTGYPLIDANMKELLATGFMSNRGRQIVCSFLVRDMGIDWRMGAEWFETCLLDYDPASNYGNWTYGAGVGNDPREDRYFSIPKQAKTYDPXDGEYVAYWLXPELRSLAKERRNXFPGPSYIKQVVXPLKFDGGHSKXDQQFNRQTRPXNIYRRQK

SEQ ID NO: 243 - protein, 640 aa, Corynebacterium efficiens
MCGLLGILSANGNAADYVPALQRALPCLHHRGPDEAGTWQDGDLAFGFNRLAIIDIAHSHQPLRWGPEGEPERYAMTFNGEIYNYIELREELTALGYAFETEGDGEPIMVGFHHWGADVVNHLRGMFAIAIWDTVDRSLFLARDQFGIKPLFYATTGVGTVFSSEKKAILEMAEELNLDLSLDRRAIEHYVDLQYVPEPETLHTGIRRLESGCTATIIPGGELVEKRYFTPRFPVKSVPKGREQDLFDRIARVLEDSVEKHMRADVTVGSFLSGGIDSTAIATLAKRHNPNLLTFTTGFEREGYSEVDVAAESAAAIGVEHIVKIVSPEEYANAIPKIMWYLDDPVADPSLVPLYFVAAEARKHVKVVLSGEGADELFGGYTIYREPLSLAPFEKIPTPLRRGLGRLSRVLPEGMKGKSLLERGSMTMEERYYGNARSFNFEQMQRVIPWARREWDHREVTAPIYAQSRDMDPVARMQHLDLFTWMRGDILVKADKINMANSLELRVPFLDKEVFKVAETIPYDLKIANGTTKYALRKAMEQIVPPHVLHRKKLGFPVPMRHWLAGDELFGWAQDTINESQTDEIFNKKAVLEMLNEHRAGVSDHSRRLWTVLAFMVWHGIFVENRIDPQIEQRDYPVEL

SEQ ID NO: 244 - protein, 373 aa, Bradyrhizobium japonicum
MEGPSPFSVVFEKEPAMNSLFSPVRIGGLELSNRLVMAPMTRSRADAGGVPGGLAAEYYAQRAGVGLIVTEGTQPSDDGQGYMTTPGIYTPAHVAGWRKVTDAVHGKGGHIFIQLMHAGRMSHPDNTPHHRQGVAPSAIAPDTPIFTPKGMQDIPQPRSLATDDVRRTVADFRDAARHAIAAGADGVEIHGANGYLVQQFIAPSANTRTDAYGGSIENRARFAIEVATAIAGEIGADRTAIRLSPGITMWGIDEGAEGPDLYRHLVGELDKLSLAYLHIMHQGDERLLADLRRLWRGKLIVNRPGRPRDRIGSDVAAGLADLEAYGQMILANPDFIARLKSGALLNEADRTTFFGGTARGYTDYPALDAIAAV

SEQ ID NO: 245 - protein, 304 aa, Zea mays
LTSSFSSLSGSLPEERHYCHTTTPPMLNMMTDLSCGPSSKAAKGGQPAATTGSGGDRQGRGKIEIKRIENTTNRQVTFCKRRNGLLKKAYELSVLCDAEVALVVFSSRGRLYEYANNSVKSTIERYKKANSDTSNSGTVAEVNAQHYQQESSKLRQAIDSLQNANRTIVGDSIHTMGLRELKQMEGKLEKAINKIRARKNELLYAEVEYMQKREMDLQTDNMYLRSKIAENNETGQPPMNMIGLPSTSEYDHMAPFVDSRNFLQVNMQQQPQHYSHLSAATNDPPTRMMKLRIFGQQSMHASTQ

SEQ ID NO: 246 - protein, 161 aa, Oryza sativa
  misc_feature (64)..(64): Xaa can be any naturally occurring amino acid
MSLIRRSNVFDPFSLDLWDPFDGFPFGSGSRSSGTIFPSFPRGTSSETAAFAGARIDWKETPEXHVFKADVPGLKKEEVKVEVEDGNVLQISGERSKEQEEKTDKWHRVERSSGKFLRRFRLPENTKPEQIKASMENGVLTVTVPKEEPKKPDVKSIQVTG

SEQ ID NO: 247 - protein, 348 aa, Thermosynechococcus elongatus
MTDYAAHQQALDRDCLTLSRHVLQQLQSFDAAAQDLSALMNRIALAGKLIARRLSRAGLMEGVLGFTGAVNIQGEDVKKMDVYANEVFIAAFKQSGLVCRLASEEMAQPYYIPENCPIGRYTLLYDPLDGSSNVDINLNVGSIFAIRQQEGTDLDSTAADLLQDGHQQIAAGYILYGPSTMLVYSLGKGTHVFVLDPSLGEFILAIENLQIPASGAIYSVNEGNFWAWEEPIRNYVRHVHRQPGYSARYSGALVADIHRILMEGGVFLYPGTQKNPAGKLRLLYEAAPIAFLVEQAGGKASTGTQPLLDVVPDHLHMRTPLIVGSPENVALVESFIQQTPAQPTVTQV

SEQ ID NO: 248 - protein, 150 aa, Pennisetum glaucum
MSLVRRGNVFDPFSMDLWDPFDNMFRSIVPSSSSSDTAAFANARIDWKETPEVHVFKADLPGVKKEEVKVEVEDGNVLVISGQRSKEKEDKNDRWHRVERSSGQFVRRFRLPEDAKTDQVNAGLENGVLTVTVPKAEGKKPEVKAIEISG

SEQ ID NO: 249 - protein, 152 aa, Pennisetum glaucum
MSLVSRSSVFDPFSMDLWDPFDSMFRSIVQSAGSPDSDTAAFAAARIDWKETPEAHVFKADLPGVKKEEVKVEVEDGNVLVISGQRSKEKEDKNDRWHRVERSSGQFMRRFRLPGNAKVDQVKAGLENGVLTVTVPKAEEKKPEVKAIEISG

SEQ ID NO: 250 - protein, 421 aa, Glycine max
GSRGYHWMWDSRLFNYGSWEVLRYLLSNSRWWLDEYKFDGFRFDGVTSMMYTHHGLEVAFTGNYNEYFGFATDVDAVIYLMLTNDVIHGLFPEAVTIGEDVSGMPTFCLPTQDGGVGFDYRLHMAIADKWIEILKKNDEDWKMGDIVHTLTNRRWLEKCVAYAESHDQALVGDKTIAFWLMDKDMYDFMALDRPSTPIIDRGIALHKMIRLITMGLGGEGYLNFMGNEFGHPEWIDFPRGDQHLPTGVIVPGNNNSFDKCRRRFDLGDADYLRYRGMQEFDQAMQHLEEKFGFMTAEHQYISRKNEGDKIIVFERGNLIFVFNFHWNNSYSDYRVGCSTPGKYKIVLDSDDALFGGFSRLNHTAEYFTSEGWYDDRPRSFLIYAPSRTAVVYALADDVEPTLADEAEPALADEAEPEPVDP

SEQ ID NO: 251 - protein, 1315 aa, Botryotinia fuckeliana
MEDSTIAHTTAILQTLALSSIDLPLTNVYGNKGIRLPGADTAEKLALERELAALVSRVQRLEARAITVNNQTLPDTPNELGAPSAFADVLTGAPSRASKSTTSRQQLVNSLLAAREAPTGGERPPKFTKLSDEELEALREHVDHQSKQLDSQKSELAGVHAQLFEQKQRQEQALNVLEVERVAALERELKKHQQANEAFQKALREIGEIVTAVARGDLSKKVQIHSVEMDPEITTFKRVINTMMDQLQIFSSEVSRVAREVGTEGILGGQAKISGVDGTWKELTDNVNVMAQNLTDQVREIASVTTAVAHGDLTQKIERPAQGEILQLQQTINTMVDQLRTFAAEVTRVARDVGTEGILGGQAEIEGVQGMWNTLIVNVNAMANNLTTQVRDIAIVTTAVAKGDLTQKVQAECKGEIKQLKETINSMVDQLQQFAREVTKIAREVGTEGRLGGQATVHDVEGTWRDLTENVNGMAMNLTTQVREIAKVTTAVARGDLTKKIEVEVQGEIASLKDTINTMVDRLSTFAFEVSKVAREVGTDGTLGGQAQVDNVEGKWKDLTENVNTMARNLTTQVRGISTVTQAIANGDMSQKIEVAAAGEILILKETINNMVDRLSIFSNEVQRVAKDVGVDGKMGGQADVAGIGGRWKEITTDVNTMANNLTTQVRAFGDITNAATDGDFTKLITVEASGEMDELKRKINQMVYNLRDSIQRNTLAREAAEFANRTKSEFLANMSHEIRTPMNGIIGMTQLTLDTDLTQYQREMLNIVHNLANSLLTIIDDILDLSKIEANRMIMEEIPYTLRGTVFNALKTLAVKANEKFLDLTYRVDSSVPDHVVGDSFRLRQVILNLVGNAIKFTEHGEVSLTIQKAEQDHCAPNEYAVEFCVSDTGIGIQADKLNLIFDTFQQADGSMTRKFGGTGLGLSISKRLVNLMRGDVWVKSQYGKGSSFYFTCTVRLATSDISFIQKQLKPYQGHNVLFIDKGQTGHGKEIITMLTQLGLVPVVVDSEQHTILLGNGRTKEKIASTYDVIVVDSIESARKLRSIDEFKYIPIVLLAPVIHVSLKSALDLGITSYMTTPCLTIDLGNGMIPALENRAAPSLADNTKSFDILLAEDNIVNQRLAVKILEKYHHVVTVVGNGQEALDAIKEKRYDVILMDVQMPIMGGFEATAKIREYERSLGTQRTPIIALTAHAMLGDREKCIQAQMDEYLSKPLKQNHLIQTILKCATLGGALLEKGREVRQSANEESPNSQNGPRGTQHPASSPTPAHMRPAIEPRAYTTTGPINHGSAESPSLVTADAEDPLARLLMRAHSS

SEQ ID NO: 252 - protein, 159 aa, Pennisetum glaucum
MSLIRRSNVFDPFSLDLWDPFEGFPFGSGSNSGSLFPSFPRTSSETAAFAGARIDWKETPEAHVFKADVPALKKEEVKVEVEDGNVLQISGERNKEQEEKTDTWHRVERSSGKFMRRFRLPENAKTDQIRASMENGVLTVTVPKEEVKKPEVKSIQISG

SEQ ID NO: 253 - protein, 750 aa, Salmonella enterica
MSHNEKSPHQSPVHDTRESQPGLDSLAPSDGSHRPTPEPTPPGAQPTAPGSLKAPETANDKLTALDAFRKGSENYALTTNQGVRIADDQNSLRAGSRGPTLLEDFILREKITHFDHKRIPERIVHARGSAAHGYFQPYKDLSDITKAAFLCDPQKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAQGKATFVRFHWKPLAGKASLVWDESQKLTGRDPDFHRRDLWEAIEAGDFPEYELGLQLIAEEDEFKFDFDLLDPTKLIPEELVPVQRVGKMVLNRNPDNFFAENEQAAFHPGHIVPGIDFTNDPLLQGRLFSYTDTQISRLGGPNFHEIPINRPTCPYHNFQRDGMHRMDIDTNPANYEPNSINDNWPRETPPAPKRGGFESYQERVDGNKIRERSPSFGEYYSHPRLFWLSQTPIEQQHIIDAFSFELGKVARAYIRERVVDQLAHIDVTLAQGVAHNLGFALTHEQTQIAPPPDVNGLKKDPALSLYAVPDGDVKGRVVAILLNDKVNAAELLTILQALKAKGVHAKLLYSRMGEVTADDGSTLTIAATFAGAPSLTVDAVIVPCGNIADIESCGDARYYLLEAYKHLKPIALAGDTRRFKALLNIDSQGEEGLVEADNVDHHFMDTLLTLMAAHRVWSRAGKINAIPA

SEQ ID NO: 254 - protein, 333 aa, Debaryomyces hansenii
MAETITKTQPQSLKLRSGFELPQVGFGLWKIPKDKTAQVVHDAIKCGYRNFDGAYDYQNEEEAGEGIRKAISDGLVTRDEIFVTTKLWNNYHSKENVFKSAKWQNEAWGLGYIDLYLMHFPIALKYVDPKENQYPAWWADKEMTIVQPDRVPIRETWEAMESLVDLGIARSIGVSNFQAQAIYDILTYNSLPISALQVEHHPYLVQPELFQLCQEQNIAFIAYSSYGPQSFLELPGSFSELANDITPLFQNKTILSIASTHKKSPAQVLLRWATQRGVVVIPKASSQTHLEQNLQLDFDLSEDQINSISKLDIGLRFNDPGFYLKSHPLHIFA

SEQ ID NO: 255 - protein, 371 aa, Unknown
  Burkholderia sp. 383
MTQALFSPLRLGPFALAHRVVMAPLTRMRAAEPGNTPHALNVEYYRQRATYGGLIITEGSQISPTGQGMPATPGIHSPEQVEGWKAVTQAVHAKGGLVFMQLWHVGRISHSSLLNGEQPVAPSAIAAPGNAFTSTFERVPFEIPRALGTKEIASLVDDYAQAARNALEAGFDGVEIHGANGYLLEQFLQSRSNHRTDEYGGSIENRCRIVLEVAEAVSAVYGPDRVGIRLSPFGVANGSGEDAPLPLYSHLIERLARLDLAYLHLIEPRASGAGQADVDHQNVPFASELFRPHWPNVLIAAGNYTPATAGAVIGAGRADAVAFGRLFIANPDLPERVRLGASLNAYNRPTFYGGGAAGYTDYPALGETAGA

SEQ ID NO: 256 - protein, 277 aa, Triticum aestivum
  misc_feature (144)..(144): Xaa can be any naturally occurring amino acid
  misc_feature (159)..(159): Xaa can be any naturally occurring amino acid
  misc_feature (166)..(166): Xaa can be any naturally occurring amino acid
  misc_feature (184)..(184): Xaa can be any naturally occurring amino acid
  misc_feature (196)..(196): Xaa can be any naturally occurring amino acid
  misc_feature (205)..(205): Xaa can be any naturally occurring amino acid
  misc_feature (207)..(207): Xaa can be any naturally occurring amino acid
  misc_feature (229)..(229): Xaa can be any naturally occurring amino acid
MGREKSRRLSGSRDFRQRLVLATLTSTPIIIKDIRAGEGGLRPHEMSLLHLLDKVSDQHVIDVNDTGTKVGYKPGVVLGGKDLEHDCGVHRGIGYFIEPLILLGLFARSPLSIRLKGITNDTKDPSVDTFRMVTLHMLQHFGCXLLEGLELKIENRGAXPPRGGGXEVPSFEFPILNSTFKGQXLALMKGMVKRIXGVTFSTNVXPXIVTRIFYAARGLFNKFIPDVHXFPDHKAGGLYVSSLKNLNITSDCCYVTPQDRSFLIPSVKKKKRKKKKK

SEQ ID NO: 257 - protein, 492 aa, Avicennia marina
MDPYKYCPSSSFNTPHTTTNGGHPVYNDNSSLTVGTRGPVLLEDYQLIDKLAHFTRERIPERVVHARGATAKGFFEVTHDVSHLTCADFLRAPGVQTPLIVRFSTVIHERGSPETLRDPRGFAVKFYTREGNFDIVGNNFPVFFIRDAIKFPDVIHAFKPNPKSHIQESWRILDFCSHFPESLLTFAWFYDDVGIPQDYRHMEGFGVHSYTLINKAGKVNYVKFHWKPTCGVKCLMEDEAVRIGGTNHSHATQDLYDSIAAGNYPEWKLYFQIMDPDQEDRFDFDPLDTTKIWPEDIIPLIPVGRMVLNKNIDNFFAENEMLAFSPHMIVPGINFSNDKMLQTRIFAYGDTQRHRLGPNYLLLPVNAPKCAYHNNHYDGFMNFMHRDEEVDYFPSKYDPTRHAERHPIPNAVITGRRDRRVIEKEDNFKQAGDRYRSWAPDRQERFLRRWVDALSDPRLTLEIRSIWVSYWSQADKSFGQKLASRLNVRPTM

SEQ ID NO: 258 - protein, 333 aa, Triticum aestivum
  misc_feature (295)..(295): Xaa can be any naturally occurring amino acid
  misc_feature (303)..(303): Xaa can be any naturally occurring amino acid
LAWSRPIVDDYKQFAEVCFKNFGDRVKNWFTFNEPHTYCCFSYGEGIHAPGRCSPGMDCAVPKGDSLREPYTAGHHILLAHAEAVELFKACYNKHGDSKIGMAFDVMGYEPFQDSFLDDQARERSIDYNLGWFLEPVVRGDYPFSMRSLIGDRLPKFTKEEQEKLASSCDIMGLNYYTSRFSKHIDISSDFTPKLNTDDAYASSETKGSDGNDIGPITGTYWIYMYPKGLTDLLLIMKEKYGNPPIFITENGIADVDSDPTMTDPLDDWKRLDYLQRHISAVKDAIDQGADVRGXTWGLIDNXEWSLGYSSRSALTSTRRRNSASSESASVAS

SEQ ID NO: 259 - protein, 347 aa, Vibrio cholerae
MTDILFQPYALNDVITLNNRIAMAPLTRCMADDDLVPTDAMVAYYARRADAGLIISEATIIRPDAQGYPNTPGLFTQAQIAGWKKVTDAVHANGGKIFAQLWHTGRVAHPAFFAGEYVLAPSALGVEGSVPRRRELQYTVPKAASQAEIKQLVADYAQAAENARLAGFDGVEIHGANGYLIDQFLHFDSNQRSDEYGETPANMARFALEVVDAVIARIGAERTALRVSPGAYFNIKADPRDREVFDYLLPELEKRNLAYLHEGMFDDSVTFDFLGGRVSTYLRQHYSKTLMGVGGFSAETGATAIENNEFDLLAIGRPFIANPDYIARVQKGEELKAYQDSMLTELY

SEQ ID NO: 260 - protein, 220 aa, Oryza sativa
MASSAPTPPPLLPVTNPAAAGSSPAATAVGSDAPIATPAFRLFLSKLSDSARRSLSDRRPWTELVDRSAFSRPDSLSDATSRLRRNLAYFRVNYAAVVAFALGASLLAHPFSLLVLLGLLAAWCFLYLFRGSDQPIVLFGRTFSDRETLLGLVVASFVAFFFTSVASLIISGLLVGGAIVAVHGACRMPEDLFLDDADAASGNSAAQGLLSFLGAPGSRV

SEQ ID NO: 261 - protein, 383 aa, Bordetella bronchiseptica
MNQEAENTKLFAPLSLRGVVLPNRVLISPMSQYSAVDGVVQDWHRYHVAAMARGYPGSVMLEVAAVTRDGRGTPGDLGIWSDEQIAGLAELARIIEAHGVVPAIQIGHAGRKASMQRPWEGGRPLALDSSDEAWQTVGASALPIQDGWPAPRQLAQHELAGLVDSFRAAAARAVQAGYRFVEVHAAHGYLLHGFLSPISNQREDQYGGSLENRMRFPLEVVAAVRAALPDEVPLSVRISAVDGMEHGWQLADSIVFARELKALGVDLVDCSSGGIQGSATAGKGPQAVKRGPGFQVPFAHAVRQEAGIATIAVGLIVEPAQAEAILRQEQADLIAIGREALQNPNWPLHARQALGADRDYSAWPAQYGWWLQRRPKVAWEEGR

SEQ ID NO: 262 - protein, 403 aa, Unknown
  Malus x domestica
NTNGIIQMGLAENQLCFDLLESWLAKNPEAAAFKKNGESIFAELALFQDYHGLPAFKKAMVDFMAEIRGNKVTFDPNHLVLTAGATSANETFIFCLADPGEAVLIPTPYYPRFDRDLKWRTGVEIVPIHCTSSNGFQITETALEEAYQEAEKRNLRVKGVLVTNPSNPLGTTMTRNELYLLLSFVEDKGIHLISDEIYSGTAFSSPSFISVMEVLKDRNCDENSEVWQRVHVVYSLSKDLGLPGFRVGAIYSNDDMVVAAATKMSSFGLVSSQTQHLLSAMLSDKKLTKNYIAENHKRLKQRQKKLVSGLQKSGISCLNGNAGLFCWVDMRHLLRSNTFEAEMELWKKIVYEVHLNISPGSSCHCTEPGWFRVCFANLPERTLDLAMQRLKAFVGEYYNVPEV

SEQ ID NO: 263 - protein, 152 aa, Brassica napus
MGSIRESAPTANSSTTVVMSSIPPFLSKTYDMVDDPSTDEVVSWSSGSNSFVVWNVPEFSKQFLPKYFKHNNFSSFVRQLNTYGFRKVDPDRWEFANEGFLKGQKQLLKSIIRRKPTQVQPPQQPQVQHSSVGACVEVGKFGLEEEVERLQR

SEQ ID NO: 264 - protein, 249 aa, Dendrocalamus latiflorus
MGRGKVELKRIENKINRQVTFSKRRNGLLKKAYELSVLCDAEVALIIFSSRGKLYEFGSAGISKTLERYQHCCYNAQDNNALSETQIWYQEMSKLRAKFEALQRTQRHLLGEDLGPLSVKELQQLEKQLECALSQARQRKTQLMMEQVEELRKKERQLGEINRQLKHKLEAEGSSNYRAMHRASWAPGTVVDEGAAYHEQQPPHSAALDCEPPTLQIGYPHQFMPPEAANIPRSAPAGGENNFMLGWVL

SEQ ID NO: 265 - protein, 330 aa, Unknown
  Shewanella sp. MR-7
MQTLAQHLTSKAVNESLSQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPAGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGIDYSEEPTLD

SEQ ID NO: 266 - protein, 279 aa, Bacillus cereus
MKNLQSTTTLHNGVEMPWFGLGVFKVEDGPELVEAVKSAIKAGYRSIDTAAIYGNEKAVGEGIRAGIKEAGISREDLFITSKVWNSDQGYETTLAAYEESLKKLELDYLDLYLVHWPVEGKYKDTWRALETLYKEKRVRAIGVSNFQIHHLQDVLADAEMKPMINQVEYHPRLTQKELQAFCKEQGIQMEAWSPLMQGQLLDNETLQEIAHKYGKTTAQIILRWDLQNEVVTIPKSTKEHRIIANADVFNFELTKEDMEKIDALNQNHRVGPDPDNFDF

SEQ ID NO: 267 - protein, 425 aa, Xylella fastidiosa
MMSNSPQTPLATRQRLSEVRYEIRGELARRARELEAEGRKLIKLNIGNPGAFGFRAPEHLQRAIADDMGRTDPYTHQQGLPIAREAIAAAYVRRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQIDNLRNAMDLLGALRLCANVPGQYAIDAAVNGPDTITPLCSPGGPLYETRRAVIEACVVSEHLSLVVPAGALYAFPSVVGPAARHFDDYAFALELMNDEGVLVVPGSSFNVPYRDHFRVTLLPDAALIREVFSRIDRALSRRAEVAEKVVPLKSRSAAA

SEQ ID NO: 268 - protein, 175 aa, Triticum aestivum
IKILNRRKIKNMEMEEKVRREIKILRLFMHPHIIRLYEVIETPSDIYVVMEYVKSGELFDYIVEKGRLQEDEARNFFQQIISGVEYCHRNMVVHRDLKPENLLLDSHHNVKIADFGLSNIMRDGHFLKTSCGSPNYAAPEVISGKLYAGPEVDVWSCGVILYALLCGTLPFDDEN

SEQ ID NO: 269 - protein, 344 aa, Nitrobacter vulgaris
MSQELTLQQRMDGEAGSDPLRQAVKEAVAALARAAVDISDLTCRGALAGITGQAQGRNTDGDIQKDLDVRADQIIRDALGKLPIAALASEEMADLDILNPAAPICVAFDPLDGSSNINTNMSVGTIFSIMPTPSDVNAAFRQAGSAQLAAGFVVYGPQTSLVLTLGRGVDIFTLDRADRVFKLTGSSVQIPTDANEFAINASNRRHWDLPVRAYIDECLAGADGPCGKNFNMRWIGSLVAEAFRILIRGGIFLYPGDARDGYEEGRLVVYEAHPMAFIVEQAGGGASTGRKRVLDIVPDSLHQRVPLIMGSIKNVQRLEHMHTVPDVALEANAPLFGNRGLFRV

SEQ ID NO: 270 - protein, 215 aa, Triticum aestivum
MAVDAVRDAAAMVSEEEEEGQLRCDEGWGKRRRPRRQRQRAPSEEEHLALSLLMLARGHRDRHLLPSSSPAQEHRCSVCGKGFPSYQALGGHKASHRPKPAPAGADEPAATAAASPAASSSTTSSGAGGGGRVHECSVCKKTFPTGQALGGHKRCHYEGPIGASAVASRGFDLNLPALPDIVTERERCMPAPADDYEEEVLIPLVFKKPRLMIPA

SEQ ID NO: 271 - protein, 276 aa, Thermosynechococcus elongatus
MMTDSAKDLLAAAAVERRLGNRDAYVPYLRQVFADVVGEDDTVSETYGGLGAAQERLANIQPLRYGKRRNFLTGEVTGLSAYLRHGVISLAAVRDRVRQLVDDPSEAEALLQQLAWRDYWQRLYAHWGDRLWQDIEPYKTGWSAVDYATDLPAALVAAETGLACMDAFSSDLQRTGYLHNHARLWLAAYVVHWCRVRWQAGAAWFLQHLLDGDPASNNLSWQWVASTFSHKPYFFNRQNLERYSDGKYCRQCPMSDRCPFDATYEELAARLFPHKT

SEQ ID NO: 272 - protein, 136 aa, Arabidopsis thaliana
  misc_feature (31)..(31): Xaa can be any naturally occurring amino acid
  misc_feature (37)..(37): Xaa can be any naturally occurring amino acid
  misc_feature (57)..(57): Xaa can be any naturally occurring amino acid
  misc_feature (95)..(95): Xaa can be any naturally occurring amino acid
  misc_feature (110)..(110): Xaa can be any naturally occurring amino acid
MGLYLKPITLVKKEFGFPPFFFLVQNGGDGXLNYRLXHLAKLNRGMELLRRGDNNCXRDNFINTLTNKRWPEKGFFYAKRDNQAFVGDKPFAFGXWDKDMYNFMAAYRPXTRVIDKGITWHKLIRLITMGLGGDGH

SEQ ID NO: 273 - protein, 640 aa, Unknown
  Chrysanthemum x morifolium
MMDSCDCFETQWPADELLVKYQYISDFFIAFAYFSIPLELIYFVQKSAFFPYRWVLMQFGAFIVLCGATHFINLWTFSSHSKTVAIVMTVAKLSTAFVSCVTALMLVHIIPDLLSVKTRELFLKQRAEDLDREMGLIIKQEGTGRHVRMLTHEIRSTLDRHTILKTTLIELGRTLDLEECVLWMPSTKGMILEVSHSLHNLIPFRSTVPINLPIITEVFNRAEAIRIPHNCPLARIRTPVGSYIPPEVVAVRVPLLHLSNFEIDNWPDNSAKSYAVMVLILPMNGVRKWRDHEMELVTVVADQVAVALSHAAILEESMRARDQLMEQNFALNLARQEAEMAIHARNDFLAVMNHEMRTPMHAIIALSSLLLETELTPDQRAMIETILKSSNLLAALVNDVLDLSRLEDGSLELESDVFNLHGLFKEVVALINPIASVKNTSMALNCDLDLPAFGIGDEKRLMQIILNVVGNAVKFTKGGHVSIQASILSPEYLQEWRTPEFCPTLTEGLFYLLVQVKDSGSGIKQQDIPHIFTKFSEPRSASNRSGGAGLGLAICKRFVNLMGGHIWIESGGLGKGTTVAFLVKLGLCNYPNDPTMQQLVPRTVPKARPHQGSGELIQHRQLDREGYQGAASFPLYNRSM

SEQ ID NO: 274 - protein, 304 aa, Kineococcus radiotolerans
MPTAGPYAPRLGMRAVTRRTSVSAMTVPTILLNDGREIPQLGFGVFQIEPGDTAQAVKTALDLGYRHIDTAQMYGNEAEVAQGIADSGVPRDEIWVTSKLNNGFHEPDAARKAVDDSVEKLRGPIDLYLIHWPLPTLYGGDFVSTWKVLEEARAAGKLRSIGVSNFQVNHLQRLAQEATVVPAVNQIEVHPYFGNEEVRRHCGEHQIGVEAWSPIAQGKVLDDPTVTAVANRLGKSPAQVVLRWHVERGDIVFPKSVTPSRMEENFALFDFELTEEDLALISALDKGEAGRTGPNPDTFDYVPS

SEQ ID NO: 275 - protein, 544 aa, Unknown
  Candidatus Blochmannia sansabeanus
  misc_feature (245)..(245): Xaa can be any naturally occurring amino acid
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVVKAGXPLLIIAEDVEGEALATLVVNNMRGIVKVTAVKAPGFGDRRKAMLQDIAILTAGTVISEEIGLDLEKSTLEDMGQAKRVVITKDVTTIIDGVGNKSSINSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAREEPSVIANNVRSGEGNTGYNAATEKYGNMIELGILDPTKVTRSALQYAASIAGLMITTECMVTELPKEDKPDLGNAGAGGMGGMM

SEQ ID NO: 276 - protein, 846 aa, Arabidopsis thaliana
MASSSLSNLMLAIHEKKTSSVDLYRPLRNYVTFTYSEREAQLIDDDLETLKQLRSDIERVSDPSPAARRELLISYYKVLCLVETRFPISPDKDHVNAVSFVWYDAFKQKHKATQQNIHLEKAAVLFNLGASYSQIGLGHDRTTVDGRRQASHAFMAAAGAFAHLRDNESIKATIGPSTTVDVSVECVGMLERLMVAQAQECVFENTIAKGSTPGVSAKIARQVGIFYEEALSALIISPLKDHFDKGWISHVQLKAALFYGEACFRYGKELHEKEEIAEEIARLRSGASRLAEAKKSSRGAPAQLIEAMNTLESSIDGNLDRAVKENDRVYLMRVPSPSSLSPLPAFSMVKPMNMTDILDASKEKMFSILVPDSSAKALSRYTEMVDDVIRTQAERLQQASELTRVRLKEMDLPDSILAVDGNSALPVDLKEDVEAVQISGGPAGLEAELQQLRDLKRVNQELLVHTEELLQKEATEDSQFRSQFGTRWTRPQSSTLTKNLQDRLNRFAANLKQAGESDVKIERSVRDNSALMSILDRRPIESAVPTLARPIMSLDATEDAIVGTLKQSLRQLENLGAQRAGLEDMLKEMKRKDDILPKLMTITGSYEDMFRKEISKYDHICEDISQNIEVQEQLLMQIQAQNEEFSTIFNLEDYKASKEKCYKQIQAAIMKYREIKENINEGLKFYVTLQDAITNVQQQCSDFVMTRSIQCRDMIEDVQRQMSGLSFQDHRSSGPYPSVHQPTASSPPPPPETQNPSHPHPHAPYYRPPEQMSRPGYSIPPYGPPPPYHTPHGQAPQPYPPQAQQQPHPSWQQGSYYDPQGQQPRPPYPGQSPYQPPHQGGGYYRQ

SEQ ID NO: 277 - protein, 377 aa, Pereskia aculeata
  misc_feature (7)..(7): Xaa can be any naturally occurring amino acid
  misc_feature (118)..(118): Xaa can be any naturally occurring amino acid
  misc_feature (120)..(124): Xaa can be any naturally occurring amino acid
  misc_feature (151)..(151): Xaa can be any naturally occurring amino acid
  misc_feature (174)..(174): Xaa can be any naturally occurring amino acid
  misc_feature (204)..(204): Xaa can be any naturally occurring amino acid
TDVPAAXAGAFKSYKLAAKAISRLQSLPSHNLPLLCDVFVKEVSELTGYDRVMVYKFHEDEHGEVISEYRRPDLEPYLGLHYPATDIPQASRFLFLKNRVRMICDCSATPVEVIQDKXLXXXXXSWGSILRAPHGSHAHYMANMGSIAFSXMAVTINEDEDEVKSDPSTGKRLXGLVVCHHTSSRLIPFPLRYACELLVQVFGXQINKEVELAAQIRESHILRIQTVLCDMLLRDSPVAIVTQSPNVMDLVKCDGAALYYKGQVWLLGISPTEDQIKNITQWLLEYHGSTKGLSTDSLMEAGYPGASELGDAVCGMAAVRIRSKDVLFWFRSHTAKEIKWGGAKHDPVDNDDGRKMHPRSSFKAFLEVVKWRSQPWE

SEQ ID NO: 278 - protein, 504 aa, Triticum aestivum
  misc_feature (444)..(444): Xaa can be any naturally occurring amino acid
LTSRSACVRVHGVQFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGXERYRSWAPDRQDRFVRRFADALAHPKVSHELRVIWIDFLSKCDKSCGMKVANRLNVKPSM

SEQ ID NO: 279 - protein, 518 aa, Unknown
  Candidatus Blochmannia vafer
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPMLESVAKAGKPLLIIAEDVEGEALATLVVNNMRGIVKVTAVKAPGFGDRRKAMLQDIAILTAGTVISEEIGLELEKATLGDMGQAKRVVITKDATTIIDGIGNKSAIDSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAATEKYGNMIELGILDPTKVTRSALQYAASIGGLMITTE

SEQ ID NO: 280 - protein, 518 aa, Unknown
  Candidatus Blochmannia laevigatus
  misc_feature (510)..(510): Xaa can be any naturally occurring amino acid
  misc_feature (516)..(518): Xaa can be any naturally occurring amino acid
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKAGKPLLIIAEDVEGEALATLVVNNMRGIVKVTAVKAPGFGDRRKAMLQDIAVLTAGTVISEEIGLELEKATLEDMGQAKRVVITKDATTIIDGVGNKSAINSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAATEKYGNMIELGILDPTKVTRSALQYAASXAGLMIXXX

SEQ ID NO: 281 - protein, 377 aa, Calymmanthium substerile
TDVPAAAAGAFKSYKLAAKAISRLQSLPSHNMALLCDVLVKEVSELTGYDRVMVYKFHEDEHGEVISEYRRPDMEPYLGLHYPATDIPQASRFLLLKNRVRMVCDCLATPVKVIQGKKWAQPLSLGGSILRAPHGCHALYMANMGSIASLVMAVTINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGITPTEEQIKNITQWLLKYHGSTKGLSTDSLMEAGYPGASELGDAVCGMAAVRISSKDVLFWFRSHTAKEMKWGGAKHDPVDSDDGRKMRPRSSFKAFLEVVKWRSQPWE

SEQ ID NO: 282 - protein, 377 aa, Talinum paniculatum
TDVPAAAAGAFKSYKLAAKAISRLQSLPSRNMLILCDVLVKEVSELTGYDRVMVYKFHEDEHGEVISEYRKPDLEPYLGLHYPATDIPQASRFLFLKNRVRMICDCLASTVKVIQDQKLTQPLSLGGSILRAPHGCHAQYMANMGSIASLVMAVMINEDEDEVKSDPSSGKRLWGLVVCHHTGSRFIPFPLRYACELLVQVFGIQINKEVELAAQIRESHILRIQTVLCDMLMRDSPIAIVTQSPNVMDLVKCDGAALYYKGQVWLLGITPTEEQIKDITQWLLEYHGSTKGLSTDSLMEAGYPGASELGDAVCGMAAVRISSKDFLFWFRSHTAKEIKWGGAKHDPIDNDDRRKMHPRSSFKAFLEVVKWRSQPWE

SEQ ID NO: 283 - protein, 336 aa, Pseudomonas fluorescens
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTQQVAAGYAIYGPQTMLVLTLGDGVKGFTLDREMGSFVLTHEDIKIPESTQEFAINMSNERHWEAPVKRYVEELLAGDTGPLKKNYNMRWVAAMVADVHRILTRGGLFMYPRDSREPEKPGKLRLMYEANPMSFLVEQAGGASTDGHKRILDIQPEGLHQRVAVFLGSKEEVARVTGYHKE

SEQ ID NO: 284 - protein, 249 aa, Dendrocalamus latiflorus
MGRGNVELKRIENKINRQVTFSKRRNGLLKKAYELSVLCDAEVALIIFSSRGKLYEFGSAGISKTLERYQHCCYNAQDNNALSETQIWYQEMPKLRAKFEALQRTQRHLLGEDLGPLSVKELQQLEKQLECALSQARQRKTQLMMEQVEELRKKERQLGEINRQLKHKLEAEGSSNYRAMHQASWAPGTVVDEGAAYHVQQPPHSAALDCEPPTLQIGYPHQFMPPEAANIPGSAPAGGENNFMLGWVL

SEQ ID NO: 285 - protein, 602 aa, Oryza sativa
MCGILAVLGAADWSQAKRAHVLSCSRRLKHRGPDWSGLYQCEGNFLAQQRLAIVSPLSGDQPLYNADRTIVVVANGEIYNHKKIRKQFASKHTFSTGSDCEVIIPLYEEYGEDFVDMLDGVFAFVLYDTRTKTYMAARDAIGVNPLYIGRGSDGAVWISSEMKALNEDCVEFEIFPPGHLYSSAAGGLRRWYKPQWFAENVPATPYQPLLLREAFEKAVIKRLMTDVPFGVLLSGGLDSSLVAAVTKRHLIKTEAAEKFGAELHSFVVGLEGSPDLIAAREVADHLGTIHHEFHFTVQDGIDAIEEVIYHDETYDVTTIRASTPMFLMARKIKALGVKMVLSGEGSDELLGGYLYFHFAPNKEEFHKETCRKVKALHQYDCLRANKATSAWGLEVRVPFLDKEFINVAMSMDPEWKMYNADLGRIEKWVMRKAFDDEEHPYLPKHILYRQKEQFSDGVGYNWIDGLKAFTEQQVSDEMMKNAAKVYPHNTPVNKEAYYYRMIFERLFPQESARETVPWGPSIACSTPAAIEWVEQWKASHDPSGRLIASHNSASANHTNHANANANGNSNGKANGNCAMAANGTNGVGLVVANGTANGKMEA

SEQ ID NO: 286 - protein, 512 aa, Corynebacterium diphtheriae
MTSPVDPILNKGERTEAAPHTTRAGGQPVASENISITAGPQGANVLNDLHLIEKLAHFNRERVPERNPHAKGHGAFGELHITEDVSQYTKAKLFQKGTVTPMAVRFSTVAGEKGSPDTWRDVHGFALRFYTQDGNYDIVGNNTPTFFLRDAMKFPDFIHSQKRLGSSGLRDADMQWDFWTRTPESAHQVTYLMGDRGTPKTSRHQDGFGSHTYQWINEDGQPVWVKYHFKTRQGWETFTDAEAQEMAGKNADYQREDLYNAIERGDFPIWDVKVQIMPFDEAETYRWNPFDLTKTWSQKDYPLIDVGYFVLNRNPQNFFAQIEQLALDPANLVPGVGLSPDRMLMARAFAYADAQRYRIGPNYQQLPINQPVVPVNTYQHEGPMAYHFNPADAPVHTPNRFGKGAGYLDDGQTSSSGATYGQAQDLYVNPDPHGTDLTRAAYVKHADDDDFMQAGILYREVYDDAAKERFVDNVTNAMAGVSPETEERVYWYWTQVDENLGAKIREAFAAKK

SEQ ID NO: 287 - protein, 945 aa, Pseudomonas fluorescens
MRLKSYLHQINPLFSSPEAARRLLRVVALIFLVGLFGAVYNFLRSSLHNELSQRQSYMSSAIAEAQAFFTSRSALLESLSLAAVYDPGEHISPPGASGASQEETYLQLGGPQGNQWGIWLTLRMRNYLQNKQLNLLYIPGTRDLQVQRLFSTRPQTSDLPGGLLDKLIALKPEQIPVGEELWLMDNSAAGAHLYIFTRLDERFAHSGWLGLEMDGKSVSAALSDQSAGDFMMFNSQGGLIFSSAPSARLSADVRHVQGGSFFGFLGGRWWPDHLVIRKQLGATDWQLVYSFDLQNLLKSLWPQLLAALLISLTGMALIGLLTHWVEVRLIAPALHRIQALVESEAFSRDVIQIAPVALCVLRRSDGRVVLENTLSQQWLGNGSERDQLCSGWIEQAFDPARPNSSDYFETADGRHLYLSSAPTRYNGEDVLFCAFSDISARKQIEAALEEAKRLADTANEAKTLFLATMSHEIRTPLYGVLGTLELLSRTQLDNQQKDYLQAIEGSSGTLLQLICDVLDVSKIEAGQLALELSEFSSLDLVHEIIQGYAAAAQAKGLQFYACVDPQLPEILLGDVTRIRQILSNLLNNAVKFTDTGRIVLRVRTESRDGERSNILWQVSDTGRGIAQDDQTLIFEPFYQTEGNTNVIAGTGLGLPICQRLTQLMNGNIRMVSELGLGSSFTLTLPLEASAVQGDTPLISPLLPEMVYVVSPVRELAESVAGWLRRWGARAQFSLPSPSDRARGNVLIELHPGSVEQRLEPDWQGPLVLASGDGHNEPRIDGGSWQINTNNLRAIHQAVSQAQGVWVAQSEDHSDHRELKKLSLHVLVAEDNVINQLILKDQLEELGCSVELASNGEEALCIWKAGRFNVVLTDVNMPKLNGYELAQELRRQGCSIPIIGATANAMRGEEELCLAAGMNHCLVKPFALRALFNYLAPYERAPHEVL

SEQ ID NO: 288 - protein, 246 aa, Dendrocalamus latiflorus
MGRGKVELKRIENKINRQVTFAKRRNGLLKKAYELSVLCDAEVALIIFSNRGKLYEFCSGQSMTKTLERYQKCSYSGPDTAIQNKENELVQSSRNEYLKLKARVDNLQRTQRNLLGEDLGSRGIKELDQLEKQLDSSLRHIRSTRTQHMVDQLTDLQRREQMLCEANKCLRRKLEESQVHGQVWEHGANLLAGYDQRQSPQQAPPHAGNGFFHPLDAAAEPTLQIGFTPEQINNSCVTGFMPTWLP

SEQ ID NO: 289 - protein, 246 aa, Dendrocalamus latiflorus
MGRGKVELKRIENKINRQVTFAKRRNGLLKKAYELSVLCDAEVTLIIFSNRGKLYEFCSGQSMTKTLERYQKCSYSGPDTAIQNKENELVQSSRNEYLKLKARVDNLQRTQRNLLGEDLGSLGIKELDQLEKQLDSSLRHIRSTRTQHMVDQLTDLQRREQMLCEANKCLRRKLEESQVHGQVWEHGANLLAGYDQRQSPQQAPPHAGNGFFHPLDAAAEPTLQIGFTPEQINNSCVTGFMPTWLP

SEQ ID NO: 290 - protein, 246 aa, Dendrocalamus latiflorus
MGRGKVELKRIENKINRQVTFAKRRNGLLKKAYELSVLCDAEVALIIFSNRGKLYEFCSGQSMTKTLERYQKCSYSGPDTAIQNKENELVQSSRNEYLKLKARVDNLQRTQRNLLGEDLGSLGIKELDQLEKQLDSSLRHIRSTRTQHMVDQLTDLQRREQMLCEANKCLRRKLEESQVHGQVWEHGANLLAGYDQRQSPQQAPPHAGNGFFHPLDAAAEPTLQIGFTPEQINNSCVTGFMPTWLP

SEQ ID NO: 291 - protein, 246 aa, Dendrocalamus latiflorus
MGRGKVELKRIENKINRQVTFAKRRNGLLKKAYELSVLCDAEVALIIFSNRGKLYEFCSGQSMTKTLERYQKCSYSGPDTAIQNKENELVQSSRNEYLKLKARVDNLQRTQRNLLGEDLGSLGIKELDQLEKALDSSLRHIRSTRTQHMVDQLTDLQRREQMLCEANKCLRRKLEESQVHGQVWEHGANLLAGYDQRQSPQQAPPHAGNGFFHPLDAAAEPTLQIGFTPEQINNSCVTGFMPTWLP

SEQ ID NO: 292 - protein, 155 aa, Cryptococcus neoformans
MSEHTNLKSLAPLGNQPEPSANSAGVGPSKPFTEAQVEEFREQDRWLPIANVARIMKSSLPTSAKVSKEAKECVQECVSEFISFITSEAAEKCLNEKRKTLNGEDILTSMRALGFDNYEGVLRVYLAKYRDVTRTGEATSWRHHFDQRPCRGDKV

SEQ ID NO: 293 - protein, 369 aa, Chorispora bungeana
MNAGGQFTDFPAVQTHGGQFISYDIFGSLFEITSKYRPPIIPIGRGAYGIVCSVLDSETNELVAMKKIANAFDNHMDAKRTLREIKLLRHLDHENIIAIRDVVPPPLRRQFSDVYIATELMDTDLHQIIRSNQSLSEEHCQYFLYQLLRGLKYIHSANVIHRDLKPSNLLLNANCDLKICDFGLARPTSENEFMTEYVVTRWYRAPELLLNSSEYTAAIDVWSVGCIFMELMNRKPLFPGKDHVHQMRLLTELLGTPTESDLGFTHNEDAKRYIRQLPSFPRQPLAKLFSHVNPLAIDLVDRMLTFDPNRRITVEEALNHQYLAKLHDPNDEPICQKPFSFEFEQQPMDVEQIKEMIYKEAIALNPTYG

SEQ ID NO: 294 - protein, 584 aa, Arabidopsis thaliana
MCGILAVLGCSDDSQAKRVRVLELSRRLRHRGPDWSGLYQNGDNYLAHQRLAVIDPASGDQPLFNEDKTIVVTVNGEIYNHEELRKRLKNHKFRTGSDCEVIAHLYEEYGVDFVDMLDGIFSFVLLDTRDNSFMVARDAIGVTSLYIGWGLDGSVWISSEMKGLNDDCEHFETFPPGHFYSSKLGGFKQWYNPPWFNESVPSTPYEPLAIRRAFENAVIKRLMTDVPFGVLLSGGLDSSLVASITARHLAGTKAAKQWGPQLHSFCVGLEGSPDLKAGKEVAEYLGTVHHEFHFSVQDGIDAIEDVIYHVETYDVTTIRASTPMFLMSRKIKSLGVKMVLSGEGADEIFGGYLYFHKAPNKKEFHQETCRKIKALHKYDCLRANKSTSAFGLEARVPFLDKDFINTAMSLDPESKMIKPEEGRIEKWVLRRAFDDEERPYLPKHILYRQKEQFSDGVGYSWIDGLKDHAAQNVNDKMMSNAGHIFPHNTPNTKEAYYYRMIFERFFPQNSARLTVPGGATVACSTAKAVEWDASWSNNMDPSGRAAIGVHLSAYDGKNVALTIPPLKAIDNMPMMMGQGVVIQS

SEQ ID NO: 295 - protein, 624 aa, Oryza sativa
  misc_feature (398)..(398): Xaa can be any naturally occurring amino acid
  misc_feature (430)..(430): Xaa can be any naturally occurring amino acid
MDSCALFLSTPRPPPPLVPAHRRRPLASRSGLRRREGCPCSCASSSSSSGRAGSQDRPPRPWQQKQRTQRPGRGEAIDPVGFLAKHGISDRAFAQFLRDRYKALKDRRWELHSRLIDLKEASSGFELMGMHRHRQHRVDFMEWAPGHHVGVALITMPIRAGARYCSVVGDFNQWSTTENCAREGHLGHDDFGYWTIILEDKLREGQEPDEYYFQEYNYADDYDKGDNGVDVEELIHRMNEEYWEPGEIKSQKSRLEVVAKLYEQMFGPNGPQTEEELGDIPDAETRYNEWKALQKDDSASSLPCYDIIDNGQEFDIFNVATDRVSFEKFQGKSPPLAYWVEMRKGRKAWLEKYVPAISHKDKYRVYFNTPDGGLERIPAWATYVLPGLLMIIIIGNYXDAEGKQSYAVHWDPPPEEIYKWRFERPKVKGXPHIKDAGYNAIQLIGIVEHKDYSSVGYKIHLYLGGILLNHPFPCCHVIVYPFLVPFSLQCEVTNYFSVSSRFGSPDDFKKLVDEAHGLGLVVLLDIVHSYASADELVGLSLFDGSNDCYFHSVFFLSPVVFPLLSSLPYSRQTTLGVARAKEATAMAKGAVTTSSRIWGGRGLGRWRSQRPGPPERGVVSSSGC

SEQ ID NO: 296 - protein, 793 aa, Solanum tuberosum
MELLHCPSISTYKPKLSFHNHLFSRRSSNGVDFESIWRKSRSSVVNAAVDSGRGGVVKTAATAVVVEKPTTERCRFEVLSGKPLPFGATATDGGVNFAVFSRNATAATLCLITLSDLPEKRVTEQIFLDPLANKTGDVWHVFLKGDFENMLYGYKFDGKFCPEEGHYFDSSQIVLDPYAKAIVSRGEYGVLGPEDDCWPPMAGMVPSASDQFDWEGDLPLKFPQRDLVIYEMHVRGFTNHESSETKYPGTYLGVVEKLDHLKELGVNCIELMPCHEFNELEYYSYNSVLGDYKFNFWGYSTVNFFSPMGRYSSAGLSNCGLGAINEFKYLVKEAHKRGIEVIMDVVFNHTAEGNENGPILSFRGIDNSVFYTLAPKGEFYNYSGCGNTFNCNNPIVRQFIVDCLRYWVTEMHVDGFRFDLASILTRSSSSWNAVNVYGNSIDGDVITTGTPLTSPPLIDMISNDPILRGVKLIAEAWDCGGLYQVGMFPHWGIWSEWNGKYRDMVRQFIKGTDGFSGAFAECLCGSPNLYQKGGRKPWNSINFVCAHDGFTLADLVTYNNKHNLANGEDNKDGENHNNSWNCGEEGEFASIFVKKLRKRQMRNFFLCLMVSQGVPMIYMGDEYGHTKGGNNNTYCHDNYINYFRWDKKDESSSDFLRFCGLMTKFRHECESLGLDGFPTAERLQWHGHTPRTPDWSETSRFVAFTLVDKVKGELYIAFNASHLPVTITLPDRPGYRWQPFVDTGKPAPFDFLTDDVPERETAAKQYSHFLDANQYPMLSYSSIILLLSSADDA

SEQ ID NO: 297 - protein, 152 aa, Zea mays
MSLVRRSNVFDPFSMDLWDPFDTMFRSIVPSAVSTNSETAAFASARIDWKETPEAHVFKADLPGVKKEEVKVEVEDGNVLVISGQRSREKEDKDDKWHRVERSSGQFVRRFRLPENAKVDQVKAGLENGVLTVTVPKAEEKKPEVKAIEISG

SEQ ID NO: 298 - protein, 377 aa, Portulaca oleracea
TDVPAVAAGAFKSYKLAAKAISRLQSLPSRNMSLLCDVLVKEVTELTAYDRVMVYKFHEDEHGEVISEYRKPGLDPYLGLHYPATDIPQASRFLFLKNRVRMICNCLATPVKVIQDKKLAQPLSLGGSILRVPHGCHAQYMANMGSIASLVMAVTINEDDDEVKSDPSTGKRLWGLVVCHHTSPKFISFPLRYACELLVQVFGIQINKEVELVAQIRESHILRIQTVLCDMLMRDSPVAIVTQSPNVMDLVKCDGAALYYNGQVWLLGITPTEEQIKNLTLWLLKYHGSTKGLSTDSLMEAGYPCASDLGDAVCGMAAVRISSKDFLFWFRSHTAKEVKWGGAKHDPTDNDNGRKMHPRSSFKAFLDVVKWRSQPWE

SEQ ID NO: 299 - protein, 377 aa, Quiabentia verticillata
TDVPAAAAGAFKSYKFAAKAISGLQSLPSRNMSLLCDVLVKEVSELTGYDRVMVYKFHEDEHGEVISEYRTPDLEPYLGLHYPATDIPQASRFLFLKNRVRMICDCLAAPVKVIQDKKLAQPLSLGGSILRAPHGCHAQYMANMGTIASLVMAVTINEDEDEVKSDPSTGTRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGITPTDEQIKNITQWLLEYHGSTKGLSTDSLMEAGYPGASELGDAVCGMAAVRISSKDVLFWFRSHSAREIKWGGAKHDPVDSDDRSKMHPRSSFKAFLEVVKWRSQPWE

SEQ ID NO: 300 - protein, 146 aa, Triticum aestivum
  misc_feature (4)..(4): Xaa can be any naturally occurring amino acid
  misc_feature (15)..(15): Xaa can be any naturally occurring amino acid
  misc_feature (24)..(24): Xaa can be any naturally occurring amino acid
  misc_feature (67)..(67): Xaa can be any naturally occurring amino acid
  misc_feature (78)..(78): Xaa can be any naturally occurring amino acid
  misc_feature (91)..(91): Xaa can be any naturally occurring amino acid
  misc_feature (96)..(96): Xaa can be any naturally occurring amino acid
  misc_feature (106)..(106): Xaa can be any naturally occurring amino acid
  misc_feature (108)..(108): Xaa can be any naturally occurring amino acid
  misc_feature (110)..(110): Xaa can be any naturally occurring amino acid
  misc_feature (119)..(119): Xaa can be any naturally occurring amino acid
  misc_feature (122)..(123): Xaa can be any naturally occurring amino acid
  misc_feature (125)..(125): Xaa can be any naturally occurring amino acid
  misc_feature (127)..(128): Xaa can be any naturally occurring amino acid
  misc_feature (130)..(130): Xaa can be any naturally occurring amino acid
  misc_feature (132)..(132): Xaa can be any naturally occurring amino acid
GPQXLPSGKFIPGNXNSYDKCRRXFDLGDADYLRYHGMQEFDQAMQHLEQKYEFMTSDHQYISRKHXEDKVIVFEKGXLVFVFNFHCNNSXFDYRXGCRKPGVYKXVXDXDAGLLGGLXRFXXAXEXXTXDXSHDNRQNQSPFIPM

SEQ ID NO: 301 - protein, 250 aa, Photorhabdus luminescens
MELISIPVLSDNYIWLLCDENRHVVIVDPTESQPVLDTLKSHGWIPDAILLTHHHHDHVGGVPGIIDRFPELPVYGPKETESKGATMIVCGGDSIHFGHFSFQIIDVPGHTLGHIAFYQAPYLFCGDTLFSGGCGRLFEGTAEQMYASLSKIAELPDDTLICCAHEYTVSNMKFAHAVLPNQTISEYQQKVTQMRESNQPTVPTTLQTEKKINIFLKCDDVDLQRNIGIVPNSQPLSAVFCQLRRRKDQF

SEQ ID NO: 302 - protein, 84 aa, Zea mays
IRLPPRAIEAAKRAGKAADVFYCLKLLEATGISTVPGSGFGQKEGVFHLRTTILPAEEDFPAIMSSFKKFNDSFMEQYEGYSRM

SEQ ID NO: 303 - protein, 244 aa, Glycine max
  misc_feature (85)..(85): Xaa can be any naturally occurring amino acid
MVSAAIARNVVGVIGNIISFGLFFSPAPTFYGIVKKKTVEEFKPDPYIATVLNCAFWVFYGMPFVHPNSILVVTINSVGLAFESXYLVFFFLFVESLKKLLIFLLIEVVFFAAVALITMLALHGTRQRSLVVGVLSDIFNVMMYVSPLTIMAKVIKTKSVKYMPFWLSLANFLNGACWTTYALIHPFDLYVLISNGIGAISGLIQLILYACYCSCKSKNDEDGDQDLKPSGFQLSNLNGRAAVV

SEQ ID NO: 304 - protein, 246 aa, Dendrocalamus latiflorus
MGRGEVELKRIENKINRQVTFAKRRNGLLKKAYELSVLCDAEVALIIFSNRGKLYEFCSGQSMTKTLERYQKCSYSGPDTAIQNKENELVQSSRNEYLKLKARVDNLQRTQRNLLGEDLGSLGIKELDQLEKQLDSSLRHIRSTRTQHMVDQLTDLQRREQMLCEANKCLRRKLEESQVHGQVWEHGANLLAGYDQRQSPQQAPPHAGNGFFHPLDAAAEPTLQIGFTPEQINNSCVTGFMPTWLP

SEQ ID NO: 305 - protein, 280 aa, Campylobacter jejuni
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKANAKNLRAALYSMYGARLELVICKDQPKLYRLNANNEFIFIKDLKMNEKGKINATGGTQKFWEEKHAKFIKNLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 306 - protein, 547 aa, Escherichia coli
AAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 307 - protein, 371 aa, Pisum sativum
MGAPIANAIPLITPYKMGNFNLSHRVVMAPLTRMRSYNNVPQPHAILYYAQRASQGGLLIAEATGVSDTAQGYPNTPGIWTKEQVEAWKPIVEAVHAKDSVFFLQIWHVGRVSNSIYQPNGQAPISSTDKAITSNDQQQFTAPRRLRTNEIPNIVNDFKLAARNAIEAGFDGVEIHGAHGYLLDQFMKDKVNDRTDEYGGSLENRCRFTFEVVEAVANEIGADKVGIRLSPFAEYAESGDSNPNALGLYMANALNKYNILYCHMVEPRLIQTFDPVETPHSLEPMRKAFNGTFMVAGGYNRQDGIKAIAENRADLVVYGRWFISNPDLPKRFALDAPLNKYNRETFYSSDPVIGYTDYPFLNDETPVESKA

SEQ ID NO: 308 - protein, 815 aa, Haemophilus somnus
MNKFVSQSTIDTFFDGEHADPFSVLGMHETSNGIEVRVLLPDAEKVFVLSKETKNVLCELLRVDERGFFAGVVPNTHSFFAYQLEVYWGNEAQVIEDPYAFHPMINELDNWLLAEGSHKRPYEILGAHFTECDNVAGVNFRLWAPNAKRVSVVGDFNYWDGRRHPMRFHQSSGIWELFLPKVSLGQLYKFELLDCHNQLRLKADPYAFSSQLRPDTASQIGALPEIVSMTEKRRKANQADQPISIYEVHLGSWRRNLENNFWLDYDQIAEELIPYVKDMGFTHIELLPLSEFPFDGSWGYQPIGLYSPTSRFGTAEGFKRLVNKAHKAGINVILDWVPGHFPSDTHGLVAFDGTALYEHADPKEGYHQDWNTLIYNYGRHEVKNYLASNALYWMERFGLDGIRVDAVASMIYRDYSREDGQWIPNQYGGRENLEAIEFLKQTNHLLGTEIPGVVSIAEESTSFAGVTHPPYEGGLGFHFKWNMGWMNDTLSYMKKDPIYRQHHHSQMTFGMVYQYSENFILPLSHDEVVHGKCSLLGKMPGDAWQKFANLRAYYGYMWGYPGKKLLFMGNEFAQGREWNYQESLDWYLLDEFHGGGWHKAIQDYVRDLNHIYQKNAPLFELDTDPQGFEWLVVDDYQNSVFVFERRSKKDERIIVVSNFTPVLRQNYRFGVNIAGEYLEILNSDAQQYMGSNSTNTSKIVTEDIESHNKAQSISIDIPPLATVYLKLHKVKKVRKMRKTSKVEDTAVKTEKKIAKGKTTRTKKTVADTVSEATEVKPKKTVTKRAVVKKVKNEESAVFPNAEVIAESTSVENNVS

SEQ ID NO: 309 - protein, 479 aa, Pseudomonas putida
MSKILTTASGAPVADNQNSRSAGPRGPLLLDDFHLIEKLAHFNRENIPERRVHAKGSGAYGTFTVTHDITGYTSAKLFEEVGKQTETFLRFSTVGGERGSADTERDPRGFAVKFYTEEGNWDIVGNNTPVFFIRDPLKFPDFIHTQKRHPQSNLKNAQMMWDFWSHSPEALHQVTILFSDRGIPDGYRHMHGFGSHTYSLINAKGERTWVKWHFKTQQGIKNLTPADAARLAGTDPDYAQRDLFEAIERGDYPRWTVCIQVMSEAEAASRDENPFDVTKTWSQKDYPLIEVGVLELNRNPLNYFAEVEQAAFGPSNMVPGVGLSPDRMLQGRVFAYADAHRYRVGTNHQQLPVNAPRCPVNSYQRDGSMATGSYGSAPNYEPNSYSDAPKQSPRHAEPALAMNGSADRYDHREDTDYFSHAGALFRLMNDEQKALLISNIAGTMAGVSEDVIQRQLQYFFKADPAYGEGIAKALGINLA

SEQ ID NO: 310 - protein, 512 aa, Glycine max
MGNSFGCSASGERLVSAARDGDLVEAQMLLNCNPCLAKYSTFGGLNSPLHFAAAKGHNEIVALLLENGADVNSRNYCGQTALMQACRYGHWEVVQTLLLFRCNVMRADYLSGRTALHFAAVHGHVRCIRLVVADFVPSALYQAIHAGTDVDRGGGSNAKGKHEQSALSKFINKTADGGITALHMAALNGYFDCVQLLLDLNANVNAVTYHYGTSMDLIGAGSTPLHYGACGGNLKCCQILVARGASRLALNCNGWLPLDIARMWGRHWLEQLLAPSSDASIPTFSHSNYLSLPLMSVLNIAREYGLQSSPTSSDEIDFCAVCLERPCSVAAEGCGHELCVRCALYLCSTNNVSSEMLGPPGSIPCPLCRHGVVSFVKLPGSQAKENKLHVSLGLCTPCILHPRDLDQPSLSHTPEIGRNRVASVPSEIRCPVTCSPFPSMAIPLCTCNDGPCPSFEPGEVETQDGSPHHSQASTVDQDKIEGPRLDKTTCSSMFWGRRSCSREHQCNSEINA

SEQ ID NO: 311 - protein, 875 aa, Chlamydomonas reinhardtii
MLLQAPGLAPGSARRQAACSVAREATNVRIVTAPALTPGRAGVSGRRILPPSRVVSVELEAPTLSSSPATVSTKKLFCEPSGQPASTAYGPALTGRPAPLGASIDADTGAINFSVFSSSAESVSLVLFTEADLNAGRATFEIPLDPYVNRTGDVWHIMLPDLRDDLLYGYRVEGVHQEEDKDYPGMRHDKRRVVLDPYAVAVLNRRRWGQMGPNLPYGEEGVLGVMPTWPQAAAALPAARGSAFDWEGDTPLNLPMESLVIYEAHVRGFTAHASSGVAAPGTYAGMVERLDYLKSLGVNAIELLPVFEFNELEYYSQIPGSDQYRFNFWGYSTVNYFSPMGRFSAAVGQGAPARASCDEFKQLVKECHRRGIEVILDVVFNHTAEGNERGPTISFRGLDNRVYYMLAPGGEYYNYSGCGNTLNCNQPVVRQFILDCLKHWVTEYHVDGFRFDLASILTRAHSAWHPQQYDQETGQRVAMSSGGAIVTAEGIMTDGAGVPTGYPLADPPLVESISEDPVLRNTKMIAEAWDCDGLNQVGAFPHYGGRWSEWNGKFRDVVRNFIKGTDGPWAGDFASAICGSPNIYANNTPHETDWWANNGGRQWKGGRGPHASINFVAAHDGFTLADMVAYNNKHNEANGENNRDGEQHNNSWNCGEEGPTTKWEVNRLRQRQMRNLTGALLLSCGVPMINMGDEYGHSKNGNNNTYCHDSELNYLRWDQLAEDPHGFNRFVRLLIHFRRATPALQRTTFVNDKDIQWHGELPNTPDWTDTSRLVAFTLHDGKGGGLYVAFNTSHLPKLLQLPKWGGRVWQPLVDTSKVAPYDFLAVDGVLSAEDVAAARRQMAMWTADHTYPVLPWSCIVLQSAPEDPAATSMIK

SEQ ID NO: 312 - protein, 474 aa, Oryza sativa
MVLTHVEAVEEGSEAAAAVFASRYVQDPVPRYELGERSISKDAAYQIVHDELLLDSSPRLNLASFVTTWMEPECDRLILEAINKNYADMDEYPVTTELQASNQTNQTIYPRLLHILSLHCVVVDNRCVNIIARLFNAPVGDGEKAVGVGTVGSSEAIMLAGLAFKRRWQNRRKAAGKPHDKPNIVTGANVQVCWEKFARYFEVELKEVKLTEGCYVMDPVKAVDMVDENTICVAAILGSTLTGEFEDVRRLNDLLAAKNKRTGWDTPIHVDAASGGFIAPFIYPELEWDFRLPLVKSINVSGHKYGLVYAGVGWGYKSVMKNCMESARTLREGLEKTGRFTIISKEEGVPLVAFTFKDGAGAQAFRLSSGLRRYGWIVPAYTMPAALEHMTVLRVVVREDFGRPLAERFLSHVRMALDEMDLAARAPVPRVQLTIELGPARTAGEEASIRVVKSEAVPVRKSVPLVAGKTKGVC

SEQ ID NO: 313 - protein, 87 aa, Ipomoea batatas
VKAQVSEVKGVMMENIEKVLDRGEKIEILVDKTENLRSQAQDFRTQGTKMRRKMWLKNMKVKLIVLAIIIALILIIVLSICGSSKCH

SEQ ID NO: 314 - protein, 357 aa, Dechloromonas aromatica
MQFGRTTLSKFVIENTRASHGELGALLIDVAAAVKTISAMVAKGALAGHHGALDSTNVQGEVQKKLDVLTNDAILRHCEWGGQLAGMASEEMDDPYPIPAEYPRGRYLLVFDPLDGSSNSDVNVSVGTIFSIFSRRAAGDAELGDYLRPGSEQVAAGYAIYGPSTMMVLTLGNGTHGFTLDRESGNFILTHANIRVPEDTREFAINTSNERFWEPPVQRYVSECKAGKSGVRGEDFNTRWIASMVAEVHRILIRGGIFMYPKDSKDPSKPGRLRLLYEANPMAMLIEQAGGAASTGRQRILDVVPDSLHQRAPVILGSKNEVERLARYHHEYDTGADRPFVSPLFSERSLFRDESRA

SEQ ID NO: 315 - protein, 766 aa, Thermosynechococcus elongatus
MTVSPEQIDRIVSNQHHDPFEILGCHQIQQNGQSVWAVRAYLPNAERVSVLCPEQRQEYPMTPVHHPHFFECHIPVAELNNYQLKIYENGHERVIYDPYAFRSPKLTDFDIHLFAEGNHHRIYEKLGAHLLTVDGVEGVYFAVWAPNARNVSVIGDFNHWDGRKHQMARRGNGIWELFIPGLSVGERYKYEIKNQEGHIYEKSDPYGFYQEPRPKTASIVTDLNSYEWGDSDWLEKRRHTDPLNQPISVYEVHLGSWLHASMEDPPIGADGQPQEPVQAAELKPWARFLTYRELAAKLIPYVKELGYTHIELLPVAEHPFDGSWGYQVTGYYAPTSRYGSPHDFMYFVDQCHQNGIGVIVDWVPGHFPKDGHGLAFFDGTHLYEHADPRKGEHKEWGTLVFNYGRHEVRNFLVANALFWFDKYHIDGIRVDAVASMLYLDYGRKEGEWIPNEYGGRENLEAANFLRQVNHVIFSYFPGILSIAEESTAWPMVSWPTYMGGLGFNLKWNMGWMHDMLDYFSMDPWFRQFHHNNVTFSMWYHHSENFMLALSHDEVVHGKSHIIGKMPGDRWQKFANLRCLFAYMFTHPGKKTMFMGMEFAQWSEWNVWSDLEWHLLQYEPHQQIKRFFGDLNHLYRSQPALYSQDFKQEGFEWIDCSDNRHSVVSFIRWDKDYQDFVVVVCNFTPQPHSHYRIGVPEHGFYRELFNSDAREYGGSNMGNLGGKWADEWPYHQRRYSLDLCLPPLAVLILKLDREKTVAERARYNLQS

SEQ ID NO: 316 - protein, 220 aa, Zea mays
MSPSSALAQASVRSLCARGSRARQSGGNVGSRVLYTPFTSSTPLHHPLLRPSSPARPAHFSSHRPHTRTIMSKAPGKVLNIGNINPHVKAAQYAVRGELAVKSEEYRAKLAKGEGSDLPFDTVIAANIGNPQQLDQKPITFFRQVASILENPGLLEHEDVLLNSLGYKSDVVDRARKLLKEVKSVGAYSQSQGAPGIRQSVAEYIERRDGYPAQFEDIYL

SEQ ID NO: 317 - protein, 106 aa, Triticum aestivum
  misc_feature (50)..(50): Xaa can be any naturally occurring amino acid
  misc_feature (80)..(80): Xaa can be any naturally occurring amino acid
MVSFEMNDLKKIGLGLTGFGVFFSFLGIVFFFDKGLIAMGNILFLSGLGXTIGLKSTMQFFTKPKNYKGAGFFLVLIGWXFFGMLLEAYGFIVLYQGGFFLCFSLD

SEQ ID NO: 318 - protein, 554 aa, Salmonella typhimurium
MCSIFGVFDIKTDAAELRKKALELSRLMRHRGPDWSGIYACDNAILAHERLSIVDVNAGAQPLYNARKTHVLAVNGEIYNHQTLRAEYGDRYAFQTGSDCEVILALYQEKGPDFLDDLQGMFAFALYDSEKDAYLIGRDHIGIIPLYMGYDEFGNFYVASEMKALTPVCRTIKEFPAGSYLWSKDGEIRQYYQRDWFEFDAVKDNVTDKNALRQALEESVKSHLMSDVPYGVLLSGGLDSSVISAITKKFAARRVEDQERSEAWWPQLHSFAVGLEGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLQALHMYDCARANKAMSAWGVEARVPFLDKKFLDVAMRINPQDKMCGNGKMEKHVLRECFESYLPASVAWRQKEQFSDGVGYSWIDTLKEVAAKQISDQQLETARFRFPYNTPSSKEAYLYREIFEELFPVPSAAECVPGGPSVACSSAKAIEWDEAFKTMDDPSGRAVGVHQSAYQ

SEQ ID NO: 319 - protein, 371 aa, Arabidopsis thaliana
MASLLTKPKPVFLCSPSLSPRTLNTATPSLNFTRISFTHHQKLAPFKPPSLVVAFSEKGLKRDVTTAAAATEGDYRRIMLSDVLVKKKEKVVWWEREWKAMDFGAVAVVLSMHLLSLLAPFQFNWRAVSVAFGLYIVTGLLGITLSFHRNLSHKAFKLPKWLEYLFAYCGAQALQGNPIDWVSTHRYHHQFCDSDRDPHSPLDGFWFGHMNWMFDTNTITQRCGEPNNVGDLEKQPFYRFLRTTYILHPLALAVALYAMGGFPFIVWGMGVRIVWVYHITWLVNSACHVWGKQAWNTGDLSKNNWWVAALAFGEGWHNNHHAFEFSARHGLEWWQLDMTWYVVKFLQAIGLATDVKLPSEAQKQRMAFTSD

SEQ ID NO: 320 - protein, 716 aa, Pseudomonas syringae
MASKNAPPVTATPKSELAGTDTLDRGNTNDKLESLEQFRSDATQQALRTNHGVKISDNQNTLKVGSRGPSLLEDFIMREKITHFDHERIPERIVHARGTAAHGYFQTYEDHGALSKAGFLRDPGKKTPVFVRFSTVQGPRGSGDTVRDVRGFAVKLYTEEGNFDLVGNNMPIFFIQDAIKFPDFVHAVKPEPHNEIPTGGSAHDTFWDFVSLVPESAHMVLWTMSDRAIPKSLRTMQGFGIHTFRFINTEGKSSFVKFHWKPKFGVCSLVWDEAQKLAGKDTDFHRRDLWESIEMGDYPEWELGVQIVAEEDEHKFDFDLLDPTKIIPEELVPVTPLGKMVLNRNPDNYFAETEQVAFCPGHIVPGIDFSNDPLLQGRLFSYTDTQISRLGGPNFHEIPINRPIAPNHNGQRDAQHRTTIDKGRASYEPNSIDGGWPKETPAGPVDGGFETYPERVEAHKVRERSESFGDHFSQATLFFQSMSHHEKEHIIAAYSFELGKVEREYIRARQVNEILANIDLELASRVAANLGLPAPTAGTVPVRQTSVKESPALSQVNLLSGDIVSRKVAILVADGVDGKAVEAMKAALTAEGAHAKVLGPTSAPVKTADGQSLPVDASAEGLPSVAFDAVFVPGGKASIEALKGDGVALHFILEAYKHLKAISFAGEAKELLSLLRLEEDAGLLEVSDSKSFKAFFNAIAQHRVWDREVKAKAVPA

SEQ ID NO: 321 - protein, 481 aa, Zymomonas mobilis
MTRPNLQTESGRIVGDNQNSITAGKRGPTLLQDVYLIEKLAHFNRERTPERVVHAKGSGAFGELTVTADITRYTKAKIFSEIGKKTPMFARFSTVGGERGSADTVRDPRGFALKFYTEEGNWDLVGNNTPVFFIRDAIKFPDFIHTQKRNPQTNLKDPKMVWDFFSQSPESLHQVLILFSDRGIPLSHRFMHGFSSHTYSMINAAGDIHYVKWHFLSQQGIKNLKAEEAEKLAGSNPDHYQEDLFSSIEKGDFPKWKVAIQIMTPEQARNQRLNPFDVTKVWYHKEFPLMEVGFFELNKNPENYFQDVEQAAFSPANTIPGLYFSPDKMLQGRLFAYADTQRYRLGINATQIPVNRPRCSVHGYYRDGTMRVDGNGGDAVNYEPNSDPSSPFENASYKEPPIAIDGEGGHYDRYEDSGNDNYEQPGKLYRLMKEDEKARLVSNLVASLGAPSVPNAIKEKQIELFRRCDADLGKRLADSLL

SEQ ID NO: 322 - protein, 342 aa, Candida albicans
MFKRFFSYTPRTFKMATFNNSFLMNHTCLRIKDPKVSIPFYTEKFGMKLIATFPFADFTLYMLNYETEANKHLNWSAREGVLELCHNHGVENDSNYKLNNGNGEKDRGFGHICMSVDNIEAFQDQLLKSEVKFQKKLSDGRQKNIAFALDPDGYWIELIENGINKVANKTEVSSYKLNHTMIRVKDPKKSLEFYRDVLGFKLLSTSEHEGAKFTLYFLGYDHDPNFKQDTLVRNEQAKREGVIELTHNWGTESDPEFKGYHNGNSTENGALQGFGHTCVSCEDPAKFCQELEEKFGDKLDWSLKWDQGKIKKIAFIRDPDGYSIEILGHDLFADSFKEQANL

SEQ ID NO: 323 - protein, 532 aa, Xylella fastidiosa
MRIKTGIKKALILMLSVVLVSLVAIAAIAAHRFYIRLPQSRLFYAWKKMDEVYYDRTFAGFDWPAVLATYKKQLPRFDSDGQKTSPIINDMLSLLEVSHLQHFPAFMVSEEKKKTAVLANYFPELRDISGMVMVMDMLPRISRVLSLETWSPLYTHGVRVGDRILLETLDTDISDKNKPVRLYCYHINTAGVKKEFEFDLPAPPLGTQQTAVPAGDHVLHITRFDQGEIQALKHVSEDRNSSITQLHYISLGAVTTALHLPKNKVIDVVKDSEADKAGVEIGSIIGNGTNIKAGPENIGGKKVIKTNSRYEVVLPDGRKVTFSINKIIPKLNDFEGIRSAQLIGQTLVIAFNEMSDENTQWALQQIKNTPATAIVLDLRSNTGGSGIAGEKLLAGFLPSGTRIATEIRGKKTNVINVPSGYTPTDKPMAVLISLLSSSGAELAARTLQFHHRARIYGAQSSGQLLASRFYKLTDGTYMQIADTNLLDPAGKPLEWYGVMPDVKKWKALSDVRAGRDPVLECALTDLSGGQCH

SEQ ID NO: 324 - protein, 555 aa, Moritella marina
MCSIFGILDIKSDIKPLREQALELSKLLRHRGPDWSGIYTSDNAILVHERLAIVDVNNGAQPLYNEEKTHVLAVNGEIYNHKDLKKTLNVDFEFQTESDCEVILALYKEKGTQFLDDLNGIFAFALYDETEDAYLIGRDHIGIIPLYTGYDEHGNFYVASEMKALVPICTQIEEFPAGHYLWSKDGVVTPYYQRDWKDFDNVAQNGGDKSVVKQGLEDAVKRQLMCDVPYGVLLSGGLDSSVISAITQQYAKRRIEDGGKTEAWWPQLHSFSVGLNGSPDLAAAQKVADHLGTIHHSIEFTVQEGIDALRDVIYHIETYDVTTIRASTPMYLMARKIKAMGIKMVLSGEGADELFGGYLYFHKAPNAKEFHEETVRKVNKLHMFDCLRANKSMAAWGIEARVPFLDKEFVDASMRLNPELKMITGDRIEKNIIREAFEDLLPEEIVWRQKEQFSDGVGYSWIDQLKVHVEEAVTDQMLASAAFKFPINTPDTKEGYYYRAIFEDHFPGDSAAKCVPFGKSVACSTVEALAWDESFQNNADPSGRAAGVHNEAYED

SEQ ID NO: 325 - protein, 484 aa, Bacillus clausii
MKTKHLVWTVAVLAAVLVGGFFFIGGMNTGSPNPIQPNNGNESVVELSDDELMDKFERALATIESEYVTETDRQQLIEGAINGMVETLNDPFSDYMDVSSATDFQQSLSSHFEGIGAEVGMIDGNVSIISPMRESPAEKAGLLPNDAIIAIDGESIEGWSVNEAVANIRGEGGTTVTLTIARNGVKDPFDVKIERDTIEVESVRADTFEQDGKKIGRLEITSFSEDVGTQFEEQLQTLEEDGIDGLVIDVRGNPGGYLEGATKIGDAIIPEGKPVVQIEHGNGEIDSYLSKMKGKKPYPVVGLINESSASASEILAAALKESGDYDLVGETTFGKGTVQKSIPMDDGSALKITTDRWLTAGGNTIDQEGVEPTVKQRQPDYFYAVALTVEETFVKDQVSDQIGNAQKMLTGLGFDVGRDDGYFDEKTEEAIIAFQQSHDLQANGELNEETAGKLQEDILSHIRDTANDEQLKRAVELAAEQASQ

SEQ ID NO: 326 - protein, 209 aa, Bacillus cereus
MKWIQMPLGPLQTNAYILTNEQNECIIFDPGHEGEKLVTYLQEEQLKPLAVLLTHAHFDHIGAVDAVRDAFHIPVYVHKEEADWLGDATVNGSQIFMMNRSITAKPADHIIDAEGALAIGSFNFEIFETPGHSPGSISYYCKEANAVFSGDVLFQMSIGRTDLPGGSFAELIGSIEEKLFVLPDETAVLCGHGPETSIGFEKENNPFLQ

SEQ ID NO: 327 - protein, 483 aa, Bacillus subtilis
MSSNKLTTSWGAPVGDNQNSMTAGSRGPTLIQDVHLLEKLAHFNRERVPERVVHAKGAGAHGYFEVTNDVTKYTKAAFLSEVGKRTPLFIRFSTVAGELGSADTVRDPRGFAVKFYTEEGNYDIVGNNTPVFFIRDAIKFPDFIHTQKRDPKTHLKNPTAVWDFWSLSPESLHQVTILMSDRGIPATLRHMHGFGSHTFKWTNAEPEGVWIKYHFKTEQGVKNLDVNTAAKIAGENPDYHTEDLFNAIENGDYPAWKLYVQIMPLEDANTYRFDPFDVTKVWSQKDYPLIEVGRMVLDRNPENYFAEVEQATFSPGTLVPGIDVSPDKMLQGRLFAYHDAHRYRVGANHQALPINRARNKVNNYQRDGQMRFDDNGGGSVYYEPNSFGGPKESPEDKQAAYPVQGIADSVSYDHYDHYTQAGDLYRLMSEDERTRLVENIVNAMKPVEKEEIKLRQIEHFYKADPEYGKRVAEGLGLPIKKDS

SEQ ID NO: 328 - protein, 157 aa, Triticum aestivum
MLLIRRSNVFDPFSLDFFDPFDGFPFGSGSNSSGSLIPRTSSDTAAFAGARIDWKETPEAHVFKADVPGLKKEEVKVEVEDGNILQISGERNKEQEEKTDTWHRVERSSGKFLRRFRLPENAKAEQVKASMENGVLTVTVPKEEAQKPEVKSIQISG

SEQ ID NO: 329 - protein, 560 aa, Medicago truncatula
MGLCFSSTKVVSGSNSNTTNNDNRKRNQSTTTDTTVTVTTATTAAQKQTAQRRKGGSNETAQKKNHHQHHRLKEKTGSKHVPCGKRTDFGYEKDFDKRFSLGKLLGHGQFGYTYVGVDKSNGDRVAVKRLEKAKMVLPIAVEDVKREVKILKELTGHENVVQFYNAFDDDSYVYIVMELCEGGELLDRILNKKDSRYTEKDAAVVVRQMLKVAAQCHLHGLVHRDMKPENFLFKSNKEDSALKATDFGLSDFIKPGKRFQDIVGSAYYVAPEVLKRKSGPESDVWSIGVITYILLCGRRPFWDKTEDGIFKEVLRNKPDFRRKPWPTISNAAKDFVKKLLVKDPRARLTAAQALSHPWVREGGEASEIPIDISVLNNMRQFVKYSRLKQFALRALASTLNEGELSDLKDQFDAIDVDKNGAISLEEMRQALAKDLPWKLKESRVLEILQAIDSNTDGLVDFTEFVAATLHVHQLEEHDSDKWQQRSQAAFEKFDIDKDGYITPEELRMHTGMRGSIDPLLEEADIDKDGKISLPEFRRLLRTASIGSRNVTSPTLRHRRI

SEQ ID NO: 330 - protein, 535 aa, Ashbya gossypii
MGNSPSKDSPYAFQSTTQQAGAGSQQQSSLADENPNEPNDPDDSRLTPTHTKNISISKPRNSHVITSGVSAVAPTSVRRSPYYDLKIDVNMARALQPVSTSSDSFSSSSSSSSAASSSSTASSSTSLCAKPGETAAVPGHCGYGREHGFLSLKSSLSSSSDTALSSINVSGGGSLPTIAEERENSHIIARNSKATSAPSYSHMAKKSRIANPRSETPIVLKRNPHDPYNNDKLNIDDAIEKLLYIGDSRSYHSRDFPFHSWEVQLICATVREIFLEQPSLLRLQAPIKIVGDVHGQFTDLLRILKLSGVPDETNYLFLGDYVDRGKQSLETILLLLCYKIKYPDRFFMLRGNHESASVTKMYGFYDECKRRMSTKTWKQFVDVFNTLPFAAIVQDKIFCVHGGISPQLSNMRQIEKIARPTDIPEEGLLTDLLWSDPDPAVSDWSLNDRGVSYTFGKRNVYDFCANFKFDLIIRGHMVVEDGYEFFAKKKFVTIFSAPNYCGQFQNWGAVMSVTTGMMCSFELLKPHGLKDTRRK

SEQ ID NO: 331 - protein, 333 aa, Haemophilus influenzae
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGNGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKE

SEQ ID NO: 332 - protein, 554 aa, Shigella flexneri
MCSIFGVFDIKTDAVELRKKALELSRLMRHRGPDWSGIYASDNAILAHERLSIVDVNAGAQPLYNQQKNHVLAVNGEIYNHQALRAEYGDRYQFQTGSDCEVILALYQEKGPEFLDDLQGMFAFALYDSEKDAYLIGRDHLGIIPLYMGYDEHGQLYVASEMKSLVPVCRTIKEFPAGSYLWSQDGEIRSYYHRDWFDFDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNVKELHEETVRKLLALHMYDCARANKAMSAWGVEARVPFLDKKFLDVAMRINPQDKMCGNGKMEKHILRECFESYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 333 - protein, 516 aa, Arabidopsis thaliana
MMNKDMLLHQHQQPQQDENMSNLTSASGDQASVSSGNITEASGSNYFPHHQQQQEQQQQQRQQLFVPDSQPQKKRRNQPGNPDPESEVIALSPKTLMATNRFVCEICNKGFQRDQNLQLHRRGHNLPWKLKQRSNKEVIRKKVYVCPEASCVHHDPSRALGDLTGIKKHFCRKHGEKKWKCDKCSKKYAVQSDCKAHSKTCGTKEYRCDCGTLFSRRDSFITHRAFCEALAEETAREVVIPQNQNNNQPNPLLIHQSASHPHHHHQTQPTINVSSSSSSSHNHNIINSLHFDTNNGNTNNSNNSNNHLHTFPMKKEQQSNDHIMNYHHSIIPPWLAPQPHALTSSNPNPSNGGGGGGSLFSLASPAMSATALLQKAAQMGSTKTPPLPPTTAYERSTHNNNLTTTMAAMMTSPSGFISSNNNNHVLFQDYNASGFDNHGGEEAFDDTFGGFLRTNEVTAAAGSEKSTKSGGGEGLTRDFLGLRPLMSHNEILSFAGLGSCINSSASDQLHPKPWQG

SEQ ID NO: 334 - protein, 662 aa, Chromobacterium violaceum
MCGIAGALLDRHAHDGDVAEARRMILRQTHRGPDGLAARRVGPALLASSRLAIVDVANGSQPFSDESRAIHAVFNGEIYNHLELRENLSRRGHSLSGGSDGEVIVHLYEEYGTDCFQWLDGQFAIAIFDSRDDSLHLARDRMGICPLHWARLDGALYFSSEIKGLLAVAGMPRRAEPRAMLQLAYFGAVCAPLTPFGGIHQLPAAHRLSFRAGRLEIGRYWSLDFPLAGEHARLSEAQAAEGLAARLERAVASHAQGEFEPTCFLSGGIDSAVIAALLQRRSQASIAAFCAASEHGRMDEGGAAARTAEWLGVDLKRVRIDEAGIADAFPRLIWHGETPVISTEASALMRLAGEAGKRSKIVLTGEGADEAFAGYLAFRQYRQLGALTGRGLSPLRTMVRPWLRGHYGSECLLPGEDRLGVLAEHFGCVPAQAYEWEFYREALTPLFSPELRAMAAAGGCWDGFEFDRGAVRGRHWLDRSLYVSYQVMLPNYLLGAHGDRIYAAHSVEGRYPFLDRALVEYAAALDPALKLRRGREKHILRVAAARWLPDEVAWRPKTRFVMPFGTPFVGPRAAPLYAELLSPGKLAEYGYFDPERVRSLFRALASPPSAGGKARRYLERLALGLGATFVVSAQLWHHLHLADGGSAVSGEAARRSAPATIA

SEQ ID NO: 335 - protein, 506 aa, Pseudomonas fluorescens
MSQDPKKCPVTHLTTEAGAPVVDNQNSMTAGARGPLLAQDLWLNEKLANFVREVIPERRMHAKGSGAFGTFTVTNDITQYTRAKIFSEVGKKTEMFARFSTVAGERGAADAERDIRGFALKFYTEEGNWDLVGNNTPVFFLRDARKFPDLNKAVKRDPFSNKRSATNNWDFWTLLPEAFDQVTIVMSDRGIPAGYRHIDGFGSHTFSFINTQNERFWVKFHMRTQQGIQNLTDAEAADLIAKDRESSQTDLFDAIERGEYPKWKMYVQIMPELEAETVPYHPFDLTKVWPKGDYPLIEVGEFELNRNPENYFQDVEQAAFAPSNLVPGISYSPDRMLQARLVNYADAARYRVGVNHSQVPVNAARCPVNSNRRDGQGRMDGNYGSLPHYEPNSFNQWQEQPQFKEPALKITGDADFWDFREDDNDYFSQPRALFNLMNDEQKQALFNNTAAAMGDALDFIKYRHIRNCYACDPAYGQGVAKALGMTVADAQAARETDPAKGLPSFL

SEQ ID NO: 336 - protein, 491 aa, Brassica oleracea
MVALTAEKQDQNLLSRMAAGDGHGEKSAYFDGWKAYEENPFHPIDRPDGVIQMGLAENQLCGDLMRKWVLEHPEASICTAEGVNQFSDIAIFQDYHGLPEFRQAVAKFMEKTRNNKVKFDPDRIVMSGGATGAHETVAFCLANPGDGFLVPTPYYPGFDRDLRWRTGVNLVPVTCHSSNGFKITAEALDAAYENARVSNIPVKGLLITNPSNPLGTTLDRDCLKSLVKFTNDKGIHLIADEIYAATTFGESEFISVAEVIDEIPDCNTDLIHIVYSLSKDMGLPGLRVGIVYSYNDRVVQIARKMSSFGLVSSQTQHLIAKMLSDEDFVDEFIRKSKLRLAERHAELTTGLDGLSIGWLKAGAGLFIWMDLRNLLKTATFDSEMELWRVIVHKVKLNVSPGGSCHCHEPGWFRVCFANMDYQTMETALERIRVFTSQTEEESLILTKPMAKKKKCWQSSLRLSFKDTRRFEEGFFSPHSPVPPSPLVRAQI

SEQ ID NO: 337 - protein, 365 aa, Pinus sylvestris
QMGLAENQLSIDMLELWLKEHPEASMSLNQDAGTSVFRELALYQDYHGLPTFRKAIANFMESLRGNKVKFDAESIVLTAGATAANELLMFCLADPGDAFLVPTPYYPGFVRDLRWRTGVEIVPVHCDSSNRFQITKSALERAYLEAQNQKLKVRGLIVTNPSNPLGTTLSVKALRNLLAFVQEKKIHLVCDGIYSGSVFSPPRFHSISEILPNDNHICDNVHIVYSLSKDLGLPGFRIGAIYSYNNTAVKTARRMSSFCMVSSQTQHMLSALLSDFKFMNHFISENQKRLRERHRFLVSGLQKAGITCLKSNAGLFCWVDMRHLLPSPDVNGELMLWQSILDEAGLNISPGSSFHCKEPGWFASR

SEQ ID NO: 338 - protein, 365 aa, Pinus sylvestris
QMGFAENQVSFDLLEAWLDEHPEASICQEGKTTFRDTAPHQDYHGLPAFRESLARFMELVRGGKVRFDPDRIVLTAGATAANELLMFCLANPGEAFLVPTPYYPGFDRDLRWRTGVEIIPVHCNSSNDFQVTSSALEEAYHEAKQKNIRVKGILVTNPSNPLGTTMERKTLKNLLSFASEKNIHLICDEIYSGSVFLPPRFRKYAEVLQASGRPNDSDRVHIVYSLSKDLGLPGFRVGAIYSYNDTVVTTARRMSSFSLVSSQTQHFLACMLSDEDFTKKYIKENKKRLRKRHRIMVSGLQKVGISCLKSNAGLFCWVNLTQLPPSENIDGEIKLWETILYEMGLNVSPGSSCHCIEPGWFSVCF

SEQ ID NO: 339 - protein, 512 aa, Zea mays
SARVGSQNGVQMLSPSEIPQRDWFPSDFTFGAATSAYQIEGAWNEDGKGESNWDHFCHNHPERILDGSNSDIGANSYHMYKTDVRLLKEMGMDAYRFSISWPRILPKGTKEGGINPDGIKYYRNLINLLLENGIEPYVTIFHWDVPQALEEKYGGFLDKSHKSIVEDYTYFAKVCFDNFGDKVKNWLTFNDPQTFTSVSYGTGVFAPGRCSPGLDCAYPTGNSLVEPYTAGHNILLAHAEAVDLYNKHYKRDDTRIGLAFDVMGRVPYGTSFLDKQAEERSWDINLGWFLEPVVRGDYPFSMRSLARERLPFFKDEQKEKLAGSYNMLGLNYYTSRFSKNIDISPNYSPVLNTDDAYASQEVNGPDGKPIGPPMGNPWIYMYPEGLKDLLMIMKNKYGNPPIYITENGIGDVDTKETPLPMEAALNDYKRLDYIQRHIATLKESIDLGSNVQGYFAWSLLDNFEWFAGFTERYGIVYVDRNNNCTRYMKESAKWLKEFNTAKKPSKKILTPA

SEQ ID NO: 340 - protein, 362 aa, Candida albicans
SPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPLNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 341 - protein, 215 aa, Chlorobium tepidum
MSVQVEQIRTGGDRNFGYLCADKATGEAFAVDPSNSPKVLVDAAARKGWQLVRAFCTHGHADHTNGNEEFERLTGIRVLLFGDRDARLGIEVMHGASFPLGEGVVEIIHTPGHTLDSICLLAGDALFTGDTLFVGKVGGTWSEADARLEYRSLHERLMVLPAGTNVFPGHDYGTAPVSTIGHEKTTNPFLLQPDAESFIDLKNNWSAYKKAHGIS

SEQ ID NO: 342 - protein, 706 aa, Mycobacterium avium
MATDHTSGAPDPKQRDLESARFRRDTGYLTTQQGVRVDHTDDALTVGERGPTLLEDFHAREKITHFDHERIPERVVHARGAGAYGYFEPYDDRLAQYTAAKFLTSPGTRTPVFVRFSTVAGSRGSADTVRDVRGFATKFYTEQGNYDLVGNNFPVFFIQDGIKFPDFVHAVKPEPHNEIPQAQSAHDTLWDFVSLQPETLHAIMWLMSDRALPRSYRMMQGFGVHTFRLVNARGEGTFVKFHWKPRLGVHSLIWDECQKIAGKDPDYNRRDLWEAIESRQYPEWELGVQLVAEDDEFSFDFDLLDATKIIPEEQVPVLPVGKMVLNRNPDNFFAETEQVAFHTANVVPGIDFTNDPLLQFRNFSYLDTQLIRLGGPNFAQLPVNRPVAQVRTNQHDGYGQHTIPQGRSSYFKNSIGGGCPALADEDVFRHYTQRVDGQTMRKRAEAFQNHYGQARMFFKSMSPVEAEHIVAAFAFELGKVEMPEIRSAVVAQLARVDDQLAAQVAAKLGLPEPPEEQVDESAPVSPALSQVTDGGDTIASRRIAVLAADGVDVVGTQRFTELMEQRGAVVEVLAPVAGGTLAGGSGGELRVDRSFTTMASVLYDAVVVACGPRSVSTLSDDGYAVHFVTEAYKHLKPIGAYGAGVDLLRKAGIDNRLAEDTDVLNDQAVVTTKAAADELPERFAEEFAAALAQHRCWQRRTDAVPA

SEQ ID NO: 343 - protein, 306 aa, Oryza sativa
MPSHADLDRQISQLRECKFLGEAEVRALCEQAKAILMEEWNVQPVRSPVTVCGDIHGQFYDLIELFRIGGDSPDTNYLFMGDYVDRGYYSVETVTLLVALKVRYRERITILRGNHESRQITQVYGFYDECLRKYGNANVWKYFADLFDYLPLTALVENQVFCLHGGLSPSLDTLDNIRALDRIQEVPHEGPMCDLLWSDPDDRCGWGISPRGAGYTNGQDIAQQFNHTNGLTLISRAHQLVMEGFNWCQDKNVVTVFSAPNYCYRCGNMAAILEIGENMDQNFLQFDPAPRQIDPDTTRKTPDYFL

SEQ ID NO: 344 - protein, 354 aa, Ustilago maydis
MSHAHGQQPNHSTTFKVGETYKVVDVVGEGAYGVVCSAIHVPSSSRVAIKKITPFDHSMFCLRTLREIKLLRHFNHENIISILDIVKPDDYDSFSEVYLIQELMETDMHRVIRTQELSDDHCQYFIYQTLRGLKALHSAQVLHRDLKPSNLLLNANCDLKICDFGLARSANQPEAEGTGFMTEYVATRWYRAPEIMLTFKEYTKAIDVWSVGCILAEMLAGKPLFPGRDYHHQLSLTLEILGTPSLDDFYAITSTRSRDYIRALPFRKRRNLSLMFPNANPLAVDLMEKCLTFSPRKRITVEEALAHPYLEPYHDPEDEPTAEPLDPSFFDFDYCKEQLSRSELKRLIYNEIMR

SEQ ID NO: 345 - protein, 432 aa, Candida glabrata
MGLSKILGSNDNIVNKNGSSNTGGSKKSSFFSLNSKRNTDAAGIVPDFTSIKAPRTIYKNANFSISGKYEIIQVLGKGSYGVVCSAKHKLDNEDQEQFTVAIKKITNIFYRKILLKRAIREIKFMNYFKGHKHIVNLIDIEIVQDKPYDGLYCYQELIDYDLARVIHSSVQLSEFHIQHFIYQILCGVKYIHSADVIHRDLKPGNILCTVNGCLKICDFGLARGVAKQFVNKNSKPNEITNYVATRWYRAPELILSNNEYTKSVDMWSVGCILAEFYGRRPIFMGKDSIHQVYEIKKILGTPSRSLLVKYGTLKAWNLFGHNSNHNLDNLKSGMPWSTVYPMASATALDLIDKLLQWEPESRLNVLQSLEHQFVQSVRKPNDEPICSKGPFNFSYEYNLNSMDDLRQCLNEEVAQFYIERQLGEEYSKYIEE

SEQ ID NO: 346 - protein, 542 aa, Unknown
  Rhizobium sp. NGR234
MAAKEVRFHTEAREKMLRGVDILANAVKVTLGPKGRNVVLDKSFGAPRITKDGVTVAKEIELEDKFENMGAQMVREVASKTSDIAGDGTTTATVLAQAIVKEGAKAVASGMNPMDLKRGVDKAVDAVVEELRRNARKVTKNDEIAQVGTISANGDTEIGRFLAEAMEKVGNEGVITVEEAKTAVTELEVVEGMQFDRGYLSPYFVTNPDKMRVELEEPYVLIHEKKLSNLQALLPVLESVVQSGKPLLIIAEDVEGEALATLVVNKLRGGLKVAAVKAPGFGDRRKAMLEDIAILTGGTAISEDLGIKLENVTLDMLGRAKKVVVEKENTTIVDGAGSKTEIEGRVAQIKAQIEETTSDYDREKLQERLAKLAGGVAVIRVGGSTEVEVKERKDRVDDAMHATRAAVEEGVLPGGGVALLRAVKALDRVQTENPDQRHGIEIVRRAIEAPVRQIAENAGAEGSIIVGKLREKTEFGYGWNAQTNEFGDLFEQGVIDPVKVVRTALQDAASVAGLLITTEAMVAEKPKKEAPVPPMPPGGMDF

SEQ ID NO: 347 - protein, 534 aa, Mesembryanthemum crystallinum
MGICASKNKATQPEDNGYTPANGVGSNNQSKPPAQQNYHQQPPQQPVAPPQPASHPPVRMPSPKPAPKVEPNTILGKPFEDVKVYYTLGRELGRGQFGVTYLCTDKKTGQQYACKSISKKKLVTKADKDDMRREIQIMQHMSGQPNIVEFKGAYEDKTSVNLVMELCAGGELFDRIIAKGHYSEKAAATMLRQIVNVVHVCHFMGVMHRDLKPENFLLSSKDENSLLKATDFGLSVFIEEGKVYRDIVGSAYYVAPEVLRRRYGKEIDVWSAGVMLYILLSGVPPFWAETEKGIFDAILQGHIDFESKPWPSISNGAKDLVRKMLTQDPKKRITAAQVLEHPWLRDGEASDKPIDSAVLLRMKQFRVMNKLKKLALKVIAENLPDEEIQGLKQMFANMDTDGSGSITYEELREGLARLGSKLTETEVKALMEAADQDGSGSIDYYEFITATMHRYRLERDEHLYKAFQYFDKDNSGFITTDELETAMKEYGIADENCIAEILLEVDTDNDGRINYDEFSAMMRSGTQNPVTKLI

SEQ ID NO: 348 - protein, 672 aa, Escherichia coli
MSYPSLFAPLDLGFTTLKNRVLMGSMHTGLEEYPDGAERLAAFYAERARHGVALIVSGGIAPDLTGVGMEGGAMLNDASQIPHHRTITEAVHQEGGKIALQILHTGRYSYQPHLVAPSALQAPINRFVPHELTHEEILQLIDDFARCAQLAREAGYDGVEVMGSEGYLINEFLTLRTNQRSDQWGGDYHNRMRFAVEVVSAVRERVGNDFIIIYRLSMLDLVEGGGTFAETVELAQAIEAAGATIINTGIGWHEARIPTIATPVPRGAFSWVTRKLKGHVSLPLVTTNRINDPQVADDILSRGDADMVSMARPFLADAELLSKAQSGRADEINTCIGCNQACLDQIFVGKVTSCLVNPRACHETKMPILPAMQKKNLAVVGAGPAGLAFAINAAARGHQVTLFDAHSEIGGQFNIAKQIPGKEEFYETLRYYRRMIEVTGVTLKLNHTVTADQLQAFDETILASGIVPRTPPIDGIDHPKVLSYLDVLRDKAPVGNKVAIIGCGGIGFDTAMYLSQPGESTSQNIAGFCNEWGIDSSLQQAGGLSPQGMQIPRSPRQIVMLQRKASKPGQGLGKTTGWIHRTTLLSRGVKMIPGVSYQKIDDDGLHVVINGETQVLAVDNVVICAGQEPNRALAQPLIDSGKTVHLIGGCDVAMELDARRAIAQGTRLALEI

SEQ ID NO: 349 - protein, 119 aa, Arabidopsis thaliana
  misc_feature (14)..(14): Xaa can be any naturally occurring amino acid
  misc_feature (28)..(28): Xaa can be any naturally occurring amino acid
  misc_feature (50)..(50): Xaa can be any naturally occurring amino acid
  misc_feature (72)..(72): Xaa can be any naturally occurring amino acid
  misc_feature (82)..(82): Xaa can be any naturally occurring amino acid
HHEGFMNFMHRDEXINHYPSKYDPDRCXEEVPTPTNSYTGIRTKCVIKEXTNFKQAGDRYRSWAPDRQDRFXVKRWVEILSXEPRLTHEIRGIWISYWSQADRSLGQKLASRLNVRPSI

SEQ ID NO: 350 - protein, 286 aa, Lactobacillus plantarum
MTALTKLTDTYTLNNGTKIPIVGFGTWQTPDGQVAYDSVLAALKAGYRHIDTAAAYGNEESVGKAIADSGVAREDLFVTTKLWNADHGYDAAKKALDTSLAKLGLDYVDLYLIHWPNPAAMRDNWEQLNADTWRAMEEAYTARKARAIGVSNFRPKHLDALLKTAKVVPAVNQIFLNPSDMEDEVVAYNRKHDILSEAYSPLGTGKIFSIPELKTLADKYDKSVAQVVLRWSLQHGFLPLPKSVHADRIEQNTELFDFELSDDDMKVIDGFHGVAGLANDPDQVNF

SEQ ID NO: 351 - protein, 441 aa, Zea mays
MSQPKIKRRVGKYEVGRTIGEGTFAKVKFARNSETGEPVALKILDKEKVLKHKMAEQIRREVATMKLIKHPNVVRLYEVMGSKTKIYIVLEFVTGGELFDKIVNHGRMSENEARRYFQQLINAVDYCHSRGVYHRDLKPENLLLDTYGNLKVSDFGLSALSQQVRDDGLLHTTCGTPNYVAPEVLNDRGYDGATADLWSCGVILFVLVAGYLPFDDPNLMNLYKKISAAEFTCPPWLSFTARKLITRILDPDPTTRITIPEILDDEWFKKEYKPPIFEENGEINLDDVEAVFKDSEEHHVTEKKEEQPTAMNAFELISMSKGLNLENLFDTEQGFKRETRFTSKSPADEIINKIEEAAKPLGFDVQKKNYKMRLANVKAGRKGNLNVATEIFQVAPSLHMVEVRKAKGDTLEFHKFYKKLSTSLDDVVWKTEDDMQMRETK

SEQ ID NO: 352 - protein, 399 aa, Candida tropicalis
MMNIDQHHQQLQQQSQAQAQAQAQAQAQAQAQAQAQAQAQAAAAAVAASSQRQVSFNVSDHYQILEIVGEGAYGIVCSAIHKPSNQKVAIKKIEPFERSMLCLRTLRELKLLKHFNHENIISILAIQRPLNFESFNEIYLIQELMETDLHRVIRTQNLTDDHIQYFIYQTLRALKAMHSANVLHRDLKPSNLLLNSNCDLKVCDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFQELFSNKPGINPLALDLLEKLLIFNPAKRITVEDALKHPYLQLYHDPNDEPISDKIPEDFFDFDKKKDSLTIEDLKKMLYEEIMKPL

SEQ ID NO: 353 - protein, 564 aa, Xanthomonas campestris
MCSIFGIFGLQPGDDLQALRRQALECSQRQRHRGPDWSGVYVDTGAILVHERLAIVDPAGGSQPLLSDDGQLALAVNGEIYNHRELKAELLQPYAFQTGSDCEVINALYREDTPASYLNRLNGIFAFALWDKTEGRVIIARDPIGVVPLYWGHDREGRLRVASELKSLVDDCADAAQFPPGHWYDSATGALSRYYERAWRHYDAVEGVQVQLQELREAFERAVHRQLMTDVPYGVLLSGGLDSSLVAAVAARYARHRIEENDTTEAWWPRLHSFAIGLKGSPDLAAAEVAAAALGTVHHGFEYTFDEGLDALPDVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDARFKMIDKTSGGAARMEKGVLREAFAGYLPESILWRQKEQFSDGVGYGWIDGLKAHAQAQVSDRELAAADRRYPVNPPQTKEAYFYRSLFEQFFPGQAAAETVPGGKSIACSSPTAIAWDASFAAMADPSGRAIAGVHAQALAS

SEQ ID NO: 354 - protein, 368 aa, Shewanella oneidensis
MKKPPIIWLNVILFSLTFLSAVILVPWYGIVYGYGASEWIAFVVLAFASGLSITAGYHRLWSHKAYKTHPAIRFLYALGGALALQNSALHWASDHRVHHKHVDDNDKDPYSAKMGFWYSHIGWMLREYQAQRYHDYQNVRDLQNDRIVMWQHKHYLTLVLLMNIGLPALLGWFTGNIAGMLLMAGLLRLVVVHHCTFFINSLAHVWGCQPYTDKNTARDNGFLAVLTYGEGYHNFHHIFENDYRNGIKWWHYDPTKWLIKSLSWVGLAKDLRTSPQERIESARLQMQLLHAKNKVLNLPNADEIIEKIQQEYELMKQHLLEYYQAQKTLLEAKRKQLVDQQLLQQVEELKTRFLNQQKSWKSLTATYS

SEQ ID NO: 355 - protein, 229 aa, Arabidopsis thaliana
MAQQSLIYSFVARGTVILVEFTDFKGNFTSIAAQCLQKLPSSNNKFTYNCDGHTFNYLVENGFSESKYCSISYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIILSICGGFNCGK

SEQ ID NO: 356 - protein, 193 aa, Oryza sativa
MSKYGTIPTSSSSDGPPPGSSSSSPLDFISRAKARGATALAERRPWRELADPRAASVPRGLGGAYRRARANLGHFSMNYAIVVLAVVFLSLLWHPVSLIVFLACMVAWLFLYFLRDEPLALCGRAVGEGAVLAVLSVLTLVLLLLTGATVNILTSLLVGVVIVLLHAVFHRPADSIDEEAGRYYTPVPPQPSY

SEQ ID NO: 357 - protein, 78 aa, Gossypium barbadense
RIMKKALPANAKIAKDAKETVQECVSEFISFITSEASDKCQKEKRKTINGDDLLWAMATLGFEDYIDPLKIYLTKYRE

SEQ ID NO: 358 - protein, 162 aa, Zea mays
MAAVSSTSTASSYFSPQPQLPISTADPAASKSRLMRQPRRSSSFVMVEASSASGSDGGVARTKSLTEDDLEELKGCLDLGFGFAYSEIPELCGTLPALELCYSMTRRFLDEQKAPGQEEELEPASPPLPNWRISGPGDDPEEVKARLKYWAQAVACTVKLCS

SEQ ID NO: 359 - protein, 309 aa, Yarrowia lipolytica
MTSIDFTMNNGKTIPAIGLGTWKSTTEEVAGAVECALTEGGYRHIDTAFNYRNEDAVGLGIKRAMEKGVKREDIFVTTKIWVTYHDRVEENLNMSLERLGLDYVDMLLIHWPVPLNPNGNDPVYPLRPDGSRDIDESGSQPKTWKQMEAVLKTGKTKSIGVSNFSIPYLQELLKEATVVPAVNQVELHPLLPQLELMEFCKKNNIIMTAFSPFGSVGGPLLKNELVLKLADKYETSPGGILTSYHIGNGTVVIPKSVTNSRIIENGKSAVNLSKEDLQALNDLHKTEGIHRTSKPKWGVDLGFPDFDFC

SEQ ID NO: 360 - protein, 385 aa, Thiobacillus denitrificans
MDLPWWGLVLVTLGLTHVTIAAVTIYLHRSQAHRSVDLHPVVSHFFRFWLWLTSGMVTREWVSIHRKHHAKCETPEDPHSPQTRGLKKVFWEGSELYRAEAKVAETLEKYSHGTPDDWVERNVYSRHSAKGIFLMMAIDLALFGPIGLTIWAVQMAWIPITAAGIINGVGHYWGYRNFACEDASTNILPWGILIGGEELHNNHHAYGTSARLSNKWYEFDIGWLYIKLMSYAGLATVRKVAPTVKWQAPKPLCDLDTLQAIITHRYDVMSRFVKSVRAESAAEIAKLRAGANLPQNWNFDSFRRWLHKEPAELAADDRAALDTLLGRSERLQTVYRMRQELAAIWGRSTASREQLLEQLQAWCKRAEESGIQSLRDFSVRLRCYA

SEQ ID NO: 361 - protein, 503 aa, Zea mays
  misc_feature (242)..(242): Xaa can be any naturally occurring amino acid
MEGAGRDANPLSGYRIGKTLGIGSFGKVKIAEHILTGHKVAIKILNRKKIRSMDMEEKVKREIKILRLFMHPHIIRLYEVIDTPADICVVMEYVKSGELFDYIVEKGRLHEEEARHFFQQIISGVEYCHRNMVAHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPSARDXFPRMLVVDPMKRITIREIREHVWFKIRLPRYLAVPPPDTAQQVKKVDEETLNDVIKMGWDKNQLIESLQNRKENEATVAYYLLLDNRLRTTSGYLGSEFQESMDSSFSQVIAETPTSATELRQHGFSESPGSGLRQHFAAERKWALGLQSRAHPREIISEVLKALQELNVYWKKIGHYNMKCRWSPGCLESMMHNSDSFSAESAIIETDVFMEKSTPTVKFEIQLYKTRDEKYLLDLQRVSGSHLLFLDLCSAFLTQLRVL

SEQ ID NO: 362 - protein, 338 aa, Yarrowia lipolytica
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKDYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYLLK

SEQ ID NO: 363 - protein, 421 aa, Dianthus caryophyllus
AKLSASICTAEGIDEFQDTAIFQDYHGLPQFRKAVAKFVEKVRGEKVKYDESRIVMSGGATGAHELMTFCLADPGDAFLVPTPYYPGFDRDLRWRTGVQLVPVLCHSSDNFRITTSALQDAYERAQEAKIKVKGLLITNPSNPLGTVLDKETLINILEFTNEKNIHLICDEIYGATVFGEQKFISISEVIIDQPHNPDLVHIVYSLSKDLGFPGFRVGIVYSYNDNVVNCARKMSSFGLVSTQTQRLIACMLSDEEFVERFLEESRKRLENRHRVFTWGLSQVGIKCLRSNAGLFVWMDLRHPLQDPTIEGELALWRVIINEVKINVSPGSSFHCSEPGWFRVCIANMNDETMEVALRRIRSFVLQKKDAATCVTSSKRKCWQTNLQLRLSNRRLEDFIGISQIGSPSSPLPQSPLVLART

SEQ ID NO: 364 - protein, 212 aa, Haemophilus influenzae
MNIEIIPVTAFQQNCSLIWDDEKNAAIIDPGGEAERLIQRIEELDLNLKVLLLTHGHLDHVGAAMQLKQHFGVEIWGSNEKDKFLFESLPEQAQRFGLPNIDAFLPDRWFNQEGEILKLDGFNFEILHLPGHTPGHIGFIEHEKKVAFTGDVLFQGGIGRTDFPRGDYETLISSIRTKLLPLNDDIIIIAGHGSYTTIGQEKRSNPFLNSKS

SEQ ID NO: 365 - protein, 305 aa, Helianthus annuus
MPSQSDLDRQIEHLMDCKPLPEEVRTLCDQARTILVEEWNVQPVKCPVTVCGDIHGQFHDLLELFRIGGSAPDTNYLFMGDYVDRGYYSVETVTLLVALKVRYRDRITILRGNHESRQITQVYGFFDECLRKYGNANVWKHFTDLFDYLPLTALIESQIFCLHGGLSPSLDTLDNIRALDRIQEVPHEGPMCDLLWSDPDDRCGWGISPRGAGYTFGQDIAAQFNHTNGLSLISRAHQLVMEGYNWSQENNVVTIFSAPNYCYRCGNMAAILEVGENMDQNFLQFDPAPRQVEPDVARRTPDYFL

SEQ ID NO: 366 - protein, 503 aa, Micrococcus luteus
MEHQKTTPHATGSTRQNGAPAVSDRQSLTVGSEGPIVLHDTHLLETHQHFNRMNIPERRPHAKGSGAFGEFEVTEDVSKYTKALVFQPGTKTETLLRFSTVAGELGSPDTWRDVRGFALRFYTEEGNYDLVGNNTPIFFLRDPMKFTHFIRSQKRLPDSGLRDATMQWDFWTNNPESAHQVTYLMGPRGLPRTWREMNGYGSHTYLWVNAQGEKHWVKYHFISQQGVHNLSNDEATKIAGENADFHRQDLFESIAKGDHPKWDLYIQAIPYEEGKTYRFNPFDLTKTISQKDYPRIKVGTLTLNRNPENHFAQIESAAFSPSNTVPGIGLSPDRMLLGRAFAYHDAQLYRVGAHVNQLPVNRPKNAVHNYAFEGQMWYDHTGDRSTYVPNSNGDSWSDETGPVDDGWEADGTLTREAQALRADDDDFGQAGTLVREVFSDQERDDFVETVAGALKGVRQDVQARAFEYWKNVDATIGQRIEDEVKRHEGDGIPGVEAGGEARM

SEQ ID NO: 367 - protein, 532 aa, Arabidopsis thaliana
AKGLVDHSRRQHHHKSPSFLSPQPRPLASSPPALSRFFSSTSEMSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIAAGIEARDGFPADPNDIFLTDGASPAVHMMMQLLLSSEKDGILSPIPQYPLYSASIALHGGSLVPYYLDEATGWGLEISDLEKQLEEARSKGISVRALVVINPGNPTGQVLAEENQRDIVNFCKQEGLVLLADEVYQENVYVPDKKFHSFKKVARSLGYGEKDISLVSFQSVSKGYYGECGKRGGYMEVTGFTSDVREQIYKMASVNLCSNISGQILASLVMSPPKPGDDSYDSYMAERDGILSSMAKRAKTLEDALNSLEGVTCNRAEGAMYLFPRINLPQKAIEAAEAEKTAPDAFYCKRLLNATGVVVVPGSGFGQVPGTWHFRCTILPQEDKIPAIVNRLTEFHKSFMDEFRN

SEQ ID NO: 368 - protein, 695 aa, Haemophilus influenzae
MVMKFKMSKNVICYTWLSVCLSSAIPAFAVQPTLKPSDISIPAISEESQLATKRATTRLTQSHYRKIKLDDDFSEKIFDRYIKNLDFNHNTFLQSDIDELRQKYGTKLDEQLNQGDLSAAFDIYDVMMKRRYERYTYALSLLDKEPDLNGQDQIEIDREKAAAPQTEADANKLWDARVKNDIINLKLKDKKWSEIKAKLTKRYNLAIRRLTQTKADDIVQIYLNAFAREIDPHTSYLSPRTAKSFNESINLSLEGIGTTLQSEDDEISIKSLVPGAPAERSKKLHPGDKIIGVGQATGDIEDVVGWRLEDLVEKIKGKKGTKVRLEIEPAKGGKSRIITLVRDKVRIEDQAAKLTFEKVSGKNIAVIKIPSFYIGLTEDVKKLLVKLENQKAEALIVDLRENGGGALTEAVALSGLFITDGPVVQVRDAYQRIRVHEDDDATQQYKGLLFVMINRYSASASEIFAAAMQDYRRGIIIGQNTFGKGTVQQSRSLNFIYDLDQSPLGVLQYTIQKFYRVNGGSTQLKGVAADINFPEIIDAKEYGEDKEDNALAWDKIPSASYMEVGNINYIDNAVNILNEKHLARIAKDPEFVALNEELKVRNERRDRKFLSLNYKMRKAENDKDDARRLKDLNERFKREGKKALKDIDDLPKDYEAPDFFLKEAEKIAADFVIFNSDQKINQANGLSEAKTESKK

SEQ ID NO: 369 - protein, 548 aa, Buchnera aphidicola
MAAKDEKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGVVELENPYILMADKKISNVREMLPILESVAKSGKPLLIISEDLEGEALATLVVNSMRGIVKVAAVKAPGFGDRRKAMLQDISVLTGGSVISEELAMDLEKSTLEDLGQAKRVVINKDTTTIIGGVGEKQAIQSRISQIRQEIQEATSDYDKEKLNERLAKLSGGVAVLKVGAATEVEMKEKKARVEDALHATRAAVEEGVVAGGGVALVRVAGKISNLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKTSDASSSPAGGMGGMGGMM

SEQ ID NO: 370 - protein, 144 aa, Brassica napus
  misc_feature (44)..(44): Xaa can be any naturally occurring amino acid
SNRSVPTPTMISCCAKFNAPVKPRSKRRRRQDLRILWTGTDEQXGGGGGSQKRRITSVAAAAMGSKCQHCGADKTPQWRAGPSGPKTLCNACGVRYKSGRLVPEYRPANSPTFSPEFHSNSHRKIVEMRKHVVSSDGGGRQDCG

SEQ ID NO: 371 - protein, 671 aa, Hypocrea jecorina
MARADQPQDKTKTEQRIGAYTVVRTLGEGSFGKVRLAIHNGTGQKVALKIITRKKLISRDMAGRVEREIEYLQLLRHPHIIKLYTVIKTPSEIIMVLEYAGGELFDYIVQNGRMKEAEARRFFQQMICAVEYCHRHKIVHRDLKPENLLLDENLNVKIADFGLSNIMTDGNFLKTSCGSPNYAAPEVIGGKLYAGSEVDVWSCGVILYVLLVGRLPFDDEHIPSLFAKIARGTYSMPQWMPPGAAALIKGMLVVNPVQRMTIDEIRADPWFNTDLPAYLQPPVEEFFNTGVDPNKAIKKSDIAPNAPEKVQEKLHNEVTEKISKTMGYGKDDVEEALQSDEPSAIKDAYMIVRENKLMLANNPDAGLTGDEGSPMMSISSTRSAISPGGASPRPYVTKIGILPSSLPAYHKDYMEREKNGTGHDPVTPAITINDELPVTRTEVEKEEAARRLNPHSRSALRLDESSKRPQGMTPITAPVKKPKPVRWQFGIRSRNAPWEALLCIHKALNKLGASHLRDEGYDEAQRRGVEDATSRDSSFANGAPLERDPNGHDKDPTKRYKLPADPWHIQVRWPSTSMQAGADRRDELGSKAGSPDSFVYTRGDAASRKDFVALHMDIQIYEMEQGVYLVDFKCSGYETQDGRLLEEKEVTSPFPFLDRAAKLIMQLAEAD

SEQ ID NO: 372 - protein, 383 aa, Cryptococcus neoformans
MPVVRFPTLAEPVSLGALQLNTRVIMASLTRNRSIPTTVPNEDNVKYYAQRAGPGRSGLILSEGTLIAHQGTEWENAPGIWDEEHANGWKKVTDAVHDKGGLIVAQLWHTGRVCHPDMIEQKRSGDPVWAPSDVGARGGKFRTLPGKPGYISDPTPIPDPTYILDQYSKAAEMAKLAGFDGVELHSANGYLIEQFLSDVSNTRTDKWGGSVENRIRFGLEAAKRLIDVWGADRVGVKISPCGGYNDTYNTTGDSRLETFKTYISRLDSLGLAYIQLMVAVLGDDHHGGKPQGFPHDIIGTYGPLIKKSKLVVNGNYTPESGEEVVKSGKAAAVVYGRNYVANPDFVKRIQQGLPLAEINMKGLYTPAVEGQNGSGYNDYPDAE

SEQ ID NO: 373 - protein, 367 aa, Pseudomonas syringae
MSVEALFTPFRLGSLELSSRVVMAPMTRSFSPGHVPNSKVIEYYRRRAAAGVGLIVTEGTTVNHKASNGYPNVPQFFGDAPLAGWRKVVEAVHAEGGKIVPQLWHVGAVRRPGTEPDGSVPAYGPMEKVKDGQVLVHGMSKQDIDDVVAAFAQAAVDAKAIGMDGVEIHGAHGYLIDQFFWEGSNQRSDEYGGSLAKRSRFAIELIKAVRVAVGADYPIIFRFSQWKQQDYTARLVQTPEALGEFLQPLADAGVDIFHCSTRRFWEPEFEGSDLNLAGWTRKLTGKPTITVGSVGLDGEFLQFMVNTDKVAQPASLENLLKRLGNDEFDLVAVGRALLVDPDWALKVREGREQDILPFSREALTTLV

SEQ ID NO: 374 - protein, 369 aa, Pyrococcus horikoshii
MEEVEKEGKKKRNRAFKGNGHDSHRGYYMITIDGSYGEGGGQILRTSVALSTITGEPVRIVNIRANRPNPGLRPQHLHAILALKHLANAEVKGAHVGSRELVFIPKKLEAKEISIDIGTAGSITLVLQALLPAMVFAREKVKFRITGGTDVSWSPPVDYLSNVTLFALEKIGIHGEIRVIRRGHYPKGGGIVEGYVEPWNEKRELVAKEYSRIIKIEGISHATNLPSHVAERQARAAKDELLQLKVPIEIRTEISRSIGPGSGIVVWAETDCLRLGGDALGKKGKPAEIVGKEAAQELLDQLKPGHCVDKFLGDQLIPFLAFSGGVIWVSEITNHLKTNIWVVESFLGRIFDVDGNVGEPGKIRVIRRV

SEQ ID NO: 375 - protein, 247 aa, Ipomoea nil
MGRGRVQLKRIENKINRQVTFSKRRTGLLKKAHEISVLCDAEVALIVFSTKGKLFEYATESCMEKILERYERYSYAERQLNSTDQNSQGSWTLEHAKLKARMEVLQRNQRHYEGEDLDSLSLKELQNLERNLIQHSNIRSKRNQLMYESILCSEKDKHCRTKYQLSKKIKEREKEMATQQQQQQEVQWEQPNDDINSSYVVPPPLVHLSSEGEYQGEGEYGETEGTQRQQQNNTSAMPQWMLSHLQG

SEQ ID NO: 376 - protein, 469 aa, Lactobacillus plantarum
MAMLYGKHNHEAEEYLEPVFGAPSEQHDLPKYRLPKHSLSPREADRLVRDELLDEGNSRLNLATFCQTYMEPEAVELMKDTLAKNAIDKSEYPRTAEIENRCVNIIANLWHAPDDEHFTGTSTIGSSEACMLGGLAMKFAWRKRAQAAGLDLNAHRPNLVISAGYQVCWEKFCVYWDVDMHVVPMDEQHMALDVNHVLDYVDEYTIGIVGIMGITYTGQYDDLAALDKVVTHYNHQHPKLPVYIHVDAASGGFYTPFIEPQLIWDFRLANVVSINASGHKYGLVYPGVGWVVWRDRQFLPPELVFKVSYLGGELPTMAINFSHSAAQLIGQYYNFIRFGMDGYREIQTKTHDVARYLAAALDKVGEFKMINNGHQLPLICYQLASREDREWTLYDLSDRLLMNGWQVPTYPLPANLEQQVIQRIVVRADFGMNMAHDFMDDLTKAVHDLNHAHIVYHHDAAPKKYGFTH

SEQ ID NO: 377 - protein, 153 aa, Zea mays
MSLVRRSSVFDPFSVDLFDPFDSMFRSIVPSSSSAAASETAAFASARIDWKETPEAHVFKADLPGVKKEEVKVEVEDGNVLLISGQRSREEEDKGDKWHRVERSSGQFVRRFRLPENAKTEEVRAALENGVLTVTVPKAEVKKPEVKSIQISG

SEQ ID NO: 378 - protein, 57 aa, Perilla frutescens
MGRGRVQLKRIENKINRQVTFSKRRAGLLKKAHEISVLCDAEVALIVFSHKGKLFEY

SEQ ID NO: 379 - protein, 458 aa, Sinorhizobium meliloti
MMIEAKKLAARFPGDFVFGVATASFQIEGASKADGRKASIWDAFSNMPGRVYGRHNGDVACDHYNRLEQDLDLIKSLGVEAYRFSIAWPRIVPEGTGPINEKGLDFYDRLVDGLKARGIKAFATLYHWDLPLALMGDGGWTARTTAYAYQRYAKTVIARLGDRLDAVATFNEPWCSVWLGHLYGVHAPGERNMDAALAALHFTNLAHGLGVAAIRSERPELPVGIVINAHSVYPGSNSAEDKAAAERAFDFHNGVFFDPIFKGEYPEDFLSALGERMPAIEDGDMATIAQPLDWWGLNYYTPMRVSADPAKGAEYPATVNAKPVSNVKTDIGWEVYAPALGSLVETLNARYRLPDCYITENGACYNMGVENGTVDDQPRLDYISDHLAVTADLIAKGYPMRGYFAWSLMDNFEWAEGYRMRFGIVHVDYETQVRTIKKSGRWYKDLAERFPSGNHKPG

SEQ ID NO: 380 - protein, 541 aa, Arabidopsis thaliana
RFVIGQAKNLIDQSRRRQLHHHKNLSFVSLIPPFSAPSDSSSRHLSSSSSSDMSASDSSSSLPVTLDTINPKVIKCEYAVRGEIVNIAQKLQEDLKTNKDAYPFDEIIYCNIGNPQSLGQQPITFFREVLALCSYTALLDESATHGLFSSDSIERAWKILDQIPGRATGAYSHSQGIKGLRDAIADGIEARDGFPADPNDIFMTDGASPGVHMMMQLLITSEKDGILCPIPQYPLYSASIALHGGTLVPYYLDEASGWGLEISELKKQLEDARSKGITVRALAVINPGNPTGQVLSEENQRDVVKFCKQEGLVLLADEVYQENVYVPDKKFHSFKKVARSMGYGEKDLALVSFQSVSKGYYGECGKRGGYMEVTGFTSDVREQIYKMASVNLCSNISGQILASLIMSPPKPGDDSYESYIAEKDGILSSLARRAKTLEEALNKLEGVTCNRAEGAMYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 381 - protein, 245 aa, Capsicum annuum
MGRGRVELKRIENKINRQVTFAKRRNGLLKKAYELSVLCDAEVALIIFSNRGKLYEFCSTSSMVKTIEKYQRCSYATLEANQSATDTQNNYHEYLRLKARVELLQRSQRNFLGEDLGTLSTKDLEQLENQLESSLKQIRSRKTQFMLDQLADLQQREQMLAESNRLLRRKLEESTAGFPVRLSWEDGADQAMHQHNRLPHTEGFLQPLGLHSSPPHFGYNPVNTDEVNAAATAHNMNGFIHGWML

SEQ ID NO: 382 - protein, 397 aa, Kluyveromyces lactis
MLFIRQLSVIPKAPAFAKFFHTAGLVRQKLSDPNHLAILLQKNLAQRNSSLYNPELETIRCTIFDRHGNMQKPSIDLRRDELIHTHGLLPRDLRKVEKSRRNDLVPSVLVRENSILVSILNIRALVKSDMLILFDSMGIKLDSVSQQNFIADLQLRLQNRSGFEVPDVVNKDPLPYEFRAVESIFISAISNLNAELKVHLNVSTGILQDLEYSITRDKLRYLLIQNKKLSVFHKKSFLMREMIEELLEQDDVLCEMYLTEKQLGKPREEHDHAEIEMLLETYYNHVDEIVQTVGNTMSNIKTTEEIINIILDSNRNQLMLLGLRFSIGLLSLAGSIFIASIYGMNLENFIEEGNVGFPVVSTLGVILMAYLFAFSVKHLHKLEKVQLMSHGKSSTLK

SEQ ID NO: 383 - protein, 252 aa, Arabidopsis thaliana
TAYQSELGGDSSPLRKSGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQSQPFDSRNYFQVAALQPNNHHYSSAGRQDQTALQLV

SEQ ID NO: 384 - protein, 512 aa, Mortierella alpina
MGSLTSPTMRTTRSSSGKSSSMKTSLSAISSSSSSNSDCSDSEAVERLSISSAASVTSLEDSSSPVIAKHIKAIPKITTKNDFSVLYEPWTIGNFYKKLDWVHMLGLVFMPIYGFYMAFTSVPLQQKTAIFAVAYYFFTGLGITAGYHRLWSHRAYAAGPALQFILMIASTGAMQGSIRWWCRNHRAHHRYTDTEKDPYGAQKGLIWSHILWMLVRQDPTTVGWADVADLKANKLVRFQHDHFLWLAPLISLGLPTMVAGFGWGDYWGGFIYGGIIRQVVVHHATFCVNSLAHWLGDMPFDDRHTPRDHILTALVTLGEGYHNFHHEFPQDYRNAIRFYQYDPTKWLIAFCAFLGLASDLKRFPTNEIKKGEVRMQQQKLDRVKAGLIWGTPIDQLPVFTYEEFEALATEKGQAVTLIEGIIYDIEAFVDEHPGGRSLIKGAIGKDATTSFNGGVYDHSNAARHLLERMRVGVVAGGGFVEHRKSSTAPKQLSTIPLGSYPPASIPVVSRTA

SEQ ID NO: 385 - protein, 401 aa, Triticum aestivum
  misc_feature (226)..(226): Xaa can be any naturally occurring amino acid
  misc_feature (336)..(336): Xaa can be any naturally occurring amino acid
  misc_feature (385)..(385): Xaa can be any naturally occurring amino acid
VTLPEQVLYKKAGCYRSGIPGISSTHASAERGSNALLARAWSPGWQNADKAFTAFINGPLIDYSVNRKKADSANTSLLSPYLHFGELSVRKVFHQVRMKQLTWSNESNGDGEEGCSLFLRSIGLREYSRYLAFNHPCSHEKPLLAHLRFFPWVVNEVYFKVWRQGRTGYPLVDAGMRELWATGWLHDRIRVVVSSFFVKVLQLPWRWGMKYFWDTLLDADLESDAXLGWQYISGSLPDGRELDRIDNPQFEGYKFDPYGEYVRRWLPELARLPTEWIHHPWDAPESVLQAAGIELGSNYPLPIVELDEAKSRLQDALSEMWELEAASRAEIENGMXEEGLGDSSDEPPIAFPQELQHMEVDRATIHTPAMAGRRRADQMVPSITXSFFRAETETELSAAFE

SEQ ID NO: 386 - protein, 718 aa, Oryza sativa
MSASPSSMSGAGAGEAGVRTVVWFRRDLRVEDNPALAAAARAAGEVVPVYVWAPEEDGPYYPGRVSRWWLSQSLKHLDASLRRLGASRLVTRRSADAVVALIELVRSIGATHLFFNHLYDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSLTTGWEVEN

SEQ ID NO: 387 - protein, 150 aa, Oryza sativa
MSLVRRSNVFDPFSLDLWDPFDSVFRSVVPATSDNDTAAFANARIDWKETPESHVFKADLPGVKKEEVKVEVEEGNVLVISGQRSKEKEDKNDKWHRVERSSGQFMRRFRLPENAKVDQVKAGMENGVLTVTVPKAEVKKPEVKAIEISG

SEQ ID NO: 388 - protein, 548 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGVVELENPYILMADKKISNVREMLPILESVAKSGKPLLIISEDLEGEALATLVVNSTRGIVKVAAVKAPGFGDRRKAMLQDISVLTGGSVISEELAMDLEKSTLEDLGQAKRVVINKDTTTIIGGVGEKQAIQSRISQIPQEIQEATSDYDKEKLNERLAKLSGGVAGLKVSAATEVEMKEKKARVEDALHATRAAVEEGVVAGGGVALVRVAGKISNLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKTSDASSSPAGGMGGMGGMM

SEQ ID NO: 389 - protein, 646 aa, Xanthomonas axonopodis
MCGLAGMLLASPRLHGEQLDALVRPMGAALRHRGPDDAGTWCDAQAGVALAHQRLSILDLSPLGHQPMRSADGRYVLAYNGEVYNFAQLRAALSALGHRFRGHSDTEVLLAAVVEWGLDETLTRCNGMFAIALWDERDNCLFLARDRVGKKPLYYGWAGDTLVFGSELKALWQHPDFDNGVDRDALTLLLRLGYIPAPACIHEHTFKLMPGRVLRIDAQAVAAGAAAHRPDQAQQPFWNAREAMQRALATPFTGTDAQAEEQLDRVLRDAVALRMVADVPVGVFLSGGTDSSIVTAMMQAQSAQPVHTFSIGFEGSHHDEAPLAREVATHLCTDHTELYVSGADALAVVPNLPDMFDEPFADASQVPTALVARLARGGVTVALSGDGGDELFFGYGRYQRALRNWRMHGLVPGPLRRLMAVAARRNGESSRTGGLAALVAEAGARGIGDIYRNRISRWRDPAAVVLGATEPDSFYSLADPLHGSGTPADAMMLADFAAYLPDDLLCKVDRTTMAVGLEARAPLLDWRVAEFAWSLPLSLKYRDGVSKYLLKRVLCRYLPDAMVYRGKRGFGAPVSAWLRGDLHGWADDLLAHGALQREGVFAADSVARLWRDFNGGERKWHTHLWTVLMFQAWQAHWREQRAAVVR

SEQ ID NO: 390 - protein, 437 aa, Arabidopsis thaliana
MANDYVSTVLLLLSLLIFLSQRTDSASIVKSLPGFDGPLPFELETGYIGVGEEEEVQLFYYFIKSERNPQEDPLLLWLSGGPGCSSISGLLYENGPVNVKIEVYNGTLPSLVSTTYSWTKVSSIIYLDQPVGTGFSYSRTKLVNKPSDSGEAKRIHEFLHKWLGKHQEFSSNPFYVGGDSYCGMVIPALVQEISKGNYVCCKPPINLQGYILGNPSTENEVDINYRIPYAHGMALISDELYESMKRICKGKYENVDPRNTKCLKLVGEYQKCTKRINKALIITPECVDTSPDCYMYRYLLTTYWANDENVQRALHVNKGSIGEWVRCYFEIPYNHDIKSSVPYHMNNSIDGYASLIFSGDHDMEVPYLGTQAWIRSLNYSLIDDWRPWMIGDQIAGYTRTYANKMAFATIKGGGHTPEYKPEESYIMFQRWISGQPL

SEQ ID NO: 391 - protein, 714 aa, Cryptococcus neoformans
MAQMLNQAVTAVTGDAKYRQMAENTIEQTSKTPLTTYFGVKVPETDVALRAGARGPTLLEDFHNREKIQHFDHERIPERVVHARGSAAHGEFKLHTPLTGITTAKVLTDTSKVVPAYVRFSTVVGSRGSADTVRDVRGFATRFYTDEGNWDLVGNNIPVFFIQDAIKFPDVIHALKPEPHNEMPQAQTAHDNAWDFISLHQQATHMQQWVTSDRAIPRSYRMMQGFGVHTFRLINEEGKSTFVKYHWIPHLGIHSLVWDEALKIAGQDPDFHRRDLWDAIEAKAYPKWELGVQLIKEEDEHKFDFDILDSTKIIPEELVPVQKIGTLTLTRNPVDFFAEVEQVAFCTQHIVPGMDFTDDPLLAGRNFSYADTQISRLGANWHDLPINRPICPVMTNFRDGQMSMFSKTNRTPYHPNRHDSLPLTSSNNGGFQSYREKISGVKERLNGPKFQEFYSQATLFWNSMSETEREHIIAAYNFELSHCAEDIVIQNVINSLNEIDHGLATSVHATFPHLTLPEAKPTHNKKSEYLSQINGKHQVFTASGRRIGIYLVPGYTYSQVVPLLAAFEADGCMVKFIGPTLGPIKASNGQSFTAEFTFEGCRTTFFDAIVFVGGPDDSFIAKLKIGRLIHAAREAYMHLKPIGVLGNATQWMVNTCLPGDFSEKTKTESSVVVENGVVFAPGDPTLHSIKFAKQFLEGVAHHRVWDRQVAHIAA

SEQ ID NO: 392 - protein, 268 aa, Brassica napus
  misc_feature (213)..(213): Xaa can be any naturally occurring amino acid
IPGVDPRRPNKDVIRKKVYVCPEPNCVHHHPSRALGDLTGIKKHFFRKHGEKKWKCDKCSKKYAVQSDWKAHAKTCGTKEYKCDCGTLFSRRDSFITHRAFCDALAEESARAIPNPILIQSSSPHQTQHNINFSSSSQNITSHNNNPHGHDELPMKQEEPHHHFHNIPPWLISSNPNPNGNNANYFPLASSSANFHHPSPAMSATALLQKAAXMGPSKSTTTPEEDEKSSYNKLITTTMAASMMTSPSEPGFGFQDYYMMNHHAHHHD

SEQ ID NO: 393 - protein, 481 aa, Glycine max
MPPKPLDYGSINENVKKSQYAVRGELYLRASELQKEGKKIIFTNVGNPHALGQKPLSFPRQVVALCQAPFLLDDPNVGLLFPADAIARAKHYLSLTSGGLGAYSDSRGLPGVRKEVAEFILRRDGYPTDPELIYLTDGASKGVMQILNTIIRGQDDGILVPVPQYPLYSATIALLGGTLVPYYLEETANWGLDVNELRQSVEQARFKGITVKAMVIINPGNPTGQCLSEANLREVLQFCYQENLALLGDEVYQTNIYQDERPFISSRKVLMDLGPPISKEVQLISFHSVSKGYYGECGQRGGYFEMTNIPPETVDEIYKVASISLSPNVPAQIFMGVMLHPPQPGDISYDKFVRESTGILESLRRRARLMTDGFNSCRNVVCNFTEGAMYSFPQIRLPPRALEAAKQAAKVPDVFYCLKLLEATGISTVPGSGFGQREGVFHLRTTILPDEEDMPAIMDSFKKFNDEFMEQYEDNRGYSRL

SEQ ID NO: 394 - protein, 57 aa, Perilla frutescens
MGRGRVQLKRIENKINRQVTFSKRRSGLLKKAHEISILCDADVGLIVFSTKGKLFEY

SEQ ID NO: 395 - protein, 536 aa, Deinococcus radiodurans
MSDENNKGVGTAVQGVGGPRDGRTAPGEQGTTLTTRQGHPVHDNQNSRTVGSRGPMTLENYQFIEKLSHFDRERIPERVVHARGVGAHGVFRATGKVGDEPVSKYTRAKLFQEDGKETPVFVRFSTVGHGTHSPETLRDPRGFAVKFYTEDGNWDLVGNNLKIFFIRDALKFPDLIHSQKPSPTTNIQSQERIFDFFAGSPEATHMITLLYSPWGIPASYRFMQGSGVNTYKWVNDQGEGVLVKYHWEPVQGVRNLTQMQADEVQATNFNHATQDLHDAIERGDFPQWDLFVQIMEDGEHPELDFDPLDDTKIWPREQFPWRHVGQMTLNRNPENVFAETEQAAFGTGVLVDGLDFSDDKMLQGRTFSYSDTQRYRVGPNYLQLPINAPKKHVATNQRDGQMAYRVDTFEGQDQRVNYEPSLLSGPKEAPRRAPEHTPRVEGNLVRAAIERPNPFGQAGMQYRNFADWERDELVSNLSGALAGVDKRIQDKMLEYFTAADADYGQRVREGIQAKEAEMKGQKQEAPVYGTEASSLY

SEQ ID NO: 396 - protein, 126 aa, Zea mays
  misc_feature (92)..(92): Xaa can be any naturally occurring amino acid
MSLATAKDVVGRKIFVVFYMTSDGSDIEHINAQNDGHTDSAHDRHGAPVEGKITHHRVKLQHDVNRHDKALCTHYINVADSIHAYMYEDLLXIVSLQYQTIHIRQILDTCNLVEVHNIGACWREDD

SEQ ID NO: 397 - protein, 1400 aa, Unknown
  Frankia sp. EAN1pec
MSADASPDRQQFPASAGDSGGPPAGATATLPVNGTGTGAATGPGGGTDALLSSLLTGLDRLVDGEFGVRLPIGDGVGGDVARRFNELAGMQERHAREVSRVSKVIRRDGRLTLRMDDLGGSGGWDELTLSVNSLIDDLARPTHEVARVIAAVAEGDLSQQMALEIAGQPVRGEFLRIGTTVNTMVDQLSSFADEVTRVAKEVGTEGNLGGQAKVMGVSGVWRDLTESVNSMAGNLTSQVRNIAQVTTAVAQGDLSQKITVDARGEIHELKSTVNTMVDQLSAFADEVTRMAKEVGTEGKLGGQAQVKGVSGVWRDLTDSVNVMAGNLTTQVRSIAEVAAAVARGDLTRQITVDARGEVAGLAHTLNTMVDQLSSFADEVTRVAWEVGTEGNLGGQAHVRGVSGVWRDLTESVNSMAGNLTSQVRNIALVATAVARGDLSQKITVTAQGEILELKETLNTMVDQLSSFADEVTRVAKEVGTEGNLGGQAHVRGVSGVWRDLTESVNSMAGNLTSQVRNISAVTRAVARGDLSQKITVTAQGEIAELKDTVNTMVDQLSSFAAEITRVGREVGVEGKLGGQATVAGVAGTWKDLTDNVNQLASTLTIQLRAIGDVSTAVTRGDLTRSITVEAEGEVAELKDNINQMIARLRETTEVNAQQDWLKSNLALIGSKMQGQRDLYTVCQMIISEMTPAVNAQQGTVYLLDFIEGDKLRYVAGYGSVPRRRSDGTFLFGEGLIGQAALEKKRIRVEDVPAGYLNIRSGLGEAPPCDLVVVPVIFENQVLGVIELASFTPFSDLHLTLVDQLVDTIGVVLNTIMANARTEELLAQSQRLTQELRSQSVELQRTNNELEEKAALLEEKNQEIELARIGLEEKAEQLALSSQYKSEFLANMSHELRTPLNSLLILAKLLADNPDHNLSQKQIDFAETIHSAGSELLGLINDILDLSKVEAGKMNVDAGPVRTAALCDAVAGVFGPTAEEKGLTFEISVTEDVPDEFVTDEQRIQQVLKNLLSNAVKFTDAGTVRLDVAVASPDTPFVAPSLRSAPMVLSFAVTDTGIGVAAEKLRMIFEAFQQADGTTSRRYGGTGLGLSISKEIARLLGGSIAVSSQIGQGSTFTLFVPSVMPPEAPAGPHPGEPDGVLMIVDGAVQPRSRTDGGDDGRGPVLAGVERAALVPAERRPAAPESPGDAAHRESAGPAPAGTSNGAGTGRQRDGERVYGAPGRPVEPKAARRLARTSWSGRGGTDAAGDRTPAEGTPFLTDPQAPARPPTTNLDGGDPLVGASILVVDDDVRNVFALTSALEMHGMRVLYADNGHDAIRMLQQDNAPVHLVLMDVMLPGMDGNETTSEIRAMPAFAALPILVLTAKAMPGDREKSISAGASDYITKPVDLDHLLGVMRSYL

SEQ ID NO: 398 - protein, 379 aa, Solanum tuberosum
MANQTGGASSTGSRDIRGVLIHGGQYVRYNVYGSLFEVSSKYVPPIRPIGRGAYGLVCAAVNSETREEVAIKKIGNAFDNRIDAKRTLREIKLLRHLDHENIVAIKDLIRPPKKEAFNDVYIVSELMDTDLHQIIRSEQPLTNDHCQYFMYQLLRGLKYVHSANVLHRDLKPSNLFLNANCDLKIGDFGLARTTSETDFMTEYVVTRWYRAPELLLNCSEYTGAIDVWSVGCILGEIMTREPLFPGKDYVQQLRLITELLGSPDDASLQFLRSDNARRYVRQLPQYPKQQFSARFPSMSPLAVDLLEKMLVFDPTRRITVDEALCHPFLSSLHDLNDEPICPSPFSLDFDEPSITEEKIKELIWRESVKFYPDFVDQNI

SEQ ID NO: 399 - protein, 374 aa, Oryza sativa
MVNQAAMPLLTPYKQAGGKIDLSHRVLLSPMTRCRSYGNVPQPHAALYYTQRATSGGLLITEATGVSDTAQGYPETPGVWTREHVEAWKPIVDAVHRKGALFICQLWHVGRVSTNDYQPNGQAPISSSDIQITPDGSGIVYSKPRRLRVDEIPQIVDDFRLAARNAIEAGFDGVEIHGANGYLLEQFMKDSSNDRTDEYGGSLENRCRFAVEVIDAVVGEIGAHRVGIRLSPFLDFMDCVDSDPEALGSYMVEQLNKHEGFLYCHMVEPRMAIVDGRRQIQHGLLPFRKAFKGTFIAAGGYDREEGNKVIENGYTDLVSFGRLFLANPDLPKRFELDAPLNKYDRNTFYTQDPIVGYTDYPFLDEDQNNSVADA

SEQ ID NO: 400 - protein, 484 aa, Xanthomonas axonopodis
MLRSLIVCCRVRMSYAIVWFRRDLRLEDNPALRAALDAGHHPIPLYIDAPHEEGEWTPGAASRTWRHRSLAALDGALRALGSGLVIRVGNSAQVLDEVIAQTGAVAVYWNRKYEPATQPRDAQIKRDLRERGIEVQSCNCALLFEPWQLSTQQGGPYKVFTPFWRNALTQLQLPAAIGAPRSLPPLPASLKTDALDTLQLVPGLQWDQGFWEHWQPGEAGAHEMLEIFIDGALSGYRENRDRPDRVGTSQLSPHLHFGEIAPWRIANTLETHRTARNGAEIDAYIRQLGWRDFAYHLLHHFPDTTNQNLNPRFAGFDWATVDPVALQAWQRGRTGIPIVDAGMRQLWHTGWMHNRVRMIVASFLCKHLRIHWIEGARWFWDTLVDADLANNTLGWQWVAGTGADAAPYFRVFNPVTQAEKFDPQAAYITRWVPELGKLAVKERFAPWLHPLSLARLAPEYPRTPIIGLAEGRDAALAAYAKTRG

SEQ ID NO: 401 - protein, 480 aa, Arabidopsis thaliana
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQVCHYCHFLIRLKKHISKIKMFMFDIGVGAVVRETIKRRGHILAGARDSNLGVGVFG

SEQ ID NO: 402 - protein, 130 aa, Sorghum bicolor
ARVVPLVAALLVLLALAVSSTRNRNAQEGEESMALDGGIKDVPANENDLHLQELARFAVDEHNKKANALLGYEKLVKAKTQVVAGTMYYLTVEVKDGEVKKLYEAKVWEKPWENFKELQEFKPVEEGASA

SEQ ID NO: 403 - protein, 282 aa, Lactobacillus plantarum
MTVLTTMYQLANGVNIPKVAFGTWQIPGGEATYQAVRAALAAGYRHIDTALAYQNEASVGQAIRDSGIPREQIFVTTKLPAETKSYQGALNDFDRSLKNLGLDYVDLYLVHAPWPWGQVGRVYDEANLDVWQAMEAIYQSGRAKAIGVSNFAVRDLKNILNQATIPPMVNQIQYYLGFTEPKITKFSEEHAMLVEAYSPLATGGVLDNPQVQAYADKYGVSVAQLALRFVLQNGVLPLPKAVNPAHIEANTQLDFAISVADMQALNDLPDAAGSYMHNPTQG

SEQ ID NO: 404 - protein, 436 aa, Arabidopsis thaliana
MSEEQPHANLAVPAFKTEKEPITQTRNGQSSVWRFGGSDKAAKASTVTLRGVIYMLFDNCGKDVNKTILPLGHGDPSVYPCFRTCIEAEDAVVDVLRSGKGNSYGPGAGILPARRAVADYMNRDLPHKLTPEDIFLTAGCNQGIEIVFESLARPNANILLPRPGFPHYDARAAYSGLEVRKFDLLPEKEWEIDLEGIEAIADENTVAMVVINPNNPCGNVYSHDHLKKVAETARKLGIMVISDEVYDRTIFGDNPFVSMGKFASIVPVLTLAGISKGWVVPGWKIGWIALNDPEGVFETTKVLQSIKQNLDVTPDPATIIQAALPAILEKADKNFFAKKNKILKHNVDLVCDRLKDIPCVVCPKKPESCTYLLTKLELSLMDNIKDDIDFCVKLAREENLVFLPGKIMKLSSMSLDLSFDTKMGFVGNVLQGMLWV

SEQ ID NO: 405 - protein, 594 aa, Kineococcus radiotolerans
MCGLCGEVRFDGRAADVAAVQRMSETMAARGPDGEGVWAQGRVAFGHRRLSVIDLSACGAQPMQDPELGLTAVFNGCIYNYPELRAELAGHGYRFTSTSDTEVIVKGYHRWGVDVVDHLVGMFAVVLHERDSGRVVLMRDRLGIKPLYLAETPGRLRFASTLPALLAGGDVDTTIDPVALHHYLSWHAVVPAPRTVLQGVRKLPPATVRVLEADGTSREHRYWAPDHVRREEFAGFSERDWEDAVLESLRTAVRRRTVSDVPVGVLLSGGLDSSLITALLAEQGQTDLATYSIGFESVGGRGGDEFEYSDVIAERFATDHHRIRVSGDELVGALGHAVGAMSEPMVSHDVAAFDLLSQQVSQSIKVVQSGQGADEVFGGYHWYPPLAGLTPQQGVDVYARAFFDRDHAGMAQVLDPRWLTATDVSREFLAEHFARPGADTAVDAALRLDTEVMLVDDPVKRVDNTTMAWGLEARVPFLDHELVELAAAVPPELQLSGGGKGILKRVGYRVIPREVIDRPKGYFPVPAITHLEGKVLGTVKDALTSRAAQDRGLFRPEYVQGLLRDPNGELTPLRGNKLWQLGLLEMWLQQHGIG

SEQ ID NO: 406 - protein, 686 aa, Pseudomonas aeruginosa
MAFEAMFQPIQIGKLTIRNRVLSTAHAEVYATDGGMTTERYVKYYEEKAKGGIGLAICGGSSVVAIDSPQQWWSSVNLSTDRIIPHFQNLADAMHKHGAKIMIQITHMGRRSRWDGYHWPTLMSPSGIREPVHRATCKTIEVEEIWRVIGNYAQAARRAKEGGLDGVELSAVHQHMIDQFWSPRVNKRTDEWGGSFEGRMKFGLEVLKAVRAEVGEDFCVGMRICGDEFHPDGLSHEDMKQIAKYYSDTGMLDFIGVVGSGCDTHNTLANVIPNMTFPPEPFLHLAAGIKEVVDVPVLHAQNIKDPNQATRILEGGYVDMVGMTRAHIADPHLIAKIKMGQVDQIKQCVGANYCIDRQYQGLDVLCIQNAATSREYMGVPHIIEKSAGPKRKVVVVGGGPAGMEAARVAAERGHDVTLFEKKEQLGGQITTAAKAPQRDQIAGITRWYQLELARLGIDLRLGTAADPETILDLRPDVVVLANGGHPFLEQNEHWGAAEGLVVSSWDVLDGTVEPGKNVLVYDTICEFSGMSVADFLADKGAQVEIVTDDIKPGVAIGGTTFPTYYRSMYPKEVIMTGDLMLEKVYREGDKLVAVLENEYTGAREERVVDQVVVENGVRPDESLYYALKQGSRNKGQIDVEALFAIQPQPCLSQPGEGYLLFRIGDCVAQRNTHAAIYDALRLCKDF

SEQ ID NO: 407 - protein, 159 aa, Yarrowia lipolytica
MRHIIDYIDHPFRGVGDLTMSSPFLDNSLTRSPTSSQAPQLPSSFKFVPQMDLYNKPDRIRVSMSLPGVKMDDIVVEFEDEARVLSVSGETCSETDKDSLGLVINERQCGEFERRIRIPQGENIDPDHITAKLTNGVLEVVIPKIEGKPEPKKVNVDKE

SEQ ID NO: 408 - protein, 626 aa, Pediococcus pentosaceus
MCGFAGYINQANVNKDTIKSMADRIKHRGPDDEAFFQDENASMGFRRLSIIDLAHGRQPMMNSAETKVLTFNGEIYNYKQVREELKELGYEFRTDVDSEVLIHGYDAWGPELLKKLRGMFAFVIYDKEKQEVFGARDHFGIKPLYYYDDDKTFLWGSEIKSFLEHPNFVKEFNEELLPIHLSFEFIPSKETMFKNVYKLLPGTYFIHKNGKTETHTYFKFNYDHIDESQTIEEDSKKIRKIVSDSVDAHMIADVEVGSFLSSGIDSSYVLAEAAKLKPIQSFSLGFRNSKYSELSYSTEFAKEINQKNTPLYMDGDDYFDILPTIMYYMDEPLSNPSAMQLFYLSKGTRKNVKVALSGEGADEFFGGYNTYLEAFTFERYQKMVPSFIRKGLAKAVSGLPRFHGRRFLMRGAQPLSERYYRVNYVFNQQERDQILRNPALNVDSGAYTQHIFDEVKGKDEMTQMQYFDINTWLPFDILHKADRMSMANSLEVRTPLVDREVAKFAATMPIKTRIHKEETKVSLRRAAEAELPERVAKKEKLGFPSPIANWIKEDKYRKRIEAAFNSDIAKKFFKPEALMHILDEHVNGKSSMQKIFTIYTFILWYGVFFPEDTNTNTIDLVKRTQV

SEQ ID NO: 409 - protein, 402 aa, Streptomyces avermitilis
MEFRQSSKLSEVCYEIRGPVIEHANALEEAGHSVLRLNTGNPALFGFEAPEEILQDMIRMLPRAHGYTDSRGVLSARRAVAQRYQDRGLEVDVDDVFLGNGVSELVSMAVQALIEDGDEVLIPAPDFPLWTAVTTLAGGKAVHYLCDEQADWYPDLADMAAKITDRTRAVVIINPNNPTGAVYPKEIVEGILDLARRHGLMVFADEIYDQILYDDAVHHSAAALAPDLVVLTFCGLSKTYRVAGFRSGWLVVTGPKQHARSYLEGLTMLASMRLCANAPAQYAIQAALGGRQSIQELTAPGGRLYEQRDRAWQKLNEIPGVSCVKPKGALYAFPRIDPTVHKIHDDEKFVLDLLLREKIQVVQGTGFNWPRPDHFRILTLPHADDLDAAISRIGRFLSGYRQ

SEQ ID NO: 410 - protein, 350 aa, Neurospora crassa
MSTFTTNGAGAENDGEKVNTHIVTLTRFLTEEQVKHKEATGDFTLLCHALQFSFKSIAYYIRRATLVNLTGLAGSSNTTGDEQKKLDVISNDLFIEAMRSSGKCALLVSEEEEHVIYFKDAKNARYAVACDPIDGSSNLDAGVSVGTIFAIHKLAEDSTGTKEDILKPGTELVAAGFTMYGASAQLVITMKGGSVNGFTLDQGVGEFILTHPNMTIPRKRSIYSVNEGNSLYWEDDVKAYFNSLKETQEDSGKPYSARYIGSMVADAYRTLLYGGMFAYPADKKSPKGKLRILYECAPMAMIFENAGGQAVDSKMNRMLEVVPEHIHDKAGIFMGSYDEVEKVKKYHGKA

SEQ ID NO: 411 - protein, 412 aa, Arabidopsis thaliana
MGLFGTKKIGKYEIGRTIGEGNFAKVKLGYDTTNGTYVAVKIIDKALVIQKGLESQVKREIRTMKLLNHPNIVQIHEVIGTKTKICIVMEYVSGGQLSDRLGRQKMKESDARKLFQQLIDAVDYCHNRGVYHRDLKPQNLLLDSKGNLKVSDFGLSAVPKSGDMLSTACGSPCYIAPELIMNKGYSGAAVDVWSCGVILFELLAGYPPFDDHTLPVLYKKILRADYTFPPGFTGEQKRLIFNILDPNPLSRITLAEIIIKDSWFKIGYTPVYHQLSDSIKDNVAEINAATASSNFINAFQIIAMSSDLDLSGLFEENDDKRYKTRIGSKNTAQETIKKIEAAATYVSLSVERIKHFKPKEIRSRSSYDLLSAEVIEVTPTNCVIEISKSAGELRLYMEFCQSLSSLLTAEVS

SEQ ID NO: 412 - protein, 706 aa, Trichodesmium erythraeum
MLQERIDIHPTHSHGDFKLRSGKPFPFGATMVSGGVNFSIFSSYATSCTLVLFQKGALKPMAEIPFPEEFRIGNVYCMIVFDLDVENIEYGYRMDGPNNFHEGQWFDKSKILMDPYAKIIGGRDVWGKTPNWDDIYQHRGRIPYDDFDWENDRPLEIPPQDQIIYEMHVRSFTAHPSSGVKHPGTFAAIREKIPYLKELGVNAVELMPIYEFDEFENSRPSPITGEMLYNYWGYSTVGFFAPKAGYAATGKLGMQMDELKTLVKDLHKNGIEVILDVVFNHTAEGNENGPTISFRGIDNKTYYMLTPEGYYFNFSGCGNTINCNNPIVRNVVLDCLRYWASEYHIDGFRFDLASILGRDPWGAPLANPPLLETLAFDPILANCKLIAEAWDAGGLYQVGSFPAFGRWAEWNGKYRDAIRKFIKGDCTVGEMAQRIQGSPDLYAWQGRGPATSINFITAHDGFTLADLVSYNDKHNEANGENNNDGANDNESWNCGAEGWSDDPGINALRSRQMRNAIAIMMVSQGVPMLLMGDEIGRSKNGNNNTYCHDSELNWLNWELLETNAELFRFVKNCVAFRKAHPILKNQNHFRNQDYVGSGKSDITWHGTQAWNADWSDNSRTLAFMLCGKHATEVTKQDNDIYVAMNMHWDSLWFNIPGLSDGKHWHIFVNTACASPEDVWELGSEPVLENQHGLLLGDRSIVILVSK

SEQ ID NO: 413 - protein, 543 aa, Clostridium botulinum
MAKSILFGEESRRAMQAGVDKLANAVKVTLGPKGRNVVLDKKFGSPLITNDGVTIAKEIELEDPYENMGAQLVKEVATKTNDVAGDGTTTATLLAQAIIREGLKNVTAGANPMLIRKGIKLAVDTAVEQIKKSSKQVDGKEDIARVAAISAADPEIGKLIADAMERVGNEGVITVEESNTMATELEVVEGMQFDRGYLSPYMVTDAEKMEAVLENPYILLTDKKISNIQEILPILEQIVQQGKKLLIIAEDIEGEALATLVVNKLRGTFTCVAVKAPGFGDRRKEMLRDIAILTGGEVISEELGREIKDVTLDMLGTAESIKVTKENTTIVNGKGSKAEIEDRIGQIKRQIEETTSEFDKEKLQERLAKIAGGVAVVKVGAATETELKERKLRIEDALAATKAAVEEGIVAGGGTAYLRAIKEVEKLTDNNSEIRLGIAIIRRALEEPVRQIASNAGLEGSVIIDKIMNGQEGMGFDALEGEYVNMVQKGIVDPAKVTRSALQNAASVASTFLTTECVVAEIPEKNPAPQAPGMGGMGMEGMY

SEQ ID NO: 414 - protein, 375 aa, Lactobacillus plantarum
MKGCFIVTSFNEPLKFKSGVTLRNRLMMSPMTTTQSFYNGSITHDEIDYYTQRATGLGAVITGAANVEDLGKGWHGELSIAHDTMLPGLSALAHGIQSQGAKAIVQIFHAGRMTHRAVLNGEQIVSASAVAALRDDAETPRAMSIDEIHATISAFGEATRRAIQAGFDGIELHGANTYLIQQFFSPHSNRRTDEYGGRTPQERFRFIDELLKAVFAAVDQYADRPFIVGYRFSPEEFEEPGIRLEDTLWLLSQLRESRLDYVHVSLNNYDRVSRDPQYQDKSIMTYVHEALQGKLPLVGVGGVRTRDDVKTVLQTAELVAVGQQLLYDPTWAVKLAKNADNTMVTAPFEEAVEVTPLSRPLYEFAASRYHSVINS

SEQ ID NO: 415 - protein, 475 aa, Magnaporthe grisea
MASSSSSVPELAAAFPDGTTDFKPMRNTKGYDVSKPHISETPMTLKNWHKHVNWLNTTFILFVPLAGLISTYWVPLQWKTAVWAVVYYFNTGLGITAGYHRLWAHSSYKASLPLKIYLAAVGAGAVEGSIRWWSNGHRAHHRYTDTEKDPYSVRKGLLYSHMGWMLLKQNPKKQGRTDITDLNEDPVVVWQHRNFLKCVIFMALVFPTLVAGLGWGDYWGGFIYGGILRVFFVQQATFCVNSLAHWLGDQPFDDRNSPRDHVITALVTLGEGYHNFHHEFPSDYRNAIEWYQYDPTKWSIWIWKQLGLAHNLKQFRQNEIEKGRVQQLQKKLDQKRAKLDWGIPLEQLPVVSWDDFVEQSKNGKAWIAVAGVIHDVGDFIKDHPGGRALINSAIGKDATAIFNGGVYNHSNAAHNLLSTMRVGVLRGGCEVEIWKRAQSENKDVSTVVDSSGNRIVRAGGQATKVVQPVPGAQAA

SEQ ID NO: 416 - protein, 418 aa, Glycine max
MEDGSEKWNFQGNKKLNASSISVRGVYNMLMERVNNSRDKKPLVPLCRVDPTENPLFRTTPEATDSVSTAVNSYNFNCYPPTVGLPDAKRAIANYLSSDLPYQLSPENVFLTIGGTQAIDIILPALARSDANILLPRPGYPQYDSRASCCLLEVRHFDLLPERGWEVDLDSLESQADENTVAMVLINPSNPCGNVFTYQHLKRVAEIARKLGIFVISDEVYAHVTYGSNPFVPMGVFSSIVPVITIGSLSKRWLVPGWRTGWIATCDPHGIFQKTGVVKSIISYLEITTDPPTFLQAAIPEILGKTKDDFLSKNLNILRETANIFYDLCKEIPCLTCPHKPEGAMCVMVEINFSQIKDIVDDMDFCAKLAEEESVLLLPGVTVGLKNWLRISFAVDTSNLVEGLSRIKAFCLRYAKMP

SEQ ID NO: 417 - protein, 432 aa, Sinorhizobium meliloti
MPITAISDKLSVSPQLSVEDIPSLRDKGFKTLINNRPHKEDTFQPNTQAERQEVKHCGLTYAFIPVTADTITEADVRAFQRAVDESDGPVLAHCQTGGRSLNLYLIGEVLDGRMSADEADAFGRSRGFDTSVAAAWLKQHAARRPQVKGFFDKRTWSVQYVVSDPETGKCAIIDPVLDFDERAGATATINADAILDYVRDNGLTVEWILDTHPHADHFSAAQYLKEKTGAQTAIGERVVDVQKLWQKIYNWPELATDGSQWDRLFADGEDFKIGSIDAKVLFSPGHTLASITYVIGDAAFVHDTLFLPDSGTARADFPGGDARVLWNSIQEILALPDETRIFTGHDYQPDGRAPRWESTVAEQKKSNPHLAGVSEKEFVALRTKRDKTLPMPKLILHALQVNICGGRLPEPEANGKRYLKFPLDALQGAAWE

SEQ ID NO: 418 - protein, 363 aa, Novosphingobium aromaticivorans
MTLPSLFRPAALPGLDLPNRLVMAPMTRRMSPGGIPGADVAAYYRRRAEGGVGLIITEGTGIADPAALAERDVPEFHGDALRGWSTVVDEVHAGGAKIFPQLWHVGSARRPDMTNTPEVPAVSPAGLFAPGQPNGEALDEARIGRIITAYGEAAAQALRMGFDGIELHFAHGYLVDQFLWEPTNGRADGWGRTPWLLAREVVAECRRQTNPDFPICMRFSQWKQQDYGARLFADPACLEAFLGPMVDAGVDMFHCSTRRFWEPEFAGSRMNLAGWTRRLSGKPVITVGSVGLDEDFLVTRVGDDPTADGARLELLEDMLATGEVDLVAVGRALIGDPQWSAKVREGRFDQIRTFTRDDLARLD

SEQ ID NO: 419 - protein, 687 aa, Oceanobacillus iheyensis
MSDQDNQQEKRKQDDNKKIDQLKKFYRDNTDKIMTTDEGVKISNDENTLSAGDRGPQLLEDFMYREKLAHFDRERIPERNVHARGYGAHGVFECYESQSDLTKAHFLQKAGQQTPVFVRFSQVAGSKGANETLRDVRGFATKFYTNEGNFDLVGNNIPIFFIQDGIKFPDLIHALKPEPNNEIPQGQTAHDTFWDFIGSNEESAAMMMWIMSDRTIPRSFRTIQGFGVHTFRLVNAEGKSVFCKFHWRPVLGIHSLIWNEAQKIGGADPDFHRRDLWENIEQGFYPEYELGVQVIEEGQEFDFDFDILDATKLWPEEEVPLQMIGKMTLNKNVENVFAETEQVALHPGNIVPGIDFTNDPLLQGRLFSYTDTQIYRVGTNFKQLPINRPVCPFHNNHRDGSQRYIIDKGQVAYHQNYLAGNTPYTVPGSQGGFVTYPSLVEGLKVRKTAPSFLDHFSQARLFWNSMTDVEQSHILQAFSFELGKVNVPEVRQRVVNLIGHISRPLATAVAEQVGVEPPDKSIKQSDVTKSSPTLSLMNTKFLPNTLKVAIIVGNGYGGNALESLLESLKEVELKPYIISERLGEITADNGDTLNVDATFLTTSPVLYDGLLVVGGDHINDQFAYEAGNFITEQFNHYKPIGGMEEGATLIQQLGIANRPGVFISQSGSRQFTRQFIDGMAKQRFWDR

SEQ ID NO: 420 - protein, 503 aa, Zea mays
  misc_feature (362)..(362): Xaa can be any naturally occurring amino acid
MSYNKAPSITAETINPRVKIIRYAPCGEIVKHAARLEQEIEENPASIPFQEIIYCNLGNPQVLGQPPLTFFREVLSLCDNPALMDRDEARALFSPCSIRRARRILNSIPSKDTGGYTDCRGIKCLRQVVADGITARDGFPSTADDIFLTDGATSAINLMMQILIRSHEDGILSPLPEYPLYSASIILHGGTMVPYNLTEDNGWGLEIFEVKRCLEEARSAGLTVRAMVVINPGNPTGQVLSVTNQEEIVEFCRKEGLVILADEVYQENIYAENKKFHSFKKVARSLAYDENDLTLVSLHSVSMSYGESGRRGGYMEVSGVAANVKDQIYKVASLTLCPNIAGQILVSLAMDPPKNFPCDLYXLGDESFESFDKEKEQIRSSFCKRAKTLEKAFSGLEGVTCNKLEGALYLFPRLHLPSAAIRAADFEGVSPDIFYAHRLLDATGIAVVPGSGFHQASGTIHIRCTILPDERKIEAMVARLRAFHKAFMNEFRGSQQVMNDLRR

SEQ ID NO: 421 - protein, 849 aa, Rhodobacter sphaeroides
MDIEQKLAKERRARLAAERLLEYKQRELFAANEKLAIHARALSDQIIEQRAVVKTALSEAEKLKGQNSRFLSELERAHTAAVMAERRLWDSIDAIEDGFAVFDAGQRLVAANEAYRCHFEGLEVRPGMALADLLQLATTHGLIDLRGEPADHWRQRMIRRWDEDPVEPEIVRRCTGQWLRLVNRRARDGDMVSLLIDITEQMRLRAAIDAIPDGFVLFDRAERLVLCNDRYRAIYPRSAEALRPGAPFEEILRHGLAHGQFPEAAGREEEWLADRLAAFRHLGGAAEQQLDDGRWLRVIEHETPDGGRVGLGVDITELKRQQAALESARAAAEAASRAKSAFLANMSHEIRTPMNGIVGMADLLCETVLTEDQRLFSETIRSSGEALLVIINDILDYSKIEANRLTLHPEPFDLERTIHEVAMLLQPKARAKGIDLLIDFDLFLPTRFVGDPGRLRQVLTNLIGNAVKFTAAGHVLIRVVGLEVAPGRHDLRVTVEDTGIGIAPEHLDHVFGEFNQIEAEATRRFEGTGLGLAITRRLIELMQGAVWVESEPGRGSCFGFRLTLPAADDEAAPPVPIEVRRALVVDGQFINRTILERQLAPCGISVTLCRSGIEALAELSADAGYDLLLTDHEMPDLDGLALAQRVRAGGFSMPILLLTSNPSAVRDHPAEALLAGVLQKPLLRSDLYRRLQSLTAPPAAPDRPPPVPVPALRRMRVLAAEDNRTNQLVFGKMVRDLDIDLTFADNGREAVELYDRIRPDLVFMDISMPEMDGRAAARAIRARERGGTHVPIVALTAHALESDARASAAAGIDRTLTKPLRRAMILETLAAFCPAGTRPIQPALVEGPD

SEQ ID NO: 422 - protein, 492 aa, Ricinus communis
MDPYRNRPSSGFNTPFWTTNSGAPVWNNNSSLTVGSRGPILLEDYHLIEKLANFDRERIPERVVHARGASAKGFFEVTHDVSHLTCADFLRAPGVQTPVIVRFSTVIHERGSPETLRDPRGFAVKFYTREGNFDLVGNNFPVFFIRDGMKFPDVVHAFKPNPKSHLQENWRIFDFLSHVPESLHMLTFLLDDLGIPQDYRHMEGSGVNTYTLINKAGKVHYVKFHWKPTCGVKCLLENEAIKVGGSNHSHATQDLYDSISAGNYPEWKLYIQIMDPAHEDKFDFDPLDVTKTWPEDILPLQPVGRLVLNKNIDNFFAENEQLAFCPGIVVPGVSYSEDKLLQTRIFSYSDTQRHRLGPNYLQLPVNAPKCAHHNNHHEGFMNFMHRDEEVNYFPSRCDPARNAESFPVPSAICSGKREKCVIEKENNFKQPGERYRSWAPDRQERFLNRLVGGLSDPRITHELRTIWISYWIQCDKSLGQKLATRLNVKPSI

SEQ ID NO: 423 - protein, 275 aa, Oceanobacillus iheyensis
MIKGLQDTFTLNNGVEMPGFGLGVYKVEDGSVAEESVRIALENGYRSIDTASFYDNEKGVGEGIKNSGVPREDIFLTSKVWNDEQGYTSTKQAFQRSLDKLGTDYLDLYLIHWPVKDTFVETWRAMEELYRDGKVKAIGVSNFHVQHLEKLFVNAEVIPAVNQVEFHPHLTQEGLRAFCRQHNIQLEAWSPLKRGQLLEEDIIQTIAKKYGKSAAQVILRWDVQHEVITIPKSITKERIIANADIFDFSLTEEEMNQIDAMNQNDRSGSNPDSFD

SEQ ID NO: 424 - protein, 646 aa, Xanthomonas campestris
MCGLAGMLLASPRLHGEQLDALVRPMGAALRHRGPDDAGTWCDAQAGVALAHQRLSILDLSPLGHQPMRSADGRYVLAYNGEVYNFAQLRAALSALGHRFRGHSDTEVLLAAVVEWGLDETLTRCNGMFAIALWDERDNCLFLARDRVGKKPLYYGWAGDTLVFGSELKALWQHPDFDNGVDRDALTLLLRLGYIPAPACIHEHTFKLMPGRVLRMDAQAVAAGAAAHRPDQAQQPFWNAREAMQRALATPFTGTDAQAEEQLDSVLRDAVALRMVADVPVGVFLSGGTDSSIVTAMMQAQSAQPVHTFSIGFEGSHHDEAPLAREVATHLRTDHTELYVSGADALAVVPGLPDMFDEPFADASQVPTALVARLARGGVTVALSGDGGDELFFGYGRYQRALRNWRMHGLVPGPLRRLMAVAARRNGESSRTGGLAALVAEAGARGIGDIYRNRISRWRDPAAVVLGATEPDSFYSLADPLHGSGTPADAMMLADFAAYLPDDLLCKVDRTTMAVGLEARAPLLDWRVAEFAWSLPLSLKYRDGVSKYLLKRVLCRYLPDAMVYRGKRGFGAPVSAWLRGDLHGWADDLLAHGALQREGVFAADSVARLWRDFNGGERKWHTHLWTVLMFQAWQAHWREQRAAVVR

SEQ ID NO: 425 - protein, 492 aa, Ricinus communis
MDPYKFRPSSSNDTPFWTTNAGDPVSNNNSSMTVGPRGPILLEDYHMIEKLANFTRERIPERVVHARGMSAKGFFEVTHDVTDLTCADFLRAPGVQTPVIVRFSTVIHERGSPETLRDPRGFATKFYTREGNFDIVGNNFPVFFIRDGIKFPDVVHAFKPNPKSHIQEYWRIFDFCSHHPESLSTFAWFFDDVGIPQDYRHMEGFGVHTYCLINKAGKVTYVKFHWKPTCGVKCLMDDEAIKVGGANHSHATQDLYDSIAAGNFPEWKLMIQTMDPADEDKFSFDPLDMTKIWPEDMFPLHPVGRLVLNRNIDNWFAENEMLAFNPAHVVPGVYYSNDKLFQLRLFAYSDTQRHRLGTNYLQLPVNAPKCPYHNNHYDGFMNFMHRDEEVDYFQSRYDPVRHAEKVPIPNAICSGRREKCVIEKEDNFRQPGDRYRSWAPDRQERFLCRLVNALSEPRITHEIRSIWVSWWTQCDKSLGQKLASRLNVRPNI

SEQ ID NO: 426 - protein, 666 aa, Oryza sativa
  misc_feature (88)..(88): Xaa can be any naturally occurring amino acid
MAGSERTVVWFRRDLRIDDNPALASAARDGAVLPVFIWCPADEGQFYPGRCSRWWLKQSLPHLSQSLESLGCPLVLIRAESTLEALLXRCIDSVGATRLVYNHLYDPVSLVRDDKIKKELSALGISIQSFNGDLLYEPWEIYDDSGLAFTTFNMYWEKCMELPIDASPSLAPWKLVPVPGLESVRSCSVDDLGLESSKDEESSNALLMRAWSPGWRNAEKMLEEFVSHGLLEYSKHGMKVEGATTSLLSPYLHFGEVSVRKVYQLVRMQQIKWENEGTSEAEESIHFFMRSIGLREYSRYLCFNFPFTHEKSLLGNLKHYPWKVDEERFKSWRQGMTGYPLVDAGMRELWATGWTHNRIRVIISSFAVKFLLIPWTWGMKYFWDVLLDADLESDILGWQYISGSLPDGHELSRLDNPEVSLIKACLVFTTFSMALVQKCRLTQYLCLVFIVLVDYGKCDCYVLCLVHMVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKDGSNELCSKLTAEVHSHIQDHGGSLVGPSRYLLQEAGRNYVDEVEDSSTADSGSSISRQRKAA

SEQ ID NO: 427 - protein, 473 aa, Chromobacterium violaceum
MKKIAWLVAGAMAGGVLTLSMQALADKEASPLPLNELRTFAEVFSLIKQSYVEPVTDKKLIDEAIKGMLTGLDPHSDYMDPEEFKELREGTQGEFGGLGIEIGAEDGLVKVVSPIEDTPAQKAGIKSGDLIIKIDDTPVRGLSLNDAVKKMRGKPGSKVTLTIARKNEAKPLVFTLARAVIKTKSVKYRMLESGYGYVRIAQFQEHTAEDLAAGLQKLYQENKQPLKGLVLDLRDDPGGLLNGAVGVAAAFLPKDKLVVYTEGRTPDAKMRLTATLQNYARQNGSDPLAKLPVAVRSVPLAVLVNGGSASASEIVAGALQDHKRAVLVGTQTFGKGSVQSILPLGSQGGIKLTTARYFTPSGRSIQAKGITPDVVAEDATLTAADQALRVREADLENHLANPNGDDKPAKTAKPAAKPAQPPAPAPVPEGKDKEPAAPDAQGGQRMPNPKSDYQLSQALNVLKVQQILQKNEN

SEQ ID NO: 428 - protein, 546 aa, Chromobacterium violaceum
MAAKDVKFGDSARSKMVAGVNILADAVKVTLGPKGRNVVLDRSFGAPTITKDGVSVAKEIELKDKFENMGAQMVKEVASKTSDVAGDGTTTATVLAQAIVQEGMKFVAAGMNPMDLKRGIDKAVVSLVGEIAKIAKPCATSKEIAQVGSISANSDSDIGEIIANAMEKVGKEGVITVEDGKSLNNELDVVEGMQFDRGYLSPYFINNQDKQIAALDNPFILLFDKKISNIRDLLPVLEQVAKSGRPLLIIAEDVEGEALATLVVNTIRGILKVVAVKAPGFGDRRKAMLTDIAVLTGGEVIAEEVGLTLEKATLDQLGQAKRVEVGKENTTIIDGAGEAATIQARVGEIRKQIEEATSDYDREKLQERVAKLAGGVAVIKVGAATEVEMKEKKARVEDALHATRAAVEEGVVPGGGVALLRARATLENLKTDNAEQEAGVKIVLRAIEAPLRQIVKNAGDEPSVVVNKVLEGKGNFGYNAASGEYGDMLEMGVLDPAKVTRSALQHAASVAGLMLTTDCMIAELPEDKPAAGMPDMGGMGGMGGMM

SEQ ID NO: 429 - protein, 565 aa, Candida glabrata
MNINDIKELVDQVSVEDVVNCVVNKTTRYLDDTPWYNILKDYVFLIVLYKFVKKIYYYLAGYGLLKSMQLLYKSVANWIFQRLLESPLLRGSVNKEVSKAVAGMEKELIKNDDQLADFEVLPKEGLSSESINSELDKLNSILPHTSWEQGRVSGAVYHGGKELIKLQSEAFEKYCVANQLHPDVFPAVRKMEAEVVSMTLKMFNAPETGCGTTTSGGTESLLLACLSAKVYGLKHRGITEPEMIVPVTAHAGFDKAAYYFGIKIHHVDLDPVTYKVDLKKVKRLINGNTVLLAGSAPNFPHGIVDDIEGLGKLAQKYKIPLHVDCCLGSFIIAFMEKAGFNDIGSFDFRVPGVTSISCDTHKYGFAPKGSSVIMYRNSELRKHQYYVDSKWTGGLYGSPTLAGSRPGALVVGCWSTMIHMGESGYKDSCTRIVSTARKLKDHIRNKLPQLEVLGDPKLSVVSFSSNKLNIYELADRLAKSGWHLNALQKPAALHLAITTLSVPTIDTFIETLTEAVEQMSADPTSTPSTEGTSALYGVAGSVKTTGVADKLITAFLDTLYKVKSD

SEQ ID NO: 430 - protein, 368 aa, Pseudomonas syringae
MSLLLEPYTLRQLTLRNRIAVSPMCQYSSVDGLANDWHLVHLGSRAVGGAGLVITEAMAVTPDGRITPEDLGLWNDEQIEPLQRITRFINAQGAVAGIQLAHAGRKASTWRPWLGKHGSISLNEGGWTPVGPSAIAFDPQHTAPVQLSETQIQELIKAFVDSARRALTAGFKVVEIHAAHGYLLHQFLSPLSNQRTDQYGGSFENRIRLTLQVTEAVRAVWPEELPLFVRVSATDWVEDGWNADETVELARRLKALGTDLIDVSSGGTSANAEIPVGPGYQTRFAERVRKESEIATGTVGMITDPAQAEHILRTGQADIILLARELLRDPYWPLRADEDLGGRLATWPAQYQRATHRDQPIHESDLRD

SEQ ID NO: 431 - protein, 435 aa, Triticum aestivum
  misc_feature (376)..(376): Xaa can be any naturally occurring amino acid
  misc_feature (383)..(383): Xaa can be any naturally occurring amino acid
  misc_feature (401)..(401): Xaa can be any naturally occurring amino acid
  misc_feature (409)..(409): Xaa can be any naturally occurring amino acid
  misc_feature (423)..(423): Xaa can be any naturally occurring amino acid
  misc_feature (429)..(429): Xaa can be any naturally occurring amino acid
PRVRKYLVDKAHSLGLRVLMDVVHGHASKNVTDGLNGYDVGQSAQESYFYTGDRGYHKLWDSRLFNYTNWEVLRFLLSNLRYWMDEFMFDGFRFDGVTSMLYNHHGINTSFTGNYKEYFGLDTNVDAIIYMMLANHLIHKVLPEATIIAEDVSGMPVLCRPVDEGGVGFDYRQAMAIPERWADYLKNKDDLEWSMSGIAHTLNNRRYTEKCIAYAESHDQSIVGDKTMAFLLMDKEMYTGMSDLQPASITVDRGIALQKMIHFITMALGGDGYLNFMGNEFGHPEWIDFPREGNNWSYDKCRRQWSLADIDHLRYKYMNAFDQAMNALDDKFSFLSSSKQIVSDMNEEKKIIVFERGDLVFVFNFHPSKTYDGYKXGCDLPGXKYKVALDSDASDVLVDMXRVAHDNDXHFTSPERSTQEYPXTNFNNXPNSFKI

SEQ ID NO: 432 - protein, 314 aa, Helianthus annuus
MALGFSDRNTEMSPYSQQSNTSAVPMDSSKKRKTRSRKEAPEKVAATLAKWIEYNKANEDGKAKTRKAPAKGSKKGCMKGKGGPENSRTNFRGVRQRTWGKWVAEIREPNRGRRLWLGTFGSAVEAALAYDEAARAMYGTSARLNLPNCRSKNDILPLLVTNPASSCDSTTTCSYSEVDATHDSKPGPAVFPSVKHEESVQVKHEPEIVAKEEHCVDNNDLGFDIGDEMFDLEELLGAVEDSNPEAGSGDGYDGRFVNGADANENMQMYMQPDPCVSGQDYSFDFLQPGRPEDCSFTLEELGLGLDAELDLYSN

SEQ ID NO: 433 - protein, 639 aa, Unknown
  Clostridium sp. TO-931
MSYDALFSPFKIRGLELKNRIVLPGMNTKMAKNKHDLSDDMIAYHVARAKAGCALNIFECVALCPAPHAYMYMGLYNDNHVAQLKKLTDAVHEVGGKMAVQLWHGGFSPQMFFDKTNTLETPDTITVERIHEIVKEFGEGARRAVEAGFDAVEFHAAHSYLPHEFLSPGMNKRTDEYGGNFENRCRFCFEVVEAIRANIPEDMPFFMRVDCIDELMDEVMTEEEIVEFINRCADLGVDVADLSRGNAQSFATVYEVPPFNLQHGFNIENIYNIKKQIKIPVMGVGRINTGEMANQVIADGKFDLVGIGRAQLADQDWVAKVREGKEDLIRHCIGCDQGCYDAVINPQMTHITCTRNPHLCLEYKGMPKTDEPKKVMIIGGGMAGILAAEVLKKRGHEPVIFEASDHLAGQFVLAGKAPMKEDWAAAAKWEAEEVARLGIEVRYNTKVTPELIEEFAPDHVVIAIGSDYVAPAIPGIDSDKVYTQYQVLKGEVEPKGHVAVVGCGLVGTEVAQYLAARGAQVTAIERKGVGTGLSMLRRMFMNPEFKYYKINKMSGTNIVGIEPGKLHYIMTNKKTQEVTEGVLECDAAVICTGITARPSEDLQEKCKELGVPFNVIGDAAGARDARIATQEGYEVGMSI

SEQ ID NO: 434 - protein, 102 aa, Brassica napus
SFSSLAACTLLITIGLKSTIQSFTQRHNYNSTLSVGGGFLLVLFRWTISGRRLETYAFFVLFRGFWTTLTVFARKITIFGWIIHHPNIRSLFDKYRGKRVPV

SEQ ID NO: 435 - protein, 250 aa, Crocus sativus
MGRGRVQLKRIENTINRQVTFSKRRAGLLKKANEISVLCDAEVALIIFSTKGKLSEYSTDARMESILERYDRYSSAERAIVAPDPDSQESWRDEYGRLKAKLEALQTSQRHLMGAQLDMLSVKELQQLEQQLENALKNIRTRKNQLMFDSISELQKKEKTLVSQNKDLEKKLIEKEKGKAMAQQGHWDQQGQQYTESSSPPSLLIQDPFPSLTIGINPASGSSEEDYEARPLPPANSNRLPPWMIRSANE

SEQ ID NO: 436 - protein, 388 aa, Francisella tularensis
MNNNEIIHQTIEKQGSIVWKSVFGLLLLPLVALIAIPWYAKTYGFSTSDYVCLVVFYMLTGVGITMGYHRLWSHKTYKANKIVSYALLLFGTAALQNSVIQWSSDHRKHHKDVDDPIKDPYAATRGFWFSHFGWLLRHSSPDVQEIRGVNDLLKDKALVFQHNNYTVLAILSCFGLPALLGFIFGFLSGHTLTGAWHSALGFLLLGGLLRVILVHHATFCINSLAHTIGKRPYSTKNTARDSWITAIVTGGEGYHNYHHAFAGDYRNGIRWFDLDPSKWFIAGLAKIGWCYDLKTTPKHLIEIAKAKVKLEEALTKKNKTFHLGIEEKYAKLVANVKNMYNAKQEYLKAKKDNVLSKADIKEIKSKYKDLKIEFIQAKKKYNKASTIA

SEQ ID NO: 437 - protein, 485 aa, Streptomyces avermitilis
MSKRVLTTESGAPVADNQNSATAGVGGPLLLQDQHLLEKLARFNRERIPERVVHARGSGAYGHFEVTDDVTGFTYADFLNTVGKRTEVFLRFSTVADSLGGADAVRDPRGFAVKFYTEEGNYDLVGNNTPVFFIKDPLKFPDFIHSQKRDPFTGKQEPDNVWDFWAHSPEATHQVTWLMGDRGIPASYRHMNGYGSHTYQWTNAEGEAFFVKYHFKTNQGIRSLSAEQAQEIAGTDPNSHQTDLLQAIERGVRPSWTLYVQIMPAAEAAEYRFNPFDLTKVWPHTDYPLQRVGRLVLDRNPDNVFAEVEQAAFSPNNFVPGIGPSPDKMLQGRLFAYADAHRYRLGVNHTQLAVNAPRATVVSNYGRDGLMASPAQGRAAKNYEPNSYDGPAETGRPLSAPLAVTGHTGTHEAPPHTKDDHFFQAGELYRLMSAEERSRLVANIAGGLSQVSRDDVIEKNLTHFHAADPEYGTRVEEAVRALRED

SEQ ID NO: 438 - protein, 548 aa, Legionella pneumophila
MAKELRFGDDARLQMLAGVNALADAVQVTMGPRGRNVVLEKSYGAPTVTKDGVSVAKEIEFEHRFMNMGAQMVKEVASKTSDTAGDGTTTATVLARSILVEGHKAVAAGMNPMDLKRGIDKAVLAVTKKLQAMSKPCKDSKAIAQVGTISANSDEAIGAIIAEAMEKVGKEGVITVEDGNGLENELYVVEGMQFDRGYISPYFINNQQNMSCELEHPFILLVDKKVSSIREMLSVLEGVAKSGRPLLIIAEDVEGEALATLVVNNMRGIVKVCAVKAPGFGDRRKAMLQDIAILTKGQVISEEIGKSLEGATLEDLGSAKRIVVTKENTTIIDGEGKATEINARIAQIRAQMEETTSDYDREKLQERVAKLAGGVAVIKVGAATEVEMKEKKARVEDALHATRAAVEEGIVAGGGVALIRAQKALDSLKGDNDDQNMGINILRRAIESPMRQIVTNAGYEASVVVNKVAEHKDNYGFNAATGEYGDMVEMGILDPTKVTRMALQNAASVASLMLTTECMVADLPKKEEGVGAGDMGGMGGMGGMGGMM

SEQ ID NO: 439 - protein, 658 aa, Rhodospirillum rubrum
MCGLTGYWTRGGDGRGRGEMTALVLRMAGALAHRGPDGDGAWVDEDAGLALGHRRLSIVDLSPAGQQPMVSADGRLALAYNGEIYNAAELRPELEAAGIVFRGHSDTEVLLEGFARWGVVPTLRRAIGMFAFALWDRKERRLTLGRDRLGIKPLYVADHGGTLLFASQPKGMMPHPSWRGEVDREGLAAMLRLSCLPAPRSIFKGVSQLAPGTVVRFEADGRRSEEVFWSLEEVAARGVAQARSQPARPESASLAVEHLESLLLDAVRRRLIADVPVGAFLSGGVDSSTVVALMRKVASGPVKTFSIGFAEEGWDESVHAAAVARHLGTDHRELVVSPDEVPAIVGDLPRWYDEPFADASQIPTLLVSKLARSEVTVSLSGDGGDELFAGYNRHVQGQRLWDLAQRIPTVGRDLGAALIEAPSPGFWQRAVGLLPAGRRPPQAADKPAKIARLLRARSPEALYRTLVGAMPSAEVPLAGVSLAAEERWYAASAEGVDSFVDRMRLLDAKGYLPDDILTKVDRASMAYGLEARVPLLDHRVVEFAWSLPPEMLIREGQGKWLLRRVLHRHVPRALIERPKMGFGVPLAAWLRGPLRGWAEDLLDPQTMAVQGLIDPAPVRRWWLDHLAGRRDTHDRLWPVLSALSWHHHWKSAGAFTAA

SEQ ID NO: 440 - protein, 399 aa, Hevea brasiliensis
MAETGTEGTGITTLFSPYKMGKFSLSHRVVLAPMTRCRALNGIPNAALVDYYTQRSTPGGFLITEGTLVSPTAPGFPHVPGIYTEEQAEAWKRVVDAVHAKGSIIFCQLWHVGRASHQVYQPNGAAPISSTGKAISNRWRILMPDGSYGKYPTPRPLETPEILEVVKNYRQSALNAIRAGFDGIEVHGAHGYLIDQFLKDGINDRTDEYGGSINNRCRFLMQVIQAVVAAIGADRVGFRMSPAIDHLDAIDSDPLNLGLAVIERLNKLQLNLGSKLTYLHVTQPRYTAYGQTESGRHGTEEEEARLMRTWRRAYKGTFICSGGFTRELGMEAIAQDDADLVSYGRLFISNPDLVLRFKLNAPLNKYVRKTFYTQDPVVGYTDYPFFRKVDGSQEPRSRL

SEQ ID NO: 441 - protein, 606 aa, Methylococcus capsulatus
MCGIAGLFNCNLPADELRLDQAVAKLTHRGPDDRGIFLDGRFGMGHTRLSIIDLAGGHQPLFSEDRRLALIANGEIYNFIELRSELTAAGFRFQTQSDSEVILHAYLAFGEGFLERIQGMFAFALYDALEGRLILARDRLGIKPLFLARRPDGIAFASEIKALLPLLDQPREIDPQGLAQYFQNQFSTGATTVLRGVERVLPGEAVVVEAGKTTRRFRYWSPLAVRTEELDFDEAAARFDALMERVMVEHMRSDVPFGLFLSGGVDSSLLLALLTRYSGEPIRTFSVGFPGTSLTDELPLAEGLARRFRSRHREIRPGPQDILHSLPLTVWAADDLMRDNASLPTSLLARAAGEELKVVFSGEGGDEVFAGYGRYRTSPLERLFKSLLAPGSGGFRTRGSFRGRWPKTLFGPALLAAAQSARRPVQESWRETPREWSDLQRMQYVDLCHALPDNLLVKADRMLMAWGVEGRVPFLDHRVVEFGLSLPDRLKIEGRQGKLFLKRWGERLVPAEQLYARKRGFHVPLGEWLDEPFLERLNRILPEHPALTPWFKPAGIRALIARCRDERQGSAMLWAIIQFAIWHRLFISGNGERPEALTDPLEILQR

SEQ ID NO: 442 - protein, 246 aa, Crocus sativus
MGRGRVQLKRIENTINRQVTFSKRRGGLLKKANEISVLCDVDVALIIFSTKGKLSEYSTDARMETILERYERYSFAESAIAVPEAESQGSWLNEYGRLKARIESLQTSQRHLTGVQLDMLNVKEMQELEQKLESAMKNIRSRKSQLLFNSISDLQTKEKALVDRNNDLKKKIAEKERKRTSAQQGHQDQQGQQYVDPTSPLSFPVQDPPSLTMGINPARSTSDEDRPLPQVNSSKLLPWMIRSVNG

SEQ ID NO: 443 - protein, 319 aa, Candida glabrata
MSYPHKIAAAHDDPTLMFNHTCLRIKDPAKSIPFYQKHFGMELLNKLDFPEMKFSLFFLSFPKDNVAKNSEGKNDVFSTSGILELTHNWGSENDADFKICNGNEEPHRGFGHICFSYADINAACSKLEAEGVSFKKRLTDGRMKDIAFALDPDGYWIELIRYDRENSPKKDVGSRFNHTMVRVKDPKASLEFYQNVLGMKLLRTSEHEAAKFTLYFLGYKVSSEDNEFSHEGVLELTHNWGTENEADFKYHNGNDKPQGYGHICVSCKDPAKLCNEIEQTYGDKIQWAPKFNQGKLKNIAFLKDPDGYSIEVVPHGLIV

SEQ ID NO: 444 - protein, 339 aa, Ralstonia eutropha
MTRISLTRYLVEEQRKHNTIQPELRLLIEVVARACKAISNSVNKGALAGVLGSAGTGNVQGETQQKLDVIANEVLLDANEWGGHLAAMASEEMESFYEIPNRYPKGEYLLMFDPLDGSSNIDVNVSIGTIFSVLHMPKPGQTVTEADFLQPGTHQVAAGYAVYGPQTTLVLTVGNGVHVFTLDREAGSFVLTQSDVQIPEDTKEFAINMSNMRHWAPPVRKYIDECLAGDEGPRGKNFNMRWIASMVADVHRILTRGGIFMYPWDKREPEKAGKLRLMYEANPMAMLIEQAGGAATNGHIRILDVQPEKLHQRVSVILGSKNEVERVTRYHHEAAGQQG

SEQ ID NO: 445 - protein, 167 aa, Triticum aestivum
MAAISSTSYFSSQPQLPASDGANPATARSSSSNGREPRRRRTGRCIMLEADAASASGSGGAAAGRTRSLTEEDLEELKGCLDLGFGFSYHQIPGLCGTLPGLELCYSMTRRFLDEQRTLVGQLEPATAAAAPIPDWKISGPGDDPDEVKARLKYWAQTVACTVKLCT

SEQ ID NO: 446 - protein, 80 aa, Antirrhinum majus
GSISEANTQYYQQEASKLRAQISNLQNQNRNMLGESLGALSLRELKNLESRVERGISRIRSKKNELLFAEIEYMQKRQEI

SEQ ID NO: 447 - protein, 589 aa, Brevibacterium helvolum
MTLVNVGPERFDVWAPDVSSVVLVADGRQYPMQKKETAPGSEGWWTASDAPPNGDVDYGYLLDGNTTPVPEPRSRRLPAGVHNHSRTYNPPPYRWQDSRWRGKELQGTLIYQLHVGTSTPDGTLDAAGEKLSYLVDLGIDFIELLPVNGFNGTHNWGYDGVQWYTVHEGYGGPAAYQRFVDAAHAAGLGVIQDVVYNHLGLRGNYFPKLGPNLKQGDANTLGDSVNLDGAGSDVFREYILDNAALWVGDYHVDGVGFDAVHAVRDERAVHILEDLGALGDAISGETGLPKTLIAESDFNNPRLIYPRDVNGYGLAGQWSDDFHTAVHVSVSGETTGYYSDFESLAVLAKVLKDGFLHDGSYSSFRGRHHGRPINPSLANPAALVVCNQNHDQIGNRATGDRLSQSLSYGQLAVAAVLTLTSPFTPMLFMGEEYGASTPWQFFTSHPEPELGKATAEGRIKEFERMGWDPAVVPDPQDPETFNRSKLDWSEASTGDHARLLELYKSLTALRREHPDLADLGFGQTEVSFDDDAGWLRFRPVSVEVLVNLSDAKVRLDDAAGDLLLATDEGNPLDGGSLALVPWSAAVLKS

SEQ ID NO: 448 - protein, 500 aa, Xanthomonas campestris
MVIHRPASRHRCARWLMLRSLTVCCRARMSYAIVWFRRDLRLEDNPALRAALDAGHHPIPLYIDAPHEEGEWTPGAASRTWRHRSLAALDGALRALGSGLVIRSGDSAQVLDEVIAQTGAVAVYWNRKYEPATQPRDAQIKRDLRERGIEVQSCNAALLFEPWQLSTQQGGPYKVFTPFWRNALTQLQLPAAMDAPRRLPPLPASLKTDALDTLQLVPGLQWDQGFWEHWQPGEAGAHEMLEIFIDGALSGYRENRDRPDRVGTSQLSPHLHFGEIAPWRIASTLEAHRTARNGAEIDGYIRQLGWRDFAYHLLHHFPDTTNQNLNPRFAGFDWATVDPVALQAWQRGRTGIPIVDAGMRQLWHTGWMHNRVRMIVASFLCKHLRIHWIEGARWFWDTLVDADLANNTLGWQWVAGTGADAAPYFRVFNPVTQAEKFDPHATYITRWVPELGKLAVKERFAPWLHPLALARFAPEYPRNPIIGLAEGRDAALAAYAKSRA

SEQ ID NO: 449 - protein, 116 aa, Glycine max
MTYQNLVLSFHITSEAIMLAGLAFKRKWQNRRKQEGKPFDKPNIVTGANVQVCWEKFARYFEVELKEVKLRDDYYVMDPEKAVELVDENTICVAAILGSTLNGEFEDVKRLNDLLI

SEQ ID NO: 450 - protein, 258 aa, Arabidopsis thaliana
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLRDLIIYIYLDYVS

SEQ ID NO: 451 - protein, 701 aa, Cryptococcus neoformans
MSARNLASGTPYRKNLSPANSPHFDAPSVSSTSDSVKSAYSVGYTPVPTADRSYSGLLHGTLSKVFRKGGQEIIVSEEPVSFSSSKEDSESTRFNGCPYMNGSIPQTPTPKSTPKSASVAVPVPLPPPSAARLKVQKQNDSIPRENGNALADDVGKLTVRSYEKDRDLKSQEVIYTTSNGVPVPHPYAVQRAGVNGPLLLQDFHLIDLLSHFDRERIPERVVHAKGSGAHGTWECTDGLEDLCLANMFQKGATCPLTIRFSTVGGESGSPDLARDPRGFAVKFRTAEGNWDFVANNTPVFFLRDPAKFPHFIHTQKRDPATHLSGGDDSTMFWDYLSQNPESIHQVMILMSDRGIPAGWRHMHGYYGHTLKIVNDNGDWVYAQFHLISDQGNKFFTSEEASTKSPDWGQKDLYEAIGRGEYPSWTMKVQVMTQEQAEEAWEKKRINVFDLTHVWPHGDYPLRTIGKITLNENPSNYFAEVEQATFNPAHMIPGVEPSADPVLQARLFSYPDAHRHRVGANYQQLPVNQSATPYATGNFQRDGAMAFYNQGGRPAYLSSIEPIKFREKRVNLNKVHGQFIGEAVSFLSEIRPEDFNAPRALWQKVFSDESKERFIQTVAGHMSTCKRKEIIARQIAIFRQVSPDLGARLEKATNVRGYGSIEGMSFNGTHNGFGVKRGANGLRQDADVVFNNGAPQKTQRAR

SEQ ID NO: 452 - protein, 478 aa, Staphylococcus aureus
MTKLPQNFMWGGALAANQFEGGYDKGGKGLSVIDVMTSGAHGKARQITESIDPNHYYPNHEGIDFYHRYKEDIALFKEMGLKCLRTSIAWTRIFPNGDEDVPNEEGLAFYDRIFDELIAQGIEPVVTLSHFEMPLHLAKHYGGFRNREVVDYFVHFARVVFERYKDKVTYWMTFNEINNQMDTSNPIFLWTNSGVALTENDNPEEVLYQVAHHELLASALAVRLGKEINPKFKIGTMISHVPIYPYSCHPKDMMEAQIANRLRFFFPDVQVRGYYPSYAKKMLARKGYDVGWQEGDDSILQQGTVDYIGFSYYMSTAVKHDVDTTVENNIVNGGLNHSVENPHIATSDWGWAIDPDGLRYTLNVLYDRYQLPLFIVENGFGAVDEVVDGHIHDDYRIEYLKAHITAAIEAVDQDGVDLIGYTPWGIIDIVSFTTGEMKKRYGLIYVDRDNDGHGTMERLKKDSFYWYQQVIASNGDKL

SEQ ID NO: 453 - protein, 477 aa, Citrus sinensis
MGILSKIATNNGHGEDSAYFDGWKAFDRNPFHPTQNPGGVIQLGLAENQLCFDLIKDWITKNPYASICTAEGVEVFKDIAIFQDYHGLPEFRQAVAKFMGKGRGGRVTFDPDRIVMGGGATGANELIMFCLANPGDAFLVPSPYYAAFDRDLSWRTGVQIVPVHCDISNNFKITREALEAAYERAQEASINIKGLIITNPSNPLGTTLDRDTLKSLVSFINDKNIHLVCDEIYAATALSSPKFTSVAEVIQEMDCNRDLIHIIYSLSKDMGLPGFRVGIVYSFNDTAVNCGRKMSSFGLVSSQTQYLLASMLSDDEFVDNFLVETSKRLAKRHHNFTKGLEQVGINCLKSNAGLFFWMDLRHLLKEKTLEGEIALWRTIVNDVKLNVSPGSSFQCTEPGWFRVCFANMDDDTLQVALNRIAAFVQQDKESEKPTKKRWQQNLRVSFSSRIYEQGVMSPHMMSPHSPIPQSPLVRART

SEQ ID NO: 454 - protein, 546 aa, Zymomonas mobilis
MAAKDVKFSRDARERILRGVDILADAVKVTLGPKGRNVVLDKAFGAPRITKDGVSVAKEIELKDKFENMGAQMLREVASKTNDLAGDGTTTATVLAQAIVREGMKSVAAGMNPMDLKRGIDLAATKVVESLRSRSKPVSDFNEVAQVGIISANGDEEVGRRIAEAMEKVGKEGVITVEEAKGFDFELDVVEGMQFDRGYLSPYFITNPEKMVAELADPYILIYEKKLSNLQSILPILESVVQSGRPLLIIAEDIEGEALATLVVNKLRGGLKVAAVKAPGFGDRRKAMLEDIAILTKGELISEDLGIKLENVTLNMLGSAKRVSITKENTTIVDGAGDQSTIKDRVEAIRSQIEATTSDYDREKLQERVAKLAGGVAVIKVGGATEVEVKERKDRVDDALHATRAAVQEGIVPGGGTALLYATKTLEGLNGVNEDQQRGIDIVRRALQAPVRQIAQNAGFDGAVVAGKLIDGNDDKIGFNAQTEKYEDLAATGVIDPTKVVRTALQDAASVAGLLITTEAAVGDLPEDKPAPAMPGGMGGMGGMDF

SEQ ID NO: 455 - protein, 176 aa, Ashbya gossypii
MDANSDQRDKHNQYIAELREQDRWLPINNVARLMKNTLPVTTKVSKDAKECMQECVSEFISFVTSEASDRCASDKRKTINGEDVLISLHALGFENYAEVLKIYLAKYRQQQALKNQMIFQRREDGADGLDGAADDGSDDAGEEEGEHGAGAAAGAPGAGALPEQDQFINQDGSLYI

SEQ ID NO: 456 - protein, 504 aa, Cucumis sativus
MDMNVPNYKLGKTLGIGSFGKVKIAEHALTGHKVAIKILNRRKIKNLDMEEKVRREIKILRLFMHPHIIRLYEVIETPSDIYVVMEYVKSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSSGARELIPSMLVVDPMKRITIPEIRQHPWFQAHLPRYLAVPPPDTMQQAKKIDEDILQEVVKMGFDRNQLVESLRNRIQNEATVAYYLLLDNRFRVSSGYLGAEFQETMETGFNRMHPSDPTNPAVGHRLPGYMDYQGMGLRAQFPVERKWALGLQSRAHPREIMTEVLKALRELNVAWKKIGHYNMKCRWLPGIPGHHEGMINNPVHSNHYFGDKSTIIENDGVVKSPNVIKFEVQLYKTREEKYLLDLQRVQGPQFLFLDLCAAFLAQLRVL

SEQ ID NO: 457 - protein, 359 aa, Ashbya gossypii
MGKKIVFNISSEFQLKALLGEGAYGIVCSAVHKPSGEVVAIKKIEPFERTLFSLRTLREIKILKHFQHENIISIYDIQKPASFDTFNEVYIIQELMQTDLHRVIATQPLSDDHIQYFIYQTLRGLKALHGSGIIHRDLKPSNLLLNANCDLKICDFGLARIEHGGAADLEHPQAGMTEYVATRWYRAPEVMLTAAQYTKAIDIWSSGCILAELFMKRPLFAGKDYKHQLMLIFELLGTPQGDDLAAVKSRRAREYIATLPRYRRASLRAVIPHANPLGLDLLQRMLVFDPRRRITAADALRHPYLATYHDPRDEPDGTPIPASFFDFDHHKDKLTTRDLKRMLWDEVFRDTHAPVRPDA

SEQ ID NO: 458 - protein, 490 aa, Magnaporthe grisea
MAALASKQQSQKIFEKLKTKQANKICFDCGQKNPTWTSVPFGIYLCLDCSSNHRNLGVHISFVRSTNLDQWQWDQLRVMKVGGNESATKFFQQNGGSAALNSKDPKTKYHSAVATKYKEELKKRAARDAKEYPEEVVITDGTDAGDGTNTPAGEPDDDFFSSWDKPAIKKPTPPVSRTATPPVVGRTPSPFLTAGGANGKDIARTPSPLAKSADSAVKPAASRITHSSALKKTTGAGPKKANVLGAKKTTKLGVKKVNAEVIDFDEAEKKAKEEAERIEKLGYDPDDIDTTAAKKVGGVKAESSGAGILAPTPVSPARGGYGASGHSREKSASEMERLGMGMGRLGFGQVGGNKPAAAAQPKKGGGFGSVGPIKATPEADEEKYARSKFGAQKAISSDEFFGKGSYDPNAQAEAKTRLQGFEGASAISSNAYFGRPEEEEVEEYGDLETAAKDFIRKFGLTRGDDLENLTAVLGDGATKLQGAIRSYLGS

SEQ ID NO: 459 - protein, 539 aa, Spinacia oleracea
MEVISRLTFASVSYPFISSNLNPTPMLNSFNFRVLSWNSAPTNVAEAHLHRLLLRKLNPANDRVVGISNFGCSCRLDLWPSWRRHKRLFFQNGVSTIRWEVKKCSPKFYKIVSNYEKCKRHIYVPFVRLVVGVVLLMSVSVALNQGPSWSLSEENRIFLEAWRTIDRAYVDKTFNGQSWFRYRENALRNEPMNSREETYTAIRKMVATLNDPFTRFLEPEKLKSLRSGTQSSLTGVGISIGPTAVDQSSTGLVVISATPGAPASRAGILPGDVILAIDDASTDKMGIYEAANILQGPDGSSVDLTICSRDEIKHVVLKRERITLSPVKSRLCEMPGSAKDAPPKVGYIKLTSFTENASDAVKEAIETLRSNNVNAFVLDLRDNSGGLFPEGIEIAKIWLNKGVIVYICDSRGVRDIYDVEGSSAVAGSEPLVVLVNKGTASASEILAGALKDNKRAVVFGEPTYGKGKIQSVFELSDGSGLAVTVARYETPAHTDIDKVGIKPDHPLPASFPKDENDFCTCVQDPSSTCYLNGVQLFSR

SEQ ID NO: 460 - protein, 548 aa, Vibrio harveyi
MAAKDVKFGNDARVKMLEGVNVLADAVKVTLGPKGRNVVLDKSFGAPTITKDGVSVAREIELEDKFQNMGAQMVKEVASKANDAAGDGTTTATVLAQAIVNEGLKAVAAGMNPMDLKRGIDKAVIAAVEQPKRASVECTDTKAIAQVGTISANSDSSVGNIIAEAMEKVGRDGVITVEEGQALQDELDVVEGMQFDRGYLSPYFINNQEAGSVDLENPFILLIDKKVSNIRELLPALEAVAKASRPLLIIAEDVEGEALATLVVNNMRGIVKVAAVKAPGFGDRRKAMLQDIAILTGGIVISEEVGLELEKVALEDLGQAKRVAITKENTTIIDGVGEEAMIQGRVAQIRQQIEDATSDYDKEKLQERVAKLAGGVAVIKVGAATEVEMKEKKDRVEDALHATRAAVEEGVVAGGGVALIRAASKIVDLEGDNEEQNVGIRVALRAMEAPIRQITKNAGDEESVVANNVKAGEGSYGYNAATGEYGDMLEMGILDPTKVTRSALQFAASVAGLMITTEAMVTDLPQKEGAGMPDMGGMGGMGGMGGMM

SEQ ID NO: 461 - protein, 337 aa, Glycine max
  misc_feature (150)..(150): Xaa can be any naturally occurring amino acid
FGSRLKEVKLRDGYYVMDPEKAVEMVDENTICVAAILGSTLNGEFEDVKLLNDLLVEKNKETGWDTPIHVDAASGGFIAPFLYPELEWDFRLPLVKSINVSGHKYGLVYAGIGWVIWRSKEDLPEELIFHINYLGADQPTFTLNFSKDNXTHSIGSSQVIAQYYQLIRLGYEGYKMVMENCNDNMAVLKEGLEKTGRFEIISKDIGVPLVAFTLKDHTHFNEFQISDMLRRYGWIVPAYTMPPDAQHVTVLRVVIREDFSRTLAERLVIDVTKVVHELDLLPARVISTNTIMVTGEAGEENDEKVLFAKKSEIETQREITKAWKKFVMDRKKMNGVC

SEQ ID NO: 462 - protein, 337 aa, Burkholderia vietnamiensis
MSIARRTTLSKFLIEQQRETNNLPADLRLLIEVVARACKAISYNVSKGALGDALGTAGSENVQGEVQKKLDILSNEILLDANEWGGNLAAMASEEMETFFPIPANYPRGEYLLVFDPLDGSSNIDVNVSIGTIFSVLRCPHGKQATEESFLQPGTEQVAAGYAVYGPQSVFVLTTGNGVNCFTLDREVGSWVLTQSNMQIPADTREYAINASNARHWYEPVQRYVSELNAGKEGPRGDNFNMRWIASMVADVHRILNRGGIFMYPADKRTPDRPGKLRLMYEANPMSFIVEQAGGAATTGTQRIMEVQPTGLHQRVPVFLGSKNEVERVTAYHNEGK

SEQ ID NO: 463 - protein, 496 aa, Nicotiana tabacum
MVLSKTASESDVSVHSTFASRYVRTSLPRFKMPENSIPKEAAYQIINDELMLDGNPRLNLASFVTTWMEPECNTLMMDSINKNYVDMDEYPVTTELQNRCVNMIAHLFNAPLGDGETAVGVGTVGSSEAIMLAGLAFKRKWQNKMKAQGKPFDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLEKSINVSGHKYGLVYAGIGWAIWRNKEDLPDELIFHINYLGADQPTFTLNFSKGSSQVIAQYYQLIRLGFEGYKNVMENCQENARVLREGIEKSGRFNIISKEIGVPLVAFSLKDNSQHNEFEISETLRRFGWIVLAYTMPPNAQHVTVLRVVIREDFSRTLAERLVIDIEKVFHGVDTLPARVNAKLAVAEANGSGVHKKTDREVQLEITTAWLKFVADKKKKTNGVC

SEQ ID NO: 464 - protein, 403 aa, Aspergillus nidulans
MATTSQPPIKLTGHKNFVYRLVFSTLTGRTIHISQIRPSSPTNPGLASHEISFLRLLEAVTNGSQMEISYTGTIIVYKPGLITGTASGVGASSGSVIRHEIPAGCTRGVSYFLIPLCLLAPFSKAPIKVLFTGPGVITSSTPTGDMSVDSVRTAILPLFNQFGIFNNIELRVLRRSNLGPNGRGGGGEVQLVFGHQVRLPKTLHLMNAGRIKRVRGVAYSVGVSASNNARMIDTCRGVLNPLVPDTYIFSDVSSAPLVPAPERNNPSAKKKIGLGFGLSLVAESSTGCLFSADVACPPSGGQPPEDIGKQCAYQLLETISKGGCVAPAAFPIMIGLMTMGSEDVGRIQVGRDIIGDESSIQLARDLMKFGAPGWGLRDAGDESNDVIISVVGRGIGNVGRKVA

SEQ ID NO: 465 - protein, 434 aa, Methanococcus maripaludis
MRTDIVSSGVGELSYEIREIVKVAKKAESSGLEVVWENIGDPIAKGEKLPLWIKEIVSETTMDDSSYGYCPTRGLLETREFLTDLNNSRNGAQITPDEIVFFNGLGDAITNIYGLMRKECRVIGPTPAYSTHSSAEGLYSNCRPVMYELDKDDGWNPDIDDLRNKVKYNPSIASILLINPGNPTGAVYSKKILSEVVDIANEYDLFILADEIYSNLVYNGKKHNYLSEVLDDVPGISLKGISKDLPWPGSRCGWTEFYNTQSDELFKKYTENICKFKMIEVCSTTLPQKVIPKIMSDKRYNKYLEERKSYYETASKYAYNKMKNIDGLNVNRTDGAFYNTIVLEKEYLNENQSLKIQDSELKNYVESISKGIPEDKRFVYYLLASTGICGVPLTSFCSEHNGMRFTLLERDEEKRNWVFETIAEKVEEYFNSSN

SEQ ID NO: 466 - protein, 496 aa, Nicotiana tabacum
MVLSKTASESDVSIHSTFASRYVRTSLPRFKMPENSIPKEAAYQIINDELMLDGNPRLNLASFVTTWMEPECNKLMMDSINKNYVDMDEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 467 - protein, 637 aa, Bacillus cereus
MKRDEFHTEKYYESYNIFGAHIVTEDEMRGVRFTVWAPHAKAMSVVGDFNEWDYEQHKMLQVTEEGIWSLFIPHIEEREIYKYAIETMAGDVIFKADPYAVYAEVRPNTASVVFDIKGYEWNDKNWSRKKKKKSVYKEAMTVYELHFGSWKKKEDGTLYSYKEMAEELIPYVVEHQFTHIEIMPLVEHPYDRSWGYQGTGYYAATSRFGTPHDLMHFVDECHKYGIGVILDWVPGHFCKDAHGLYLFDGTPTYEYKDKDVQENPVWGTVNFDLGKREVRNFLISNALFWMRYFHIDGFRVDAVANMLYWNKEGQEQSNEHAVSFLRELNEAVFAENEDFLMTAEDSTAWPLVTAPTYEGGLGFNYKWNMGWMNDVLKYMECAPEYRKYIHDKMTFSLLYAYSENFILPLSHDEVVHGKKSLLNKMPGDYWDKFAQLRLLYGYFFTHPGKKLLFMGGEFGQFDEWKDLEDLDWNLHDFEMHRYMHDYFKELIALYKRSKPLWQLDHSPEGFQWIDANNNEQSIFSFIRQGDKQEDALVVVCNFTKATYENYKVGVPDFEYYNEILNSDAEQYGGSGQVNKKRLKAIQEPYHNQAAHVEITIPPFGVSILRPVKTRKGSKKQDGSKTKVRSNVTSRGKR

SEQ ID NO: 468 - protein, 365 aa, Enterobacter cloacae
MSAEKLFTPLKVGAVTAPNRVFMAPLTRLRSIEPGDIPTPLMGEYYRQRASSGLIITEATQISAQAKGYAGAPGLHSPEQIAAWKKITAGVHAEEGRIAVQLWHTGRISHSSIQPGGQAPVSASALNANTRTSLRDENGNAIRVDTSTPRALELDEIPGIVNDFRQAVANAREAGFDLVELHSAHGYLLHQFLSPSSNHRTDQYGGNVENRARLVLEVVDAVCQEWSPDRIGIRVSPIGTFQNVDNGPNEEADALYLIEELAKRGIAYLHMSEPDWAGGQPYSEAFRQKVRERFHGVIIGAGAYTPEKAEDLINKGLIDAVAFGRDYIANPDLVARLQQKAALNPQRPESFYGGGAEGYTDYPTL

SEQ ID NO: 469 - protein, 492 aa, Arabidopsis thaliana
MDPYKYRPASSYNSPFFTTNSGAPVWNNNSSMTVGPRGLILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDIVHALKPNPKSHIQENWRILDFFSHHPESLNMFTFLFDDIGIPQDYRHMDGSGVNTYMLINKAGKAHYVKFHWKPTCGVKSLLEEDAIRLGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 470 - protein, 503 aa, Oryza sativa
MSTAAAGAAPVSLHTINPKVLKCEYAVRGEIVTHAQDFLRNLDYDLHFILQNLQQELQKNPDSLPFDEILYCNIGNPQSLGQQPVTFFREVLSLCDHPALLDKSETHALYSSDAIERAWQILDKIPGRATGAYSHSQGIKGLRDEIAAGIAARDGFHASGDNIFLTDGASPAVHMMMQLLIRSENDGILCPIPQYPLYSASIALHGGSLVPYFLDEETGWGLEVDELKKQLEEAQSKGITVRALVVINPGNPTGQVLAEENQKKIVEFCKNEGLVLLADEVYQENIYVEDKKFHSFKRIARSMGYTDDDLPLVSFQSVSKGYYGECGKRGGYMEVTGFSADVREQIYKVASVNLCSNVSGQILASLIMNPPKAGDESYESFMVEKDGILSSLARRAKALEEAFNSLEGITCNKAEGAMYLFPRIYLPQKAIGAAQAAGTAPDAYYARRLLEATGIVVVPGSGFGQVPGTWHFRCTILPQEDKIPAIISKFKEFHEKFMDEFRD

SEQ ID NO: 471 - protein, 442 aa, Magnaporthe grisea
MSAEKKTLSKPAAGVPYYTPAQEPPAGTPLQQQDAIPTLFKPLKIRGVELSNRFGVSPMCTYSADDGHLTDFHLVHLGQFALHGTALTIVEATSVTPNGRISPEDSGLWQDSQIAPLRRIVDYVHSQGQKIAIQLAHAGRKASTKAPWHDSFTPSGEYKPREGLQVVGPEYGGWPDDVWAPSAIPFSEDFPNPKEMTVEEIEGLVTSFVDAAKRAIEAGVDIIEIHGAHGYLITEFLSPLSNKRTDKYGGSFENRTRVLIDIIKAVRAVIPEEMPLFVRISATEWMEYAGEPSWDLEQSTQLAKLLPNLGVDLLDVSSGGNSVAQKIELTPYYQIDLAAKIREAVGDRLLIGAVGNINTADIARDVVDEQGAEKVAEAKQTHDTIEVVSESHGGKTKADLVLIARQFLREPEFVLRTAHNLGVNVQWPHQYHRAVWRKGARI

SEQ ID NO: 472 - protein, 436 aa, Arabidopsis thaliana
MGKGPLSFRRLSSIRHRKKGSAVKDDSAQTSTPSSPPPPLPIHAGGSAVGATGKAKKKTGGARLWMRFDRTGAMEVVECDKSTIIKRASVPARDLRILGPVFSHSSNILAREKAIVVNLEVIKAIVTAEEVLLLDPLRPEVLPFVERLKQQFPQRNGNENALQASANVQSPLDPEAAEGLQSELPFEFQVLEIALEVVCSFVDKSVAALETEAWPVLDELTKNVSTENLEYVRSLKSNLTRLLARVQKVRDELEHLLDDNEDMADLYLTRKWIQNQQTEAILAGTASNSIALPAHNTSNLHRLTSNRSASMVTSNTEEDDVEDLEMLLEAYFMQLDGMRNKILTVREYIDDTEDYVNIQLDNQRNELIQLQLTLTIASFAIAAETLLASLFGMNIPCPLYSIHGVFGYFVWSVTALCIVLFMVTLGYARWKKLLGS

SEQ ID NO: 473 - protein, 445 aa, Unknown
  Phalaenopsis hybrid cultivar
MARGIGLGAPLSKIAVSKAHGEDSPYFAGWKAYDEDPYDPVANPTGVIQMGLAENQVSFDLLEDYLEQHPETASWSSGISGFKENALFQDYHGLQSFRKAMASLMEQIRGKRVKFNPDRMVLTAGATAANELLTFILADPGDAVLVPTPYYPGFDRDLQWRTGVKIFPVHCHSSNGFQLTLPSLQSAYSIAEASNLRVKALLITNPSNPLGTTMPRSLLEDILNFISQKNIHLISDEIYSGSVFSSPEFISVAEVVEASQHKNCDGVHIVYSLSKDLGLPGFRVGTIYSYNDRVVTTARRMSSFSLVSSQTQKMLASMLSDEEFTVKYIKTNRERLRRRHGYIVEGLKDAGIECLEGNAGLFCWMNLTQMLEEKSMEGELRLWKMILSEVKLNVSPGSSCYCAEPGWFRVCFANMTKETLEVALRRTKDFVEKIKGRKSNVIFRS

SEQ ID NO: 474 - protein, 101 aa, Zea mays
  misc_feature (14)..(14): Xaa can be any naturally occurring amino acid
  misc_feature (20)..(20): Xaa can be any naturally occurring amino acid
  misc_feature (26)..(26): Xaa can be any naturally occurring amino acid
DNHLYKLIGSPDLXFGRNFXRCPELXNTLPVLQLCYSMSHRLQLYDKKPPQHLEDTSPDAVTPLTSVTNWKIFIPVYSPYEVKAQLKYWAHAVACTLRLCS

SEQ ID NO: 475 - protein, 482 aa, Bartonella rattimassiliensis
ELEDKFENMGAQMLREVASKTNDIAGDGTTTATVLGHAIVQEGIKAVAAGMNPMDLKRGIDAAVDEVVANLFQKAKKIQTSAEIAQVGTISANGAVEVGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKSEIAARVNQIKAQIEETTSDYDREKLQERLAKLAGGVAVIRVGGATEVEVKEKKDRVDDALNATRAAVEEGIVAGGGTALLRAASALTVKGINPDQEAGINIVRRALQAPARQIATNAGEEAAIIVGKVLENNADTFGYNTATGEFGDLIALGIVDPVKVVRSALQNAASIASLLITTEAMVAEVPKKDTPMPPMPAGGMGGM

SEQ ID NO: 476 - protein, 486 aa, Bartonella rattimassiliensis
ELEDKFENMGAQMLREVASKTNDIAGDGTTTATVLGHAIVQEGIKAVAAGMNPMDLKRGIDAAVDEVVANLFQKAKKIQTSAEIAQVGTISANGAVEVGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKSEIAARVNQIKAQIEETTSDYDREKLQERLAKLAGGVAVIRVGGATEVEVKEKKDRVDDALNATRAAVEEGIVAGGGTALLRAASALTVKGINPDQEAGINIVRRALQAPARQIATNAGEEAAIIVGKVLENNADTFGYNTATGEFGDLIALGIVDPVKVVRSALQNAASIASLLITTEAMVAEVPKKDTPMPPMPAGGMGGMGGMD

SEQ ID NO: 477 - protein, 478 aa, Bartonella phoceensis
MGAQMLREVASKTNDVAGDGTTTATVLGQAIVQEGVKAVAAGMSPMGVKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLNMLGRAKKVNISKENTTIIDGAGQKNEISARVSQIKAQIEETTSDYDREKLQERLAKLAGGVAVIRVGGATEVEVKEKKDRVDDALNATRAAVEEGIVAGGGTALLRAASALTVKGSDPDEEAGINIVRRALQAPARQIATNAGEEAAIIVGKVLENNADTFGYNTATGQFGDLIALGIVDPVKVVRSALQNAASIASLLITTEAMVAETPKKDTTMPPMPAGGMGEWAEWI

SEQ ID NO: 478 - protein, 254 aa, Zea mays
MTTRQVLTEENQKKIVEFCKNERLVLLADEVYQENIYVEDKQFHSFIIIARSLGYTDDDLPLVSFQSISKGYYGECGKRGGYMEITGFSPQVRDQIYKMASINLCSNITGQILASLVMNPPKAGDESFESFRLERDGILSSLGRRAQALEEAFNSLEGITCNKAEGAMYLFPRLHLPRKAIGAAQAAGTAPDAYYAKRLLEATGIVFVPGSGFGQVPGTWHIRSTILPQEDKIPGIVSRFKEFHDKFMDEFRDY

SEQ ID NO: 479 - protein, 207 aa, Oryza sativa
MFGGGGGGGRKPLDYEELNENVKKVQYAVRGELYLRASELQKEGKKIIFTNVGNPHALGQKPLTFPRQVVALCQAPFLLDDPNVGLIFPADAIARAKHYLAMAPGGLGAYSDSRGIPGIRKEVAEFIERRDGYPSDPELIYLTDGASKGVMQMLNTIIRNERDGILVPVPQYPLYSAAISLFGGSLVPYYLEEEANWGLDFVNLRQT

SEQ ID NO: 480 - protein, 765 aa, Neurospora crassa
MQRLALHYPPLDPAAEPPTEHILQQSNPTMSNIISQAGQKAKEALTSAPSSKKVDDLKNEFKETDKSARLTTDYGVKQTTADDWLRIVSDDKIGPSLLEDPFARERIMRFDHERIPERVVHARGSGAFGKFKVYESASDLTMAPVLTDTSRETPVFVRFSTVLGSRGSADTVRDVRGFAVKFYTEEGNWDLVGNNIPVFFIQDAIKFPDVIHAGKPEPHNEVPQAQSAHNNFWDFQFNHTEATHMFTWAMSDRAIPRSLRMMQGFGVNTYTLINAQGKRHFVKFHWTPELGVHSLVWDEALKLAGQDPDFHRKDLWEAIENGAYPKWKFGIQAIAEEDEHKFDFDILDATKIWPEDLVPVRYIGEMELNRNPDEFFPQTEQIAFCTSHVVNGIGFSDDPLLQGRNFSYFDTQISRLGVNFQELPINRPVCPVMNFNRDGAMRHTISRGTVNYYPNRFDACPPASLKEGGYLEYAQKVAGIKARARSAKFKEHFSQAQLFYNSMSPIEKQHMINAFGFELDHCEDPVVYGRMVQRLADIDLGLAQTIAEMVGGEAPTTTNHPNHGRKTINLSQTEFPPATPTIKSRRVAIIIADGYDNVAYDAAYAAISANQAIPLVIGPRRSKVTAANGSTVQPHHHLEGFRSTMVDAIFIPGGAKAAETLSKNGRALHWIREAFGHLKAIGATGEAVDLVAKAIALPQVTVSSEAEVHESYGVVTLKKVKPESFTDAVKIAKGAAGFLGEFFYAIAQHRNWDRELDGLHSMIAY

SEQ ID NO: 481 - protein, 404 aa, Unknown
  Frankia sp. EAN1pec
MEFAQSDKLADVCYDVRGPILDEATRLEAAGQRILKLNIGNPAPFGFSAPPSVLAAVVENLAAAQGYSDSKGLLPAREAVVRYAAGKGMTSVTPDDVYLGNGVSELIMMSLQALLNNGDEVLLPAPDYPLWTAVVSLTGGRPVHYLCDESAGWNPDLDDIIRKITPRTRAIVIINPNNPTGAVYDRPVLEELIEVARRHHLMLFSDEIYDRILYDGAEHHSPAALAPDLFCVTFNGLSKAYRLAGFRSGWMTLSGPRQHASSYIEGLNILANMRLCANVPGQFALQAALAEGSGAGDLVLPGGRLLEQRDTVVKLLNDIPGVSCVPPRGALYAFPRIDPEVYPIDDDESFVLDLLQAERILLVQGTGFNWPRPDHVRLVTLPCVDDLTDAVGRIDRFLTTYART

SEQ ID NO: 482 - protein, 471 aa, Streptococcus pneumoniae
MTIFPDDFLWGGAVAANQVEGAYNEDGKGLSVQDVLPKGGLGEATENPTEDNLKLIGIDFYHKYKEDISLFSEMGFNVFRTSIAWSRIFPKGDEEEPNEAGLKYYDELFDELHAHGIEPLVTLSHYETPLYLARKYHGWIDRRMIHFYEKFARTVLERYKDKVKYWLTFNEVNSVLELPFTSGGIDIPKENLSKQELYQAIHHELVASSLVTKIAREINSEFKVGCMVLAMPAYPMTPNPKDVWATHEYENLNYLFSDVHVRGYYPNYAKRYFKEHDINIEFAAEDAELLKNYTVDFLSFSYYMSVTQSALPTQYNSGEGNIIGGLVNPYLESSEWGWQIDPIGLRIILNRYYDRYQIPLFIVENGLGAKDQLIKDEFNNLTVQDDYRIQYMKEHLLQVAEALQDGVEIMGYTSWGCIDCVSMSTAQLSKRYGLIYVDRNDDGNGTFNRYKKMSFTWYKGVIESNGESLFK

SEQ ID NO: 483 - protein, 476 aa, Lycopersicon esculentum
MDLETSEISNYKSSAVLSKLASNEQHGENSPYFDGWKAYDNDPFHLVNNLNGVIQMGLAENQLSVDLIEEWIKRNPKASICANDGIESFRRIANFQDYHGLPEFTNAIAKFMEKTRGGKVKFDAKRVVMAGGATGANETLILCLADPGDAFLVPTPYYPGFNRDLRWRSGVQLLPISCKSCNNFKITIEAIEEAYEKGQQANVKIKGLILTNPCNPLGTILDRDTLKKISTLTNEHNIHLVCDEIYAATVFNPPKFVSIAEIINEDNCINKDLVHIVSSLSKDLGFPGFRVGIVYSFNDDVVNCARKMSSFGLVSTQTQHLLAFMLSDDEFVEEFLIESAKRLRERYEKFTRGLEEIGIKCLESNAGVYCWMDLRSLLKEATLDAEMSLWKLIINEVKLNVSPGSSFNCSEVGWFRVCFANIDDQTMEIALARIRMFMDAYNNVNKNGVMKNKHNGRGTTYDLTPQMGSTMKMLLA

SEQ ID NO: 484 - protein, 369 aa, Pseudomonas aeruginosa
MSNLLLSPLAVGNLALRNRIVMAPMTRSRAQQPGDVPTALNALYYAQRAGAGLIVSEGTQISRLGQGYAYTPGIYSEAQLAGWRQVTEAVHAAGGLIAAQLWHVGRMSHRSLQAGGEAPIAPSPIQAKAQVFIADGQGGGSMAPADAPREMTLEDIRRVRDEFVRAARNALDAGFDLVELHGANGYLIDQFLASASNRRSDAYGGSLENRARFLLEIVDALVAAVGAERVGLRLSPWGTINDMHDDEPEAMTLYLAEALQRRGIAYLHLAEWEWSGGPAYPQGFRERLRERFRAPLIVCGNYDAERAEAILQAGLADAVAIGRPFIANPDLVERIRLGAPLAEANQARFYGGDAAGYTDYPTLGQSATA

SEQ ID NO: 485 - protein, 476 aa, Lycopersicon esculentum
MDLETSEISNYKSSAVLSKLASNEQHGENSPYFDGWKAYDNDPFHLVNNLNGVIQMGLAENQLSVDLIEEWIKRNPKASICANDGIESFRRIANFQDYHGLPEFTNAIAKFMEKTRGGKVKFDAKRVVMAGGATGANETLILCLADPGDAFLVPTPYYPGFNRDLRWRSGVQLLPISCKSCNNFKITIEAIEEAYEKGQQANVKIKGLILTNPCNPLGTILDRDTLKKISTFTNEHNIHLVCDEIYAATVFNPPKFVSIAEIINEDNCINKDLVHIVSSLSKDLGFPGFRVGIVYSFNDDVVNCARKMSSFGLVSTQTQHLLAFMLSDDEFVEEFLIESAKRLRERYEKFTRGLEEIGIKCLESNAGVYCWMDLRSLLKEATLDAEMSLWKLIINEVKLNVSPGSSFNCSEVGWFRVCFANIDDQTMEIALARIRMFMDAYNNVNKNGVMKNKHNGRGTTYDLTPQMGSTMKMLLA

SEQ ID NO: 486 - protein, 441 aa, Glycine max
MSQPKIKRRVGKYEVGRTIGEGTFAKVKFARNSETGDPVALKILDKEKVLKHKMAEQIRREVATMKLIKHPNVVRLCEVMGSKTKIYIVLEFVTGGELFDKIVNHGRMSENEARRYFQQLINAVDYCHSRGVYHRDLKPENLLLDAYGNLKVSDFGLSALSQQVRDDGLLHTTCGTPNYVAPEVLNDRGYDGVTADLWSCGVILFVLVAGYLPFDDPNLMNLYKKISVAEFTCPPWLSFSARKLITRILDPDPTTRITIPEILDDEWFKKDYKPPVFEENGETNLDDVEAVFKDSEEHHVTEKKEEQPTAMNAFELISMSKGLNLENLFDTEQGFKRETRFTSKSPADEIINKIEEAAKPLGFDVQKKNYKMRLANVKAGRKGNLNVATEIFQVAPSLHMVEVRKAKGDTLEFHKFYKKLSTSLDDVVWKTEDDMQMRETK

SEQ ID NO: 487 - protein, 246 aa, Zea mays
MRMLSKACSIVASSLPRCSSSAAAPTMRGQPSLLPSVRKQWPGKPLLYGIGTLLVMPLRTLYGVGRVFGAGRFLCNMTNVSSSLQIELVPCLRDNYAYILHDVDTGTVGVVDPSEAMPIINALEKRNQNLTYILNTHHHYDHTGGNLADEGTDAWEVIGSEKDKDRIPGIDITLKEGDTWMFAGHQVLVLETPGHTTGHVCYYFAGSGAIFTGDTLFNLSCGKLFEGTPQQVFHLLANIFIYMYVV

SEQ ID NO: 488 - protein, 544 aa, Tannerella forsythensis
MAKEIKFDMNARDLLKKGVDELANAVKVTLGPKGRNVILEKKFGAPQITKDGVTVAKEIELACPYENMGAQLVKEVASKTNDKAGDGTTTATVLAQAIIGVGLKNVTAGANPMDLKRGIDKAVSKVVESIASQSEAVGTNMDRIEHVAKISANGDEGIGKLIAEAMQKVKKEGVITVEEAKGTETTVEVVEGMQFDRGYISAYFVTDTEKMETQFENPYILIYDKKISVLKDLLPILEQMVQSGRALLIIAEDIDSEALATLVVNRLRGGLKVCAVKAPGFGDRRKAMLEDIAILTGGTVITEEKGMKLEDAKMDMLGSADKVTVNKDNTTIVKGNGDKAAIESRIGQIKAQIETTTSDYDKEKLQERLAKLAGGVAVLYVGAPSEVEMKEKKDRVDDALHATRAAIEEGTVPGGGVAYLRAIPALEGLKGENEDETTGIEIVKRAIEEPLRQIVNNAGKEGAVVVQKVKEGTGAFGYNARTDVYEDLSEAGVVDPAKVTRIALENAASIAGMFLTTECVVADKKEEAPAPPMNPGMGGMGGMM

SEQ ID NO: 489 - protein, 251 aa, Buchnera aphidicola
MILKKISILSDNYVWVLLNTSGSCIIIDPGLSEPIIQEIERKKWRLRAILLTHNHIDHTGGTRKIIEYFPKISVFGPKETRQHGVNKIVSHGDRIILLDKIFYVFFTPGHTSGHVSYYSQPYIFCGDTLFSAGCGRVFKNKHLEMYRSIKIISSLPDSTLLCCSHEYTLSNLQFSMFILPNDNFIKLYLKKIEIKLKLGQSSLPSYIFFEKKINLFLRTNDNYVKKSIGLKSTCTDFEVFKRLRLKKDFWS

SEQ ID NO: 490 - protein, 598 aa, Unknown
  Magnetococcus sp. MC-1
MCGICGVMYFQPQTPQPAMLEKMVEKLHQRGPDGGGIEIDGQLGLGHRRLKVIDLSENGHQPMQDDALGLTIVFNGCIYNYQALRQSLLELGYSFFSTSDTEVILKAYHAWGWQCVQRFNGMFAFAIYERQSGRVVLARDRLGIKPLYIHQDKSHLRFASSIPSLLAGGGITTTLDPIALHHFLSFHSVVPAPRTLLQQVQKLPPATVRIVEKNGSETNHTYWNLQMGPQAGDAERTEAEWQQLLDQALRAAVSRRLVADVPVGLLLSGGLDSSLMAGLLVESGQLSRGGLSTFSIGFEQAGGEEGDEFQYSDIVAAHFGTDHHKIFIETNNLPELLRETVRAMSEPMVSHDAVGFYLLSREVAKHVKVVQSGQGADEVFAGYHWYPKVDAGQDAFQDYRKAFFDRSHEECCEMVHRDIAAAWQQDYSSAFVESWFAHPHSGTAAVDKALHLDQNIMLVDDPVKRVDNMTMAWGLEARVPFLDHELVELAARIPGHLKLQQGGKGILKEVARPIIPHAVIDRAKGYFPVPALKHMDGPVLKLAKEVLTSPRATQRGLIQPSYINRLLDHPTQHITPLHGSKLWQLTLLELWLQTHDIH

SEQ ID NO: 491 - protein, 145 aa, Carboxydothermus hydrogenoformans
MLIPFDPWREMLNFKNQMERFFERGDFLEPFNPARLFSPRVEIFEEGADVVVRAEIPGLNAKEDLEVIVEPESLTLRGEIRDERERKQERFYRSERYYGKFSRTIALPAEVEPDHARASYQNGILEVRMKKSGKNNPRARRIEIQ

SEQ ID NO: 492 - protein, 327 aa, Magnetospirillum magnetotacticum
MPSLFDPITLGALTLPNRILMAPLTRGRATRTHVPTPMMAEYYAQRASAGLIISEATGISQEGLGWPYAPGIWSDEQVEAWKPVVKAVHDAGGRIVSQLWHMGYLVHSDFLGGEPPVAPSVATAPDQAHTYEGKKPYSQARALREDEIPRLIADYERAARNALAAGFDGVQIHAANGYLLDEFIRDGSNKRSDRYGGSVENRVRLVTKVAQAVAGVVGPERTGIRFSPNGPIQGVDDSNPHETFGLAAEMMERVGLAFIELREPGPNGTFGKATVAPVAPVIKERFGGPVILNCDYDGERAKAAVASGEADAIAFGRPYIANPDLPE

SEQ ID NO: 493 - protein, 175 aa, Sinorhizobium meliloti
MAEPATKLPIKSEEKGVERRAESWLPFESLRSEIDRLFDDFAPSLWHRPLASALMRRVPRLSELDVAPAVDLAETEKTYEITCELPGMEEKDIEVAISNGTLTIRGEKQEEKKENKKEYVLSERRYGSFQRTFRMPDGVDTEKIAAKFSKSVLSITLPKTPEAQQNERKIQIKVT

SEQ ID NO: 494 - protein, 435 aa, Arabidopsis thaliana
MGSWIPKLLLLQLVLLLTKHADSSSIIKYLPGFEGPLPFELETGYIGVGDEDEDQMFYYFIKSESNPEEDPLLVWLSGGPGCSSFTGLVYENGPLGFKVEAYNGSIPTLVSTTYSWTKVANIIYLDQPVGAGFSYSRNPFADRPSDTGSAKLVNEFVRKWLAKHPDYFSNPFYVTGNSYSGKVIPAIVQEISNGNYICCKPQINLQGYVIGNPVAYYDHDKDSRIPFAHGVALISDELFESLKRSCGGSYSIVDPLNTECLKLIKDYHKCVSGIYQELILKPKCETTSPDCYTYRYLLSIYWANNEIVRRALKVVEGSKGKWERCDLSVRSNQDIKSSIPYHMNNSIKGYRSLVISGDHDMTIPFLGTQAWIRSLNYSITEKWRPWMILDQVAGYTKTYANKMTLATVKGGGHTLEYKPEENSILFKRWISGQPL

SEQ ID NO: 495 - protein, 411 aa, Arabidopsis thaliana
MSLTLEFLLLLIVLILSHHAHSGSIVKFLPGFEGPLPFELETGYIGIGEEEEVQLFYYFIKSEKNPEEDPLLLWLSGGPGCSSLTGLLFENGPVALKFEVYNGSVPSLVSTTYSWTKMANIIFLDQPVGSGFSYSRTPLVDKISDTGEVKRIYEFLQKWLSKHQQFFSNPFYVGGDSYSGMIVPPLVQEIGKGNYQINLQGYILGNPITDTESEQNYQIPYAHGMALISDELYKSMERICKGNYVKVDSLNTKCYKLIKDYQKCIHKLNKYHILLPDCDITSPDCFLYRYTLITFWANNKSVREALQVNKGSIGKWVQCNYKNISYNYDIKSSVAYHMKNSIDGYRSLIYNGDHDMMVPFLATQAWIRSLNYSITDDWKPWMINDQIAGYTRSYSNKMTFATIKASLLVST

SEQ ID NO: 496 - protein, 1342 aa, Oryza sativa
MSDCNSGGGERRPNARATDAPPVRAPSGGAFRCRGCGACVILIAKYNPKTDEVTEFNASSCLTLLYSIHFCSIITTEGLGNTKDGFHAIQKRMSGFHASQCGFCTPGMCMSIFSSLVNADKSKKPDPPKGFSKLSVSEAERSFSGNMCRCTGYRPIVDACKSFASDVDLEDLGLNIFWKKGDKHPDPTKLPSYTLGGGICTFPDFLKSEIKSSIDFNDASISSPREGWYCPKNIKQYYKLVNSGLFSESSVKVVVGNTSTGVYKDQDLYDKYIDIAGIPELSAIVRKDKGIEIGAATSISRTIEILNQESESTSSPNGSVVFRKLAEHMSKVASPFVRNTASIGGNIILAHKYPFRSDIATILLGAAATVNLQVSSKTLHVTLEQFLEQPPLGHNTLLLSIFIPHWASDCKKEHTLVFETYRAAPRPLGNAVSYVNSAFLGHVSLDKSSGDNILSNLHLAFGAYGTEHAIRARKVEEYLTGKILSASVVLEAIRLLRETIVPVEGTTHPEYRVSVAVGFLFSFLSPLCKGVIEPGKTLSISEDLVHTDNVHNMPLSSRRETLSGDEYKPVGDPIKKYKVELQASGEAIYVDDIPAPKNCLYGEFIYSTQPLANVKSIKFKPSLASKKILTVVSAKDIPTGGRNIGSTFLFGDEEPLFGDPIAEFAGQALGVVIAETQRYADMAAKQAVVEYTTDGLKAPILTVEQAVQNNSYFQVPPERAPKQVGDFSKGMAEADHKIMSEEVKLASQYYFYMETQTALAIPDEDNTMTVYSSSQFPELAQNVISKCLGIPFNNVRVITRRAGGGFGGKAVRSLHIATAAALCAHTLRRPVRMYLNRNTDMIMVGGRHPMKARYSVGFKSDGKITALHLDLLINAGISADASPVIPGTIISGLKKYNWGALSFDVKLCKTNNTSKSVMRAPGDTQGSFIAEAIIEHVAAILSLDANTVRQKNFHTYDSLVLFYPDSAGESSTYTLHSIFDRLASTSRYLQRVESIKKFNSTNKWRKRGISSVPLIFKVEPRPAPGRVSVLNDGSIVVEVGGVELGQGLWTKVQQMTAFALGQLWPKGCEGLLDRIRVLQSDTLNLIQGGLTAGSTTSESSCAATLQACNMLIERLKPVMERLQLQSDTVSWDTLISQASQENINLSASAYWVPEQDSNFYLNYGAGTSEVEVDLLTGAITIIRSDLIYDCGKSLNPAVDLGQIEGSFIQGIGFFIYEEHQTNSDGLVISNSTWDYKIPSVDTIPKQFNAEVLNTGYHKHRVLSSKASGEPAVVLGASVHCAVREAIRAARIEFAGNNGSGSSLLTFQLDVPAPMTVVKELCGLDIVEKYLEDLSNRGAASGN

SEQ ID NO: 497 - protein, 475 aa, Lactobacillus gasseri
MSTLLKRVKKLPKGFVWGAATAAYQVEGNTNLDGKGKIMWDDYLKNQGNFSPNPACDFYHRYPEDLKIAHNLGLNAIRISIAWTRIFPNGYVTDEPNEAGVKYYHRLFHECLKNNLVPYVTLHHFDSPKTLFDQGDWLNREMIDEFVKYADFCFQEFVEVDNWFTINELISLAMCQYIQGTFPPNKLFDVSDAIQAQHNELVAHAKVVNLFKAKGYKGRIGLIHVIQPVYPATNSEADRHAADLRDAFMNRFLLDGTLLGFYSDRTRHLIKEILVANNAELHILPEDLEILKQASKQNDMLGINYYQNQTVASYDGPSETYHNGNGKKGSSVFAFHGVGKDVRNPAIPTTDWDWNIYPEGLYDVLKRIAHDYPDYPVIYITENGMGAKEAWDSSKEYLDDNYRIDFIDQHLAAILKARNEGVNVQGYFLWSLQDQFSWSNGYNKRYGLIYVDFASQDRHLKRSALWFKALSKTMK

SEQ ID NO: 498 - protein, 369 aa, Yersinia pestis
MDKLFTPFKVGDTELVNRVVMAPMTRSRATVGDTADELTAKYYQQRASAGLIITEGSQISVQGQGYLFTPGIYNDAQVKGWERVTNAVHNAGGKIYIQLWHVGRISHTGLQNDGQAPVSSVAVKAKNSTCYARDENGQPGLVPVSEPRALSVSEIKDIVQDYVQAADNAIRAGFDGVEIHAANGYLLEQFINGGLNTRQDEYGGADPENRLRFVLEVTDAISQAIGAGKTGIRLAPFGRLFDMHPFEGEEETWLLLAKELSTRSLSYVHLSDQQTLGEQAIPAGFIEKFRAAYDGPLIIAGGFDKQRAEQYLQQGKADLIGFGRPYIANPDLVERMVNDWPLNQVDRATMYGGDEKGYTDYPVWSDTQA

SEQ ID NO: 499 - protein, 542 aa, Unknown
  Rhizobium sp. NGR234
MAAKEVRFHTDAREKMLRGVDILANAVKVTLGPKGRNVVLDKSFGAPRITKDGVTVAKEVELEDKFENMGAQMVREVASKTSDIAGDGTTTATVLAQAIVKEGAKAVASGMNPMDLKRGIDKAVDAIVEELKTNARRVTKNDEIAQVGTISANGDIEIGRFLAEAVEKVGNEGVITVEEAKTAVTELEVVEGMQFDRGYLSPYFVTNPDKMRVELEEPYLLIHEKKLSNLQALLPVLESVVQSGKPLLIIAEDVEGEALATPVVNKLRGGLKIAAVKAPGFGDRRKAMLEDIAILTGGTAISEDLGIKLENVTLNMLGRAKKVVVEKENTTIVDGAGSKSEIQGRVAQIRAQIEETTSDYDREKLQERLAKLAGGVAVIRVGGSTEVEVKERKDRVDDAMHATRAAVEEGVLPGGGVALLRAVKALDSIRTENADQKHGIEIVRRALEAPVRQIAENAGAEGSIIVGKLREKTEFGFGWNAQTNEFGDLYDQGVIDPVKVVRTALQDAASVAGLLITTEAMVAEKPKKDAPLPPMPGGGMDF

SEQ ID NO: 500 - protein, 537 aa, Dehalococcoides ethenogenes
MAKQIIFGEKVRVSLKKGVDTLANTVRVTLGPKGHPVALERKWGAPTVIDDGVTIARDIELPDAFENMGAQLVKEAATRTSDAAGDGTTTSIVLAQALINEAFKNIAAGAEPINLKRGIEKAVAALKAQLRKNSTPVKGKQQIVQVATITGKDPEIGNLIADVMDKVGKDGVITIEESRGLRYETSYVEGMQFDRGYISAYFVTDPGRMESIMEDATILMTDRKIETVAELLPALEKILQISKNLVIVAENVEAEALATLVVNKLRGNLNILAVKAPGYGDRQKAMLEDMAILTGGHVISKEAGRKLDSVTEADLGHARRVVSNKDKTTIIDGEGSAEAIKNRIKQIKAQIEETESAFDREKLQERQAALVGGVAVIAVGAATETEMKERKARVEDALAATRAAIEEGILPGGGTGLLNALPCLDALKLEGDEATGVSIVRKALIEPVRWIATNAGKDGNVIVDKVKNSPVGHGYNAEKDVFGDMAEMGIIDPTMVVRSALENASSIANMVLITDSLVADIQDKNPAPPMPEAPGMY

SEQ ID NO: 501 - protein, 384 aa, Pleurotus sajor-caju
MPTQEVFDKQDGAVYTTSNGAPVAEPYAAQRAGLHGPLLLQDFHHIDLLAHFDRERIPERVVHANAAGAHGYFEVTHSCADITSNKLLCSVGKKVRLTARFSTVGGESGSADTARDPRGFALKLRTEEGNWDWVFNNTPIFFIRDPAKFPHFIHTQKRDPQTHLKDADMFWDYLGQNPESIHQMMILFSDRGTPDGVRQMHGYSGHTFKWLKDDGSFTYVQVHCRADSGFKTLDGDTAHRLTADNPDYSTEMLFRTIEAGKFPSWTVYIQTMTPEQAENFRYNILDLTKVWPHKEFPLRPIGRFVLDENPKNYFAEIEQAAFAPSHLVPYIEPSADPVLQSRLFSYPDTHRHRLGANYHQIPVNAPIVPVANFQRDGPMTVNNN

SEQ ID NO: 502 - protein, 700 aa, Oryza sativa
MSVSSSSMGGGGGGDAGGRTVVWFRRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 503 - protein, 497 aa, Erwinia carotovora
MTTHVVTHHAVTHVVWLRNDLRITDNLALYAACQDPSATVLAVFIATPAQWEKHDMAPRQAAFLLENLTLVQHVLAEKGIPLHYHECADFAASVDWLMQFCAEQQATDLFYNHQYEINERLRDKQVKDRLADSVVCHGYHDSLLLPPGSVLTGNGEMYKVFTPFRQAFIKRLLEADTTCVPAPDARGEPINNTAELVPFSYPQCEVDSEDFPCGERAALQQLRRFCREQVQDYDQQRDFPALPGTSKLSPYLALGIVSPRQCFNRLRAECPDMLERREGGAFTWFNELVWREFYRHLIVSWPQLCKHRPFTAWTQWVKWRESPEDLTAWQQGKTGYPIVDAAMHQLNETGWMHNRLRMICASFLVKDLLIDWREGERYFMSQLLDGDLAANNGGWQWAASTGTDAAPYFRIFNPTTQGERFDPDGRFIRHWLPELAAVPDKDIHQPHRWADKQHVKLNYPLPIVDHKTARLDTLAAFEAAKNIGMANNDREEKSKYA

SEQ ID NO: 504 - protein, 422 aa, Glycine max
MNSERQSTTTTLLHGKYELGRVLGHGSFAKVYHARNLKTGQHVAMKVVGKEKVIKVGMMEQVKREISVMKMVKHPNIVELHEVMASKSKIYISIELVRGGELFNKVSKGRLKEDLARLYFQQLISAVDFCHSRGVYHRDLKPENLLLDEHGNLKVSDFGLTAFSDHLKEDGLLHTTCGTPAYVSPEVIAKKGYDGAKADIWSCGVILYVLLAGFLPFQDDNLVAMYKKIHRGDFKCPPWFSLDARKLVTKLLDPNPNTRISISKVMESSWFKKQVPRKVEEVVEKVDLEEKIENQETMNAFHIISLSEGFNLSPLFEEKRKEEMRFATAGTPSSVISRLEEVAKAGKFDVKSSETKVRLQGQERGRKGKLAIAADIYAVTPSFMVVEVKKDNGDTLEYNQFCSKQLRPALKDIFWNSAPASA

SEQ ID NO: 505 - protein, 359 aa, Unknown
  uncultured marine gamma proteobacterium EBAC20E09
MIFEPYKLKNITLRNRVVMAPMTRNQSPGGIPTQDVVSYYSRRSKAEVGLIITEGIEVSHKASSAYPNVPRLDSENAREGWKKVVNGIKKHDGSVIAQLWHCGGFRKLGMQPDPEVPGYTASGLVKPGKKVAHEMTLDDIKETIEAYASDAKICEELGFDGIEIHGAHGYLIDNFFWSGTNIRDDQYGGTIEKRSQFVVDIIKAIRDQVSNEFIVGLRFSQWKQHDFEAKLALNPEELKKVLIEPVNSGLDYVHSSMRRFWEKEFENSEENLAYWTKKITKIPTIGVGSVGLDSDFIDMTAPASPTSIERAIEDISKNKYDMIAVGRALLSDPEWVLKMKEGRLNDVIPYTKEALLNLY

SEQ ID NO: 506 - protein, 508 aa, Haemophilus influenzae
MSSQCPFSHLAATNLTMGNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDLVGNNTPVFFLRDPRKFPDLNKAVKRDPRTNMRSATNNWDFWTLLPEALHQVTVVMSDRGIPASYRHMHGFGSHTYSFWNEAGERFWVKFHFRTQQGIKNLTDAEAAEIIANDRESHQRDLYEAIERGDFPKWTLFVQIMPEADAEKVPYHPFDLTKVWSKKDYPLIEVGEFELNRNPENFFADVEQSAFAPSNLVPGIGASPDRMLQARLFNYADAQRYRLGVCYRQIPVNRPRCPVHSNQRDGQGRVDGTYGSLPHYEPNSFSQWQQQPDFAEPPLRISGDAAHWDYRTDDNDYFSQPRALFNLMNAEQKQSLFNNTAAAMGDAPDFIKYRHIRNCHWCDAAYGEGVAKALGLTVEDALKARDTDPALGQGGLL

SEQ ID NO: 507 - protein, 641 aa, Bordetella parapertussis
MCGIVGIWGPLRDKANVLAESCRRIRHRGPDSNGYWEDAEADLALAHVRLAILDLTEAGHQPMVSACGRYVIVLNGEIYNHMELRERLQQDGLAPAWRGHSDTETVLACFAGWGLEQTLQAAVGMFAIALWDRAERKLALMRDRMGEKPLYYGYSQANLLFGSELKAFMPVPGFGRELDRNALASFMRHNYIPAPQSIYAGIRKLPPGAWVEIDAAQMRRGELPEPQVYWSARRAADQGLGDRRRFESDAQAIDALEQVVSQAVRGQMLSDVSLGAFLSGGIDSSTVVALMQAQSAQPVRTFAIGFHEKGYNEAEHAKAVAAHLGTEHTELYVTAEDGLAVVPSLADMYDEPFADSSQIPTSLVTRMARQHVTVALSGDGGDELFGGYSRYFRVDNWWRKCAAMPGPLRHLAGAALRGSAALPGAGAWRGKVGKLGELLGADTRGEFYRLFVSYWADPGRVVIGGTEPLSPFEQPMEGSTFDAMMKLDTVTYLPDDILVKVDRAAMAVSLETRVPLIDHRVYEFAWQLPFEYKVRGGTGKWLLRQLLYRHVPQAMVDRPKRGFAVPLAAWLRGPLRDWAEALLDPARLRQEGWFEPEPILRKWREHLSGHRNWDSHLWGVLMMQAWLDRYRAGAGDEAGRR

SEQ ID NO: 508 - protein, 505 aa, Oryza sativa
MVLSHASSGRDDAVRCTFATRYACETLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGIQEHHAELHGEHSNTKGRHRGDWSIRNPLQGGRCALGGVLAQGQRQVHRVRHLRAPEEVRLDRAGVHHAGQRRARRRPPRRHQGGLQPEPRRAARLGHRQDPARAGRPFGPGAEDLQRHREAAIGRRWRGHQEERPGDREGDLRVLEGPGEEEADRNLLVWLCEKCLNNVACSICAWDGRIGWD

SEQ ID NO: 509 - protein, 358 aa, Methylobacillus flagellatus
MPADLFSPTKLGSIALKNRIVMAPLTRNRAGKGNVPQPINAEYYAQRASAGLIITEATPISPTAHGYPATPGIHEPEQVEGWKLVTKAVHDKGGKIVLQLWHVGRISHPSLQPGNALPVAPSAIKPAGQAFTYEGLQDFVTPRALAIEELPGIVADYAQATRNALEAGFDGVEIHAANGYLLDQFLRDSTNRRTDEYGGSIENRTRLLLEVTQAVVDVAGADRVGVRISPLNPFNDISDSNPQALFNHVADSLSPFGLAYLHVVEGGMGGGDIPPFDFSALRRHFKGGYIANLGYDKAKGNAAIASGHADAVAYGSLYIANPDLVERFQQDAPLNTPDQATFYGGDAKGYTDYPTLQG

SEQ ID NO: 510 - protein, 284 aa, Arabidopsis thaliana
FLQLLQISYFPENHFPKKNKTFPFVLLPPTAITAYQSELGGDSSPLRKSGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQSQPFDSRNYFQVAALQPNNHHYSSAGRQDQTALQLV

SEQ ID NO: 511 - protein, 480 aa, Photorhabdus luminescens
MKKRGLTTNAGTPVVDNNNVMTAGQRGPMLLQDVWFLEKLAHFDREVIPERRMHAKGSGAHGVFVVTHDITKYTRAKIFSEIGKKTEMFARFSTVAGERGAADAERDIRGFALKFYTEEGNWDLVGNNTPIFYLRDPLKFPDLNHVVKRDPHTNLRNPAYKWDFFSHQPESLHQLTIDFSDRGVPKSFRHMHGFGSHTFSFINADNERFWVKFHFRCQQGIKNLMDEEAEALVGKDRESSQRDLFAAIEQGDYPRWKLKVQIMPEKEANLLPYNPFDLTKVWPHGDYPMIDVGYFELNRNPDNYFSDVEQAAFNPANVVPGISFSPDKMLQGRLFSYGDAQRYRLGVNHHQIPVNTPRCPFHNYHRDGAMRVDGNSGNTVTYEPNNAGLFQEQPEFKHPSLSLEGDADHWNHRQDEDYFSQPRKLFMLINSKEHQRMFDRIASELSQAHEDTQRRQVELFRKVHPEYGAGVENALKKIKG

SEQ ID NO: 512 - protein, 440 aa, Leptospira interrogans
MGAPLKTPDGFNIGTLCVFDSQPKHLNPKQRVILKALSNQIIYNFELNKKNIELLLIQKKEEELQKSKSLFFANMSHEIRTPVHGILGVSGLLSETELQQEQKEYVDTIQRSGKLLLNLLNDILDFSKLESFNMKIEIIAFDLIDLLKDVFHLFEADAKRKNIEFKLVGKQPSHSIVSTDPHRFKQILVNLISNAIKFTEKGSVLIEFDFKSDLKHCDIQIRIKDTGVGIPEQKLKELFQAYRQVDTSVSRKYGGTGLGLSISKNLSEMMNLKLTARSIINQGSVFEISGQIPLAEKSEVNFEPKKATQNIEIQNLNILVAEDNETNQMLIKKILEKLGYKPVIVSNGIEALHHIKMYKTDVLFLDIQMPELNGIEAAKILTQQNDSSIRPYIIAMTANASQTDKEDCMASGIDQYLSKPFHKEEIADLLNQFISHKTTN

SEQ ID NO: 513 - protein, 147 aa, Alkalilimnicola ehrlichei
MQYLHTMVRVSDLDASLDFYCNKLGLVEISRKESEKGRFTLVFLAAPDDEARARSADKAPMLELTYNWDPETYTGGRNFGHLAFRVPDIYGLCQRLMDSGVTINRPPRDGHMAFVRSPDGISIELLQAGEALPPKEPWASMANTGTW

SEQ ID NO: 514 - protein, 542 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMEPCAGGELFDRIQEKGHYSERKAAELIRIIVSIVAMCHSLGVMHRDLKPENFLLLDKDDDLSIKAIDFGLSVFFKPGQVFTELVGSPYYVAPEVWHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQVH

SEQ ID NO: 515 - protein, 313 aa, Medicago sativa
MATAIKFFQLNTGAKIPSVGLGTWQAEPGVVAKAVTTAVQVGYRHIDCAEAYKNQSEIGSALKKLCEDGVVKREELWITSKLWCSDHHPEDVPKALDKTLNDLQLDYLDLYLIHWPVSMKRGTGEFMGENLDHADIPSTWKALGALYDSGKAKAIGVSNFSTKKLQDLLDVARVPPAVNQVELHPGWQQAKLHAFCESKGIHLSGYSPLGSPGVLKSDILKNPVVKEIAEKLGKTPGQVALRWGLQAGHSVLPKSTNEARIKKNLDVYDWSIPEDLFPKFSEIKQDKLIKGTFFVNDTYGAFRTIEELWDGEV

SEQ ID NO: 516 - protein, 338 aa, Unknown
  Frankia sp. CcI3
MAGFQPATHIPETGYSENGYGADGSTPRRKTISNSYLHRLQRRHFLLFDVLPIAGTAAAIAFLAVHPIGATELALLFSMWLLTGLGITVGYHRLFTHRAFKAAPAAAAALAVLGSMAGQGGVVSWVALHRRHHECSDRDGDPHSPNLAGNGLKGRLRGLAHSHFLWMRRHEYPNVVHYAPDLIKNRALVRVARLYYYWVTLGLLLPALVGGLVYQSWTGAVSGFLWGGLVRMFVLEHVIWGINSFLHMFGTRPYESRENSRNGGIFALLSLGESWHNNHHAFPDSPSFGLRWYRLDPGYWLIRLLAVSGLAWDVKLPSEERMAAKRIAARRSAPSTAV

SEQ ID NO: 517 - protein, 830 aa, Solanum tuberosum
EKSSYNSESRPSTVAASGKVLVPGTQSDSSSSSTDQFEFTETSPENSPASTDVDSSTMEHASQIKTENDDVEPSSDLTGSVEELDFASSLQLQEGGKLEESKTLNTSEETIIDESDRIRERGIPPPGLGQKIYEIDPLLTNYRQHLDYRYSQYKKLREAIDKYEGGLEAFSRGYEKMGFTRSATGITYREWAPGAQSAALIGDFNNWDANADIMTRNEFGVWEIFLPNNVDGSPAIPHGSRVKIRMDTPSGVKDSIPAWINYSLQLPDEIPYNGIYYDPPEEERYIFQHPRPKKPKSLRIYESHIGMSSPEPKINSYVNFRDEVLPRIKKLGYNAVQIMAIQEHSYYASFGYHVTNFFAPSSRFGTPDDLKSLIDKAHELGIVVLMDIVHSHASNNTLDGLNMFDGTDSCYFHSGARGYHWMWDSRLFNYGNWEVLRYLLSNARWWLDEFKFDGFRFDGVTSIMYTHHGLSVGFTGNYKEYFGLATDVDAVVYLMLVNDLIHGLFPDAITIGEDVSGMPTFCIPVQDGGVGFDYRLHMAIADKWIELLKKRDEDWRVGDIVHTLTNRRWSEKCVSYAESHDQALVGDKTIAFWLMDKDMYDFMALDRPSTSLIDRGIALHKMIRLVTMGLGGEGYLNFMGNEFGHPEWIDFPRAEQHLSDGSVIPGNQFSYDKCRRRFDLGDAEYLRYRGLQEFDRAMQYLEDKYEFMTSEHQFISRKDEGDRMIVFEKGNLVFVFNFHWTKSYSDYRIGCLKPGKYKVALDSDDPLFGGFGRIDHNAEYFTFEGWYDDRPRSIMVYAPSRTAVVYALVDKEEEEEEEVAVVEEVVVEEE

SEQ ID NO: 518 - protein, 422 aa, Geobacillus stearothermophilus
LIAANPTDLEVYLFHEGSLHKSYELFGAHVIDEGGRAATRFCVWAPHARDVRLVGSFNGWDGAKFRLTKVNDEGVWTIVVPENLEGHLYKYEIVTPDGRVLLKADPYAFCSELRPHTASIVYDLKGYQWNDQSWQRKKRRKRIYEQPMVIYELHFGSWKKKEDRFLTYREMADELIPYVLERGFTHIELLPLVEHPLDRSWGYQGTGYYAVTSRYGAPHDFMYFVDRCHQAGIGVILDWVPGHFCKDAHGLYMFDGAPTYEYANEKDRENYVWGTANFDLGKPEVRSFLISNALFWLEYYHVDGFRVDAVANMLYWPNNDQLYENPYAVEFLRKLNEAVFAYDPNVLMIAEDSTDWPRMTAPTYDGGLGFNYKWNMGWMNDMLKYMETPPHERKHAHNQVTFSLLYVYSENFILPPVVLVEL

SEQ ID NO: 519 - protein, 433 aa, Arabidopsis thaliana
MSLKIKFLLLLVLYHHVDSASIVKFLPGFEGPLPFELETGYIGIGEDENVQFFYYFIKSENNPKEDPLLIWLNGGPGCSCLGGIIFENGPVGLKFEVFNGSAPSLFSTTYSWTKMANIIFLDQPVGSGFSYSKTPIDKTGDISEVKRTHEFLQKWLSRHPQYFSNPLYVVGDSYSGMIVPALVQEISQGNYICCEPPINLQGYMLGNPVTYMDFEQNFRIPYAYGMGLISDEIYEPMKRICNGNYYNVDPSNTQCLKLTEEYHKCTAKINIHHILTPDCDVTNVTSPDCYYYPYHLIECWANDESVREALHIEKGSKGKWARCNRTIPYNHDIVSSIPYHMNNSISGYRSLIYSGDHDIAVPFLATQAWIRSLNYSPIHNWRPWMINNQIAGYTRAYSNKMTFATIKASGHTAEYRPNETFIMFQRWISGQPL

SEQ ID NO: 520 - protein, 437 aa, Arabidopsis thaliana
MSLILKFMLLILLVSSHHVRSGSIVKFLPGFKGPLPFELETGYIGIGEEENVQFFYYFIKSDKNPQEDPLIIWLNGGPGCSCLSGLFFENGPLALKNKVYNGSVPSLVSTTYSWTKTANIIFLDQPVGSGFSYSKTPIERTSDTSEVKKIHEFLQKWLIKHPQFLSNPFYVVGDSYSGMIVPALVHEISKGNYICCNPPINLQGYVLGNPITHIEFEQNFRIPYAHGMSLISDELYESLKRICKGNYFSVDPSNKKCLKLVEEYHKCTDNINSHHTLIANCDDSNTQHISPDCYYYPYHLVECWANNESVREALHVDKGSIGEWIRDHRGIPYKSDIRSSIPYHMNNSINGYRSLIFSGDHDITMPFQATQAWIKSLNYSIIDDWRPWMIKGQIAGYTRTYSNKMTFATVKASGHTAEYLPEESSIMFQRWISGQPL

SEQ ID NO: 521 - protein, 97 aa, Glycine max
  misc_feature (23)..(23): Xaa can be any naturally occurring amino acid
  misc_feature (47)..(47): Xaa can be any naturally occurring amino acid
  misc_feature (56)..(56): Xaa can be any naturally occurring amino acid
  misc_feature (59)..(59): Xaa can be any naturally occurring amino acid
  misc_feature (75)..(75): Xaa can be any naturally occurring amino acid
  misc_feature (86)..(86): Xaa can be any naturally occurring amino acid
  misc_feature (88)..(88): Xaa can be any naturally occurring amino acid
CLQQDVGVGIVNALLGKIAQSGXVDSSHQGLLFLLCALCPQDVSKVXVGKLSQHGXETXNITDFLDLKFIIKPDXNSQSVFLKCIXYXMKNLSRKVS

SEQ ID NO: 522 - protein, 140 aa, Zea mays; identical to SEQ ID NO: 152

SEQ ID NO: 523 - protein, 233 aa, Debaryomyces hansenii
VHENGSFISSQFWFLGRLGDPQLLKDHGLDYVALSAIYPDQDFKNKAEAAENPLRALTEEEIHELIYETYTNAAKNAIAAGFDYIELHAAHGYLLDQFLNPATNQRTDKYGGSIENRARLVLELVDHLTTIVGASKLAIRISPWAKFQGMDAEKDSTHPTTTLSYVLHELQKRADNGKGLAYVSVVEPRAQGGDDVEKSQQVGDNTFVGQINPTYLRICLKSPIQRNKIDQEC

SEQ ID NO: 524 - protein, 632 aa, Bacillus subtilis
MCGFVGVFNKHPLAQTADQEELIKQMNQMIVHRGPDSDGYFHDEHVGFGFRRLSIIDVENGGQPLSYEDETYWIIFNGEIYNYIELREELEAKGYTFNTDSDTEVLLATYRHYKEEAASKLRGMFAFLIWNKNDHVLYGARDPFGIKPLYYTTINDQVYFASERKSLMVAQNDIEIDKEALQQYMSFQFVPEPSTLDAHVKKVEPGSQFTIRPDGDITFKTYFKANFKPVQTEEDKLVKEVRDAIYDSVNVHMRSDVPVGSFLSGGIDSSFIVSVAKEFHPSLKTFSVGFEQQGFSEVDVAKETAAALGIENISKVISPEEYMNELPKIVWHFDDPLADPAAIPLYFVAKEAKKHVTVALSGEGADELFGGYNIYREPLSLKPFERIPSGLKKMLLHVAAVMPEGMRGKSLLERGCTPLQDRYIGNAKIFEESVKKQLLKHYNPNLSYRDVTKTYFTESSSYSDINKMQYVDIHTWMRGDILLKADKMTMANSLELRVPFLDKVVFDVASKIPDELKTKNGTTKYLLRKAAEGIVPEHVLNRKKLGFPVPIRHWLKNEMNEWVRNIIQESQTDAYIHKDYVLQLLEDHCADKADNSRKIWTVLIFMIWHSINIEKRYMPEELSHQPKEVIFV

SEQ ID NO: 525 - protein, 542 aa, Cytophaga hutchinsonii
MENEKPKNTLFQMRLPIFLALAVICGIFIGAALSKKGTEQNIAGNYLRFAEILNYVQQDYVDTVDVDKLVDYSISQMLEKLDPHTSYIPASERQIADSHLESDFEGIGIEFNIIKDTIYVVSPISGGPSEKAGLMAGDKIIKVDSIQMAGNGVTSADVFKRLRGKKGTKVLLTVKRSNSSKLLTYTIIRDKIPTYSIDAAYMIDKTTGYIKISRFGDKTYNEFLTALTDLKTQGMQRLMIDLKDNGGGYLDRATNIADQLIDGNKMIVYTNGKGTKYDQEIRARVTGAFETGPVVVLINEGSASASEILSGALQDNDRGLIVGRRSFGKGLVQMPINLNDGSELRLTISRYYTPSGRSIQKPYDKEDASAYESDLLSRYEHGEFFHADSIHFNDSLKFKTLKGRTVYGGGGIMPDVFVGRDTSEYTKYLMELFNQNVIREYTLNYYQTNKAALTKMTFEEYFKSFTVTEAMLKDMLDLAAKTGVKYNEVQYKRSKDFIKNNIKAYIARSAWGNKGFYPIYNQKDEIYNKGLNAFKEAEKISQ

SEQ ID NO: 526 - protein, 411 aa, Triticum aestivum
WTPSTRTTSTWTSTQSPPSLQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAIEMVDENTICVAAILGSTLTGEYEDVKLLNDLLVEKNKKTGWNVPIHVDAASGGFIAPFLQPELEWDFRLPLVKSINVSGHKYGLVYPGVGWVIWRSKDDLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIVRELDAHAVHAIKLSNAAAAEGASKSTVDAVTEAFKGLAGNKKAGVC

SEQ ID NO: 527 - protein, 299 aa, Neurospora crassa
MAPLSKTHKLNTGDEIPAVGLGTWQSKPGQVEKAVEAALRAGYTHIDTAYAYGNEKEVGQGIKASGVPREKIWLTTKLDNDWHKHVAEAIDTSLKNLDTPYVDLYLMHWPASLVKGNTKEVYNDWDFVDTWREMQKLVDTGKVKNIGVSNFGVKNLEKLLSAESTKIVPAVNQIELHPGNPSPHLVEYLRSKGIHASAYSPLGSSDSPLYKLNSLTKLAESKGKTVQQVLLRWGVQKGWSVLPKSVTEERIKANIDLEGWSLTDEEIAQIDEVHKENSFKVCGDDWLPVKIFFGAGDSD

SEQ ID NO: 528 - protein, 590 aa, Unknown
  Azoarcus sp. EbN1
MCGIAGEIRFDGQSPDVGALERMNARQRVRGPDSGGVFVQGALGFGHRRLKIIDLSESAQQPMFDPALGLGIVFNGAIYNHAALRRELETLGYRFYSRGDTEVLLKAYHAWGQDFVQRLNGMFAFAIWERDSGRVVLGRDRLGIKPLYYSAQPGLLRFASSLPALVAAGGVDTTVDAVALNHYLSFHAVVPAPHTILAGVRKLPPATLMTIHTDGRRSERSYWSLAYAHEPGDAARSFEEWTEILLEGLRSAVGRRLVADVPVGALLSGGVDSSLIVGLMAQAGVQGLRTYNVGFEDVGGEKGNEFEYADIVAERFATIHERIFVPEAQLLARLPEAVAAMSEPMVSHDCIGFFLLSEAVSRHSKVVQSGQGADEVFGGYHWYPKLAGSVDPVGDYLAAFRDRDYDEYCRMVGAANRADDCSGAFVAAHFDLPGAIDPVDKALRLDTTVMLVDDPVKRVDNMTMAFGLEARVPFLDHELVELAARIPARHKLAHGGKGVLKEAARQVIPSAVIDRPKGYFPVPGLKYLQGQVLERVRDALTNRAARERGLFRREYVDTLLADPGAHMTPLRGSKLWQLGLLEWWLQTHVR

SEQ ID NO: 529 - protein, 315 aa, Neurospora crassa
MAATTDVQNYKFNHSMIRVKDPKESVKFYEFLGMSLLKKLSFPEAKFDLYFLGYDAPGAVSAGANLWDREGLIELTHNYGTESDPNYKINNGNVEPHRGFGHTCISVDNLQAACQRLEDAGYKFQKKLSDGRMKHIAFALDPDGYWVEIIGRKPVEETEGVKETDLKTYRMNHTMLRVKDGEKSLKFYQEVMGMKLVRTHEAKEAGFNLYFLGYGDEKQNTADREGLLELTWNYGTEKDENFSYHNGNDQPQGFGHICVSVDNIEAACERLEGLKVNWKKRLTDGRMKNVAFVLDPDNYWIELVQNERFTGQANF

SEQ ID NO: 530 - protein, 664 aa, Listeria monocytogenes
MTDYPSIFEPLTVKRMTIKNRVIMPPMGTNLAGLNGEFLEEHMNYYEQRAKGGTGLITIENACVDFPYGTNGTTQLRIDNDQYIPGFYKLTERLHKHGTCVSIQINHAGASAYPARLNGLQPVSASDIPSKKGGTVPRPLTVEEIYEIVNKYGDAARRAQQAGFDAVEIHGGHSYLLCQFLSPLYNKRTDEFGGTPENRARIVKLILEKVRAEVGPFFPIVLRFSADEFTEGGNHLEDILELLDYCQEEADILNVSAAINDNLYLQIDQMNLEDGWRSYLAKAVKDKFNKPTITSGNIRSPKAAEKILSEGYADLLAMGRGLIAEPNWVNKVASGQEDMLRKCISCNIGCADHRISKSKPIRCTVNPDIIHEDKYKETKVTRPTNVVVIGGGTAGLEAACTAAEVGCNTTLIEANEQTGGLARAIANLPDKSRIADFPNYLANRAEKLTNLKVITGTKADTALIDTFNPDVIVNATGSKPLLPPIKGLLDVIDKEGSNVHSIFGLISSIDDFTEFSNKKVAVIGGGAVGLDVVEYFSERGSDVTIVEMMPLLGKDLDMITRLSMMDIIEKNNVDVQTETALTEVAADHFKVKHDGVDAEIPFDYGFVCLGMRPERPLMEELAAYGKEKQIEIVNIGDSAATRKILEGVREGRNILTTLEKIGSL

SEQ ID NO: 531 - protein, 224 aa, Lycopersicon esculentum
MGRGRVELKRIEGKINRQVTFAKRRNGLLKKAYELSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDYQRKEHALNEANRTLKQRLMEGSQLNLQCSQMHKLWAMAGKQLKLRAMASFILWIVNLLCKLGIRMIQLQ

SEQ ID NO: 532 - protein, 367 aa, Mesorhizobium loti
MTASLFQPITLDGLTFPNRIAVAPMCQYSAEDGSASDWHLYHWMNLAMSGAGMVTVEMTDVERRGRISHGCLGLYSDDNEAAARRTLDAARRVAAPGTKFGTQLAHAGRKASNRKPWEGGGPLQPNEDPWQTVSASAMAYDTGWNVPRALDEEEILQLIERFAQAARRAERAGFDFIELHAAHGYLIFQFLSPLSNQRTDRWGGSLENRMRLVVEIARAVKKAVPKLMLGARLSVKDWVDGGFDVEDAIEVAKALKAEGIAYLCCSSGGNSPLQKLPTGPGYQVHLAEAVRKGAGIPTRAVGLIDDPQQAEAVIAEGRADMVALARAFLADPRWGWRAAATFKEKIHPAPQLARSVTTMEHWMKAAG

SEQ ID NO: 533 - protein, 415 aa, Trichodesmium erythraeum
MLTGVTVIGAGIHLSSQASLSNNAPKELIDEVWQIIDKTYVDGTFNQVDWKATRNEYLDKTYTSEEQAYDAIKEMLKKLDDPYTRFMDPEEFKNMQIDTSGELTGVGIQLTQDPDSKKLVVISPIEDTPAFDAGIQAKDIISKIDGQSTKGMNINEAVSLIRGPIGSQVILTIKRENLEIEFPIVRAKIEIHPVKYSQKESYNSLGKVGYIRLSQFSANAAGEMREAIGNLETQKVSGYILDLRSNPGGLLYASIEIARMWLKRGDIVSTVDRNGVTDRQKANNRSLTDKPLVVMVDGGSASASEILSGALQDNKRATLVGTKTFGKGLVQSVRSVGKGAGIAVTIAKYFTPNGRDINKLGIQPDVKIPLSEKQKETLQKNRDKIGTIEADPQYAKALDILNKEIAEFQNQTAQW

SEQ ID NO: 534 - protein, 347 aa, Zea mays
NSRVDPRVRPRARIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQDALSEMWELEAASRAAMENGMEEGLGDSTDERPIDFPQELRMEVDRQPVQPAIHAQGVTGRRREDQMVPSMTSSFIRAETELTADFGHTSEDSRPEVPSNIHHLQARPEREETVDGGTGNAVRVHGNHHQQNLQNNIHRVLGIAPSISEASSSWTGRDGGVVPVWSPPAASGNSDPYAADEADISSRGYLDRHPQSHTMMNWSQLSQSL

SEQ ID NO: 535 - protein, 571 aa, Pirellula sp.
MAKQIVFDDDARGPLLAGVSKLARAVRSTLGPRGRNAVLDKGWGSPKVTKDGVTVAEDIELDDPFENLGAQLVKEAASKTNDVAGDGTTTATVLSEAIFREGLKMVATGADPMALSRGIQKAVDTAIAQIAKMATPINEKSKSDIKQVATIAGNNDPQIGDVLADAFTKVGKNGVITVEEGRSNETYVDVVEGMQFDRGFLSPHFVTNQDEVTVELDDCYILLFEEKISNNKKMIPLLEAISKAKKPLLIIAEDTEGEALATLVVNKMRGILSACAVKAPGYGDRRKAILGDIAALTGGKAIFKDLGIDLESVKVSDLGRAKQIRITSEATTIVGGAGKKADIEGRVAQIRREIEATDSDYDREKLQERLAKLAGGVAQINVGAATETEMKERKALIDDARAATQAALEEGIVPGGGTALLRCRAAVEKLEKATEGDQKLGVRIIRNVLDQPMRAIANNAGLDGAVVVNRVLQMKGKTEGYDANADKYCDLVAAGIVDPAKVVRTSLTNAASVAALLLTTESLVTEIPVEEEPAGGDHHDHGMGGGMPDMGGMGMGGMGGMGGMGGMGGMM

SEQ ID NO: 536 - protein, 295 aa, Pseudomonas putida
MAGKSPLINLNNGVKMPALGLGVFAASAEETASAIASAISSGYRLIDTARSYNNEAQVGEGIRNSVDRAEMFVTTKLFNCDYGYERALRAFDESLGRLGLDYVDLYLLHWPTKDWNATIQSWKAAEKILGDGRARAIGVCNFLEDQLDELIAASDVVPAVNQIELHPYFAQKPLLAKNRALGIVTEAWSPIGCHQRWQDGDNHGGRKHPLTDPVITTIAEAHGRSAAQVILRWHFQNDVVAIPKSVNPERIAKNIDVFDFALSDAEMAQLDELDTGVRIGPDPRDVDTSSFAEFV

SEQ ID NO: 537 - protein, 554 aa, Escherichia coli
MCSIFGVFDIKTDAVELRKKALELSRLMRHRGPDWSGIYASDKAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDFDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFESYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 538 - protein, 504 aa, Staphylococcus epidermidis
MSKQDGKLTGLFGAPVSDRENSMTAGQRGPLLMQDVYYLEQISHFDREVIPERRMHAKGSGAFGTFTVTNDITQYTNAKIFSEVGKQTEMFARFSTVSGERGAADLERDIRGFALKFYTEDGNWDLVGNNTPVFFFRDPKLFISLNRAVKRDPRTNMRSAQNNWDFWTGLPEALHQVTILMSDRGMPKGFRNMHGFGSHTYSMYNDKGERVWVKYHFRTQQGIENYTDEEAAKIVGMDRDSSQRDLYNAIENGDYPKWKMYIQVMTEEQAKNHPDNPFDLTKVWYKKDYPLIEVGEFELNRNPENYFLDVEQAAFTPTNIVPGLDYSPDKMLQGRLFSYGDAQRYRLGVNHWQIPVNQPKGVGVENLCPFSRDGQMRFLDNNQGGGPHYYPNNQGIYESQPEHKKPPFPTDGDGYEYNYRQDDDNYFEQPGKLFRLQSEDAKERIFTNTANAMDGVSKDVKVRHIRHCYKADPEYGKGVAKALGIDINQIDLETNQDETYENFK

SEQ ID NO: 539 - protein, 501 aa, Candida albicans
MDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDWCYV

SEQ ID NO: 540 - protein, 917 aa, Pseudomonas tolaasii
MLRRMGIKGRVLLLTLLPTSLMALLLGGYFTWMQLSELQTQLLQRGEMIAEQLAPLVAPALSTRNTDLLERIATQSLEQPDVRAVSFLAPDRSPLAHAGPTMLNQPPVGNSSHLLQRSGNDATRYLLPVFGRHRNLAGELIPDEADRLLGWVEVELSHNGMLLRGYRSLFASLLLIAIGLICTAALALRISRTINSPIGQIKQAVAQLKDGNLETRLPPLGSQELDQLASGINRMAETLQNAQEELQHSIDQATEDVRQNLETIEIQNIELDLTRKEALEASRIKSEFLANMSHEIRTPLNGILGFTHLLQKSELSPRQLDYLGTIEKSADNLLGIINEILDFSKIEAGKLVLDSVPFNLRDLLQDTLTILAPAAHAKQLELVSLVYRDTPLALVGDPLRLKQILTNLISNAIKFTREGTIVARAMVEDEEEDSVQLRISVQDTGIGLSNQDVRALFQAFSQADNSLSRQPGGTGLGLVISKRLIEQMGGEIGVDSTPGEGSEFWISLNLPKTRDDVDDLPSAPLLGRRVAVLENHELARQALQHQLEDCGLEVTPFNTLESLTNGITSTHQTEQAIDLAVLGVTANDIPPERLNQHLWDLEHLGCKVLVLCPTTEQMLFNQSVPNPNSQLQAKPACTRKLRRALADLISPRPLRSEPGEPLSSRAPRVLCVDDNPANLLLVQTLLEDMGAKVLAVESGYAAIDAVKQETFDLVLMDVQMPGMDGRQSTEAIRQWESERHGTPLPVVALTAHAMANEKRALLQSGMDDYLTKPISERQLAQVVLKWTGLALRNQGPERGNDNLGHGVQLLVLDHEEGLRLAANKADLAADMLAMLLASLEADRLAITVAREAKDNNALIERVHRLHGATRYCGVPQLRAACQRAETLLKQDDAKAMAALDELDMAIARLASEARVNA

SEQ ID NO: 541 - protein, 155 aa, Zea mays
KLQFPIPSNDYSFQLAIRKWELYGKVFHKHIFNLSKDVMSLDENERIISRGPPNILHCDDTSMVISFTRGPLFFIFNFNPQVSHPSYRVGVDEAGEYQLIFNTDETKYGGCETLKSSQYMRRTSDKRADGCRNSLELALPSRSAQVYKLVRILRI

SEQ ID NO: 542 - protein, 138 aa, Nocardia brasiliensis
DQVPDFIRSQKRLPGNGLRDHNMQWDFWTLRPESAHQVTWLMGDRGIPKTYRHMNGYGSHTYQWINAAGERFWVKYHFKTDQGIDYLTQADADRIAGENADYHRKDLWDAIERGEFPSWTLHVQVMPVAEAENYRFTR

SEQ ID NO: 543 - protein, 405 aa, Chromobacterium violaceum
MSLVTGRIEYMNLNWLNGLLDLPWWGNIIAALILTHITIASVTIFLHRHQAHRALDLHPIPSHFFRFWLWLTTGMVTKQWAAIHRKHHARCETQEDPHSPQVLGIKKVLWEGAELYRAACKDQSIMDKFGHGTPDDWLERNVYSKHNAKGIVLMLLIDLALFGPIGLSIWAVQMVWIPFWAAGVINGLGHYWGYRNFENEDASTNLVPWGILVGGEELHNNHHTFGTSAKLSYKWYEFDIGWMYIRMLEICGLAKVRKVAPQLAHDPSRPQLDLEHLQAIIANRYAIAARYARELKAECRAELAKLSLPELPQVNLPRKMKVWLKQDAKDLPECERDQLARILEQSHVLATIYNMRQELTRLWERSNLTREQLLHELQDWCARAEASGIAALQRFSLNLRQTALA

SEQ ID NO: 544 - protein, 484 aa, Burkholderia fungorum
MSEHKLTNAAGAPVADNQNSMTAGARGPVVLQDVWLLEKLAHFDREVIPERRVHAKGSGAFGTLKVTHDISRYTKAKVFAQAGKETPLFMRFSTVAGERGAADAERDVRGFSIKFYTEEGNWDVVGNNTPVFFIRDPLKFPDFIHTQKRDPYTNMRSNVAAWDFWSRHPESLHQVTILMSDRGIPQNFRQMHGFGSHTYSFINANNERFWVKFHFKSMQGVENFTDAEAAQVVAQDRESAQRDLLTNIDQGNFPKWRFAIQVMPEAEAATYRFNPFDITKVWSQKDYPLIDVGTIELNRNAANYFADVEQAAFTPANVVPGIGFSPDRLLQGRLFSYGDTQRYRLGVNHHQIPVNASRVASPHSFHRDGAMRTDGNLGGNVNYEPNRFGDFAQDANASEPPLAAGAVDRYDHRLDDDYYTQPGMLFALFDAAQRERLFGNIARHINGVPQEIVARQIEHFRRADPAYAEGVIAAIARLAEGETK

SEQ ID NO: 545 - protein, 184 aa, Glycine max
MASKAPKKANLLDHHSIKHILDESVSEVVTSRGFVEDVRLSNVRLLIGAIIIVIALFAQFYKKKFPENRDFLIACIALYVIFNGLLQLIIYTKEKNAILFTYPPVGSFTSTGLVVSSKLPRFSDMYTLTIASADPKSISANDQVHFTKSVTQWFTKDGVLVEGLFWKDVEALIVQYTKEPKKSK

SEQ ID NO: 546 - protein, 548 aa, Rickettsia akari
MATKLIKHGSKAREQMLEGIDVLADAVKVTLGPKGRNVLIEQSFGSPKITKDGVTVAKSIELKDKIRNAGAQLLKSAATKAAEVAGDGTTTATVLARALAREGNKLVAAGYNPMDLKRGMDLAVNAVVEEIKKSSKKINSQEEIAQVGTISSNGDKEIGEKIAKAMEEVGKEGVITVEEAKNFSFDVEVVKGMMFDRGYLSPYFVTNSEKMVAELENPFILLFEKKLSNLQPMLPILEAVVQSQRPLLIIAEDVEGEALATLVVNRLRGGLKVAAVKAPGFGDRRKAMMEDIAILTKGELITEDLGMKLENVSIKSLGTAKRVTVSKENTVIVDGSGDKKNIEDRVLQIKSQIAETTSDYDKEKLQERLAKLSGGVAVLKVGGATEVEVKERKDRVEDALAATRAAVEEGVVAGGGVTLLHASQTLTKLKVENKDQQAGIEIVIEALKDPLKQIIENAGENGGVVVGKLLEHNDKNYGFNAQDMQYVDMIKAGIIDPAKVVRTALQDAASVASLIITTETLIVDEPSDKEDAMPPMRGGMGGMGGMDF

SEQ ID NO: 547 - protein, 532 aa, Ralstonia eutropha
MVEGVNILANAVKVTLGPKGRNVVLERSFGGPTVTKDGVSVAKEIELKDKLQNMGAQMVKEVASKTSDNAGDGTTTATVLAQSIVREGMKFVAAGMNPMDLKRGIDKAVAAAVEELKKVSKPTTTSKEIAQVGAISANSDTSIGERIAEAMDKVGKEGVITVEDGKSLADELEVVEGMQFDRGYLSPYFINNPEKQVVQLDSPFVLLFDKKVSNIRDLLPVLEQVAKAGRPLLIIAEDVEGEALATLVVNNIRGILKTAAVKAPGFGDRRKAMLEDIAILTGGTVIAEEIGLTLEKATLNDLGQAKRIEIGKENTIIIDGAGDAAAIEGRVKQIRAQIEEATSDYDREKLQERVAKLAGGVAVIKVGAATEVEMKEKKARVEDALHATRAAVEEGIVPGGGVALLRARAAISALTGENPDQNAGIKIVLRAMEEPLRQIVLNAGEEASVVVAKVIEGKGNYGYNAASGEYGDLVEMGVLDPTKVTRTALQNAASVASLMLTTDCAVAETPKEESAPAMPGGMGGMGGMEGMM

SEQ ID NO: 548 - protein, 181 aa, Triticum aestivum
  misc_feature (90)..(90): Xaa can be any naturally occurring amino acid
LDGVFAFVLYDTRDRTYVAARDAIGVNPLYIGWGSDGSVWMSSEMKALNEDCVRFEIFPPGHLYSSAAGGFRRWYTPHWVPRSRCPGTPXYQAAPSLREASEKAGYQRGHDRLPFRGLLSRRLDPPFVASVNKAPLRPRPTPPESGQTPSFVVRSRGPLTEGRTRVPDTRDTTRFLTKTDH

SEQ ID NO: 549 - protein, 624 aa, Bordetella parapertussis
MCGVAGLIHLDGAAVDPAVLQGMTDAIAHRGPDGEGHWIDGNVGLGHRRLAIIDLSPAGHQPMISADSRYVLSYNGEIYNFRELRAELETAGYRFKSRTDSEVLLYAVIAWGLKALKRFNGMFAFALWDCHERRLILARDRYGIKPLYYAEQGGTLAFGSEQKAILALPGFRRKLDKAALLEYFTFQNIFTSKVLLEDIQILPAGHYAIVEPDRCASISLTQYWDFCFREPDVAATDQEYREELDRLFVQAVKRQLVTDVELGSYLSGGMDSGSIAAVAAAEHPYIKTFTCGFDLNSASGIELGFDERSKAEYMSYCFKTEHYEMVLKAGDMERILPHVACHLEEPRVGQSYPNFFAAKLASRFVKVVLSGAGGDELFAGYPWRYYRAVVNDDFEHYVDKYYNFWQRLLPNSELKRVFAPIAGEVEHVWTRDIFRNVFRHHADQLYRPEDYINHSLYFEAKTFLHGLLVVEDKLSMAHGLETRVPFLDNDLVEFAMRCPIRLKLNNLAEVVKINENETGNKVRKFFEKNRDGKTILREVMNHRLPADISKAEKQGFSAPDASWFKGESLEFVRRKLLDGHSPLYEIMDAATVRELVNEHLGGIRNRRLLIWSLLSVDAWMRQTF

SEQ ID NO: 550 - protein, 445 aa, Triticum aestivum
MAAAGGKGGPRRTTRVGPYELGKTVGEGSFAKVKIAKDTRNAATCAIKVLDRNHVLRHKMVEQIKREIATMKLIRHPNVVQLHEVMASKSKIYMVLEFVEGGELFDKIVNSGKLGEDEARRYFHQLINAVDYCHSRGVYHRDLKPENLLLDSYGALKVSDFGLSAFSPQTKEDGLLHTACGTPNYVAPEVLADKGYDGMAADVWSCGIILFVLMAGYLPFDDPNLMTLYKLITRANVSCPPWFSTGARNLIKRILDPNPHTRITISQILEDEWFKKDYKPPHSEHNEDVSLEDVDAAFDSSEEHLVAERREKPESMNAFALISRSEGFNLGNLFEKEMMGMVKRETSFASQRTPQEIMSKIEEACGPLGFNVRKQNYKMKLKGDKTGRKGHLSVATEVFEVAPTLHMVELRKTGGDTLEFHSFYKNFSSELKDIVWKTESNTIAK

SEQ ID NO: 551 - protein, 297 aa, Bacillus anthracis
MVESCSNKVVAYKKCNDERETTVHIPTTTLHNGVKMPMIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTEINTLNRNLHVGTNPDKYDTL

SEQ ID NO: 552 - protein, 461 aa, Oryza sativa
MEKKASILMNRYELGRMLGQGTFAKVYHARNLASNQSVAIKVIDKEKVLRVGMIDQIKREISIMRLVRHPNIVQLHEVMASKSKIYFAMEYVRGGELFSRVARGRLKEDAARKYFQQLIGAVDFCHSRGVYHRDLKPENLLVDENGNLKVSDFGLSAFKECQKQDGLLHTTCGTPAYVAPEIINKRGYDGAKADIWSCGVILFVLLAGYLPFHDSNLMEMYRKISKGDVKFPQWFTTDVRRLLSRLLDPNPNIRITVEKLVEHPWFKKGYKPAVMLSQPNESNNLKDVHTAFSADHKDNEGKAKEPASSLKPVSLNAFDIIFLSKGFDLSGLFENDKEQKADSRFMTQKPASAIVSKLEQIAETESFKVKKQDGLVKLQGSKEGRKGQLAIDAEIFEVTPSFFVVEVKKSAGDTLEYEKFCNKGLRPSLRDICWDGQSEHPSLAQSSTLTQSSKSISRHAI

SEQ ID NO: 553 - protein, 497 aa, Nostoc punctiforme
MTEPQNLTTADGIPVSDNQNSLTAGARGPVLIQDFHLIEKLAHFNRERIPERVVHAKGAAAHGTLTITNDITRYSKAKLFSEIGKKTELILRFSTVGGEKGSADAERDPRGFSLKFYTEEGNWDLVGNNTPIFFIRDPLKFPDFIHTQKRNPQTNCKDQNAKWDFWSLSPESLHQVTILFSDRGIPKTHRHMDGFGSHTFSLINAEGDRVWCKFHFKTLQGHQTLTEEESAKIKGEDPDHATHDLFEAIAKKDYPKWRMCIQVMTEEQAEKHPDNPFDLTKVWKQGEYPLIEVGILELNRNPENYFAEVEQAAFSPSAVVPGVSFSPDKMLQARIFSYPDAQRYRLGGNYQQLPVNQPKCPVMHYQRDGFMASGNNGGSVPNYEPNSAEGTPKENPAYAEPPSHLGDVTVDRYSHREGNDDYTQAGNLYRLLTPEQQERLAKNIVGSLSQAREDIQMRQLCHFFRADVSYGRRVAEGLGIAIDPSMFSHDAQPVGNW

SEQ ID NO: 554 - protein, 146 aa, Mesorhizobium loti
MRYLHTMVRVADVDASLDFYCNKLGLKEVRRYENEQGRFTLIFLAASEDEQSGINDKAPLIELTYNWDPEDYKGGRNFGHLAYEVDDIYATCQHLMDNGVTINRPPRDGNMAFIRSPDGISIELLQKGPAKAKAEPWASMANTGSW

SEQ ID NO: 555 - protein, 292 aa, Leuconostoc mesenteroides
MEYKTLASDIKMPVLGFGVFQVQEKGAAKQAVIDAIKTGYRLIDTAASYGNEREVGEGIAEAIETGLVTREELFVTSKMWVQDVSADKAAAAIQASLDRLKLDYLDLYLLHQPYNDVFGAWRAMEAAYKAGQLKAIGVSNFDIAQLTNLAEFSEIKPMLNQIEANPFQQNKKDAAYFAEYGVQVEAWAPFAEGKNGLFSNELLQGIADKYNKSIAQVVLRWLTQRDIIVVAKSVKPERMAQNLDVLDFKLTDEEMQEIATLDTNISQFFDHADPDMIKWMAGREISYDVTAD

SEQ ID NO: 556 - protein, 481 aa, Gibberella zeae
MASLPRNFKLGFATASYQIEGAVAEDGRGPSIWDTFCHLEPTRTKGANGDIACDHYHRLDEDLDLLKRYGSDMYRFSISWSRVIPLGGRHDPINEAGIAFYDRVIDGCLARGITPWVTLYHWDLPQALHERYGGWLDVEESQLDFERYARLCYERFGDRVKHWITLNEPWIVSIFGYATGGNAPGRSSINPQSTEGDTSTEPWIVGKALIMSHARAVAAYNKDFRQSQNGSIGISLNGDYYEPWDKNDPQDSEAAERRMQFHIGWFANPIFLGQGYPQCMRDQLKGRLPAFTPDDMQLLRSAETDFYGMNYYTSQFARHRSSPALDTDFIGNLDELQTNKAGEPVGLESGLHWLRSCPDLFRKHLTRVYRLYGKPIIITENGCPCPGEEMMSREESVQDEYRIKYFEDHLDAIGKSVTEDGSVIQGYFAWSLMDNLEWSDGYGPRFGVTFTDYKTLERTPKKSALVLRQIIDRQKGEQLKL

SEQ ID NO: 557 - protein, 509 aa, Vibrio rumoiensis
MSDDTKKCPVTHMTTDFGAPVVTNRDSLTAGPRGPLLAQDVWLNEKLAGFVREVIPERRMHAKGSGAFGTFTVTHDITKYTRAKIFSEVGKKTEMFARFTTVAGERGAADAERDIRGFALKFYTEEGNWDMVGNNTPVFFIRDPRQFPDLNKAVKRDPRTNLRSATNNWDYWTLLPEALHQVTVVMSDRGIPASYRHMHGFSSHTYSLWNQAGERFWVKMHFRTQQGIKNLTDAEAGELVAQDRESHQRDLYEAIERGEYPKWTMFIQVMPEADAEKYALHPFDLTKVWYKGDYPLIEVGEFELNKNSENFFADVEQVAFSPSNLVPGIGVSPDRMLQARLFNYADAQRYRLGVNYHQIPVNQARCPVHSNHRDGQGRVDGNYGALPHYEPNSFGQWQGQPQFSEPPLKLTGNAAHWSYDKDDHNYFEQPGKLFRLMNDGQKEALFGNTGRAMGDAPEFIKFRHIRNCHAADPAYGAGVAKALGINLEKALASKKDDPMYGNPLVALPA

SEQ ID NO: 558 - protein, 404 aa, Photorhabdus luminescens
MLAVKKSSKLDNVCYDIRGPVLKEAKRLEEEGNKVLKLNIGNPAPFGFEAPDEILVDVIRNLPTAQGYSDSKGLYSARKAIMQHYQARNMMDVTVEDIYIGNGVSELIVQAMQALLNTGDEMLVPAPDYPLWTAAVSLSSGKAVHYMCDEGSDWFPDLNDIRNKITPRTRGIVIINPNNPTGAVYSKELLLEVVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHLRIVTLPRLDELEMAIQKFARFIGKYHQ

SEQ ID NO: 559 - protein, 376 aa, Arabidopsis thaliana
SESRSPRVRVDSVFHTLASGDVLLIIRGKGMVDSVFQAPMGTGTHHAVLSSYEYVSQGLRQYNLDNMMDGFYIAPAFMDKLVVHITKNFLTLPNIKVPLILGIWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYNKEENARVPIICTGNDFSTLYAPLIRDGRMEKFYWAPTREDRIGVCKGIFRTDKIKDEDIVTLVDQFPGQSIDFFGALRARVYDDEVRKFVESLGVEKIGKRLVNSREGPPVFEQPEMTYEKLMEYGNMLVMEQENVKRVQLAETYLSQAALGDANADAIGRGTFY

SEQ ID NO: 560 - protein, 553 aa, Nocardia farcinica
MTDVASQGAAQGDDRRVLTNRQGHPVFDNQNQRTVGARGPATLENYQFLEKISHFDRERIPERVVHARGAVAYGYFEATGKWGDEPIENYTRAKIFAEAGKRTDLAIRFSTVIGGRDSSEAARDPRGFAIKFYTEDGNWDLVGNNLGVFFIRDAIKFPDVIHALKPDPVTFRQEPARIFDFMSQTPEAMHMLVNLFSPRGIPANYRTQQGFGVNTYKWVNAEGVTHLVKYHWIPKAGVKSLTEADAAAIQAQDLGHASKDLYEHIEAGDYPEWELRVQIMSDDEHPELNFDPLDDTKVWPENEFPPKPVGKMVLNRNVSNHFLENEQISFGTGVLVDGLDFSDDKMLVGRTFSYSDTQRYRVGPNYLQLPVNQAKNAHVATNQQGGPMAYGIDDVGENPHVNYEPSITGGLREAQYPTHDEQGPEIRGRLTRKRIPRTNDYEQAGQRYQLMEQWEKDDLVTNLVANIGQATREVQERMVWHFYMCDDELGERVGQGLGISADDVRGLPPLQSQTLSDEELQRAANLGKNGPRDVEGLQMTHCVPDEREVHAAA

SEQ ID NO: 561 - protein, 335 aa, Treponema denticola
MSLLFSSFKIKNIELNTKLVMPPMASEKADAGGIVSQALCDYYDEKTKGSYIGLVIIEHSYVSPQGKASAGQLSISDDSTIEGFKKLASVLHKNGAKVIAQISHAGAAARHKITGYDVLSSSSVMIPRKAPDYELPRAMTQEDIDKVINDFVQAARRAKEAGLDGVEIHSAHGYLLNQFFSPIMNKRTDKYNGSSIEGRTRLHIEIIEAIRKMTGLDFLIAVRLGACDYISGGSSLEDSVEACLLFKKAGVDLLDISGGFCGYTNPELEEEGWFSRITQAVKEKVGAPVILTGGIVSPEAAEKILQEEKADLIGVGRALLNDSDWPKKAKQKLEG

SEQ ID NO: 562 - protein, 634 aa, Rhodopirellula baltica
MCGFTGGLWQRDDQAINADLLSRMTNEIAHRGPDDSQIWMDPEHRDATGRPMGVGLGFRRLSIIDVEGARQPLSNEDGRVRMVFNGEIYNYEVLRKRLQGAGHQFATQGDGESIVHLYEDIGTDCFSSLNGMFAIAIWDARRNRIVLARDRIGQKPLYYSYKNGRLVFASELKALRLVPGVCEEVDPNAIDEFLTYQYIPHPGTIFKGVHKLPPGHFAVLDERGLRVERYWNFDPSIERPLGREEAIEKVRDLLADSVRLRMRSDVPLGSFLSGGIDSSLITALAGDHTDTPLRTFSIGFPVADFDETRYAAQVAEHLQTDHTRFEVQPSGIDILEKLVWHYDEPYGDSSAVPTWYLSKLTRESVKVALSGDGGDELFAGYERYRALWMSQKIARLFPLNKFPGIGLIQRLPDSNRRRSVVRRAKRFLEAIDQPVVRRYMNWLQIFPESMRASMYNDEFVQALPGHDPVDFLESVWARSEGRDVVTRASTSDIQSYLPCDLCTKVDIASMAHGLEVRQPMLDYRFVELAASMPVEHKFRGRRGKLILQDAFGDRIPSSIFTRPKMGFGIPIGQWFREDFKPLVHDTMLASDARINAYFRPEAIADLVRSHETGEQNHGYRLWNLLVLETWLRQL

SEQ ID NO: 563 - protein, 331 aa, Unknown
  Saccharum hybrid cultivar H65-7052
MTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 564 - protein, 160 aa, Pseudomonas aeruginosa
MLGLVFEIFHVPGHTLGHIAYYHPAETPLLFCGDTLFAAGCGRLFEGTPAQMHHSLARLAALPANTRVYCTHEYTLSNLRFALAVEPDNAALRERFEEATRLRERDRITLPSEISLELSTNPFLRVSENSVKKKADQRSGQQNRTPEEVFAVLRAWKDQF

SEQ ID NO: 565 - protein, 942 aa, Saccharophagus degradans
MKSQSVQTELFRLITVPVFAACFILASTFFYLQKSHIEDQFSNNKHLATELLNSVVFSNKASTNPFAEAANALLATGDYRSIVVSSATGQQIASYGLPLRTHSYQTQLGVESQWTHEDSLIYSFPLKKSNLQSSTPLWVIIAIDKRSWAISEYQGTITILLAGSLCLFLTFYFARRFRDALATPLQKIETGLRDFLKGNFEKSITIEPSSVFKDLASNINRLGALQKSANDELQLNIDQSTHELRETLETVEIQNIELDIARKSALQASRVKSEFLANTSHEIRTPLNGILGFSELLRKTELNNQQVDYLTTIEESAKGLLTIINDILDFSRLEIGTLTLEYKPVKIRQLIEDTLKLQTPAANEKNIRMLTIIDHDVPENLLGDPLRLKQVLSNLVSNAIKFTDVGYILLGVSKDQSSENQFTLKFRVTDSGIGLSQDQQERLFDPFTQLDSSESRLHGGTGLGLAIAKGLVDRMNGTIGVESTLGKGATFWFTSTLGRSPSASAKQTYLAGTLRGVHALVFDHSNMGRMEITHYLTGWGAKVCETGEMEDIEPQISFFSNSEPVDIAIIDSMIDIKTFDRLRICEHVTQLNHRFNIPVIILAPSSIQRILEPHLAGTNSLFINRPLFCNKLHQTICEQLEIVATENIESRTYLHQHEPLEQQQVNILAVDDNPANLKLVTELLKGLNINVTPVESGEQAIAQIKDSHFDLILMDIQMPSMDGIETTGHIRELETSGPRTPIIALTAHAVSEQKSRLLLAGMDDCLSKPVSESELRHVIERWTNVTIATKIAPTNPAPVASALIEHSPNADKTGENQPATDSQAAAIVDRALGLSLTNQNPSLAGDMLSMLIETLPDVLHKSRTQYENKQFDELQETVHKLHGGCCYCGVPRLKAISEQIDKNLQKNKYNNLANEIQLLEAEIKNLLQWAEEHDIDVLFSDD

SEQ ID NO: 566 - protein, 484 aa, Synechococcus elongatus
MAAPILFWHRRDLRLSDNIGLAAARAQSAQLIGLFCLDPQILQSADMAPARVAYLQGCLQELQQRYQQAGSRLLLLQGDPQHLIPQLAQQLQAEAVYWNQDIEPYGRDRDGQVAAALKTAGIRAVQLWDQLLHSPDQILSGSGNPYSVYGPFWKNWQAQPKPTPVATPTELVDLSPEQLTAIAPLLLSELPTLKQLGFDWDGGFPVEPGETAAIARLQEFCDRAIADYDPQRNFPAEAGTSGLSPALKFGAIGIRQAWQAASAAHALSRSDEARNSIRVWQQELAWREFYQHALYHFPSLADGPYRSLWQQFPWENREALFTAWTQAQTGYPIVDAAMRQLTETGWMHNRCRMIVASFLTKDLIIDWRRGEQFFMQHLVDGDLAANNGGWQWSASSGMDPKPLRIFNPASQAKKFDATATYIKRWLPELRHVHPKDLISGEITPIERRGYPAPIVNHNLRQKQFKALYNQLKAAIAEPEAEPDS

SEQ ID NO: 567 - protein, 636 aa, Bordetella parapertussis
MCGIFGALWHQGKSVSAIEQQLQVGIARQQHRGPDGHGTWIDPQGRLGLAHVRLSIIDLVSGAQPMRGNSGNVITYNGEIYNYIELRRELGEDSFETTSDTEVILRAYEKWGERCVDRLEGMFAFAIWDAKRGEMFVARDRFGIKPFYYACVQGGFYFGSEVKALTPFLNRVETDANALHDYFAFQFCLGEKTLFAGVRQLKPAHCGYVGRDLELKQRQYWEVQYDLDWDHTEKYFVEQVREKLQHSVDMHMRSDVEVGAYISGGVDSSLVAAMARHGRRSSRFQGFTGKFALGDAFDESRYAQALADEHDILLHQVDITEDDFVNDIAKVIYHLDQPVAGPGSFPQYAVSRLAKDHVKVVLGGQGSDEMFGGYARYLIAYWEQCIKGALDGTMHDGNYIVTYESIIPNLRTLRNYKPLIQEFMAEGIFDSRDKRYYRLINRSNTFGNVVNWGMFEGIASSFDDFKQIFWGKNVGKESYFDSITHFDFKTLLPALLQVEDRMSMAHGIESRVPFLDHKLIELVATVPANVKFQNGELKRLLRVAFQDMLPQAIRERKDKMGFPVPLQVWMRKGGKAREFILDTFRSQNARSRAYLAPGFDIEKMMEQEGLFSRNIWAFLSLELWQQQFHDVHRQTI

SEQ ID NO: 568 - protein, 215 aa, Escherichia coli
MNYRIIPVTAFSQNCSLIWCEQTRLAALVDPGGDAEKIKQEVDDSGLTLMQILLTHGHLDHVGAAAELAQHYGVPVFGPEKEDEFWLQGLPAQSRMFGLEECQPLTPDRWLNEGDTISIGNVTLQVLHCPGHTPGHVVFFDDRAKLLISGDVIFKGGVGRSDFPRGDHNQLISSIKDKLLPLGDDVIFIPGHGPLSTLGYERLHNPFLQDEMPVW

SEQ ID NO: 569 - protein, 208 aa, Triticum aestivum
  misc_feature (40)..(40): Xaa can be any naturally occurring amino acid
GTKFLTKKKHGFGTRVPEFPREIGANPRVPVKDKDRIPGXIDITLSEGDTWMFAGHQVLVMETPGHTSGHVSFYFPGSGAIFTGDTLFSLSCGKLFEGTPEQMYSSLQKIVALPDVTKVYCGHEYTLSNSRFALSIEPGNEELQEYAASTADLRNKNTPTVPTTIAREKQCNPFLRTSSPEIKKRLSIPDHFDDARVLEVIRRAKDNF

SEQ ID NO: 570 - protein, 189 aa, Desulfovibrio desulfuricans
MDIDFKKLAPWNWFKKEQEEQQSTASLPMQRNDLPVAGGPVSPILQLHREIDRLFDDAFRGFGFPALAMPRWPSDWPGLLKPALDIQETDKLYKISLEVPGVEEKDIQITLDNDVLLVRGEKRQEQETKDGGFHRVERSYGSFQRALNLPADANQDTIKAAFKNGVLTITMEKREACAPKQGRSIPING

SEQ ID NO: 571 - protein, 569 aa, Ashbya gossypii
MSDAVERHTFKVFTQDFMVDKRFQLIKEIGYGAYGIVCSARFMESVEDTTVAIKKVTNVFSKALLCKRSLRELKLLRHFRGHKNITCLYDMDIVLLPDGSFNGLDLYEELMEWDMHQIIKSGQPLTDAHYQSFVYQILCGLKYIHSADVLHRDLKPGNLLVNADCQLKICDFGLARGYSENPIENDQFLTEYVATRWYRAPEIMLSYQGYTRAIDVWSCGCVLAELLGGRPIFKGKDYVDQLNRILQVLGTPPEETLKRIGSKNVQDYIHQLGYIPKVPFERLYPNANPDAADLLERMLALDPKTRITVDEALEHPYLSIWHDPSDEPVCCKKFDFSFESVNEMEELKRMVIEEVKDFRRFVRQPNIRDTSLQEQEEQQPQQPQQPQQPQPEQPQHQRQHQQAQAQAQAQAHEQQQQHHRTQYQRSGAVQRQPQTVEHGQHLQHRSGHHSEHLQRAHGQQEQYLPKKDDSRAFQSRPVGTSISDSRSSYEEHDYVQQMMFAHSPTLAHDSFIGIHSENLPEHNTDFPPRPQENMLASPMGFSDGTHSNAEFGDFLDLEKELEFGLDRKI

SEQ ID NO: 572 - protein, 498 aa, Trichodesmium erythraeum
MSQNVIILWYRNDLRIHDHEPLYKALKVNAQIIPIYCLDPRQFSQTDFGFPKTGVFRAKFLLESIADLRNNLQKLGSNLVIFQDKPEIVIPRLAQQLSAKSVFFHQEVTELEVKVERLVHQALKQIGVRLKSFWGHTLYHPDDLPFEIKQLPELFTTFRKDVEKNSSVNPTFSIPKKLSSLPKIDVGELPTLSDLNLEKPPLNSQGVLEFKGGETAAKERVKNYFWQQDYLKVYKETRNGMLGANYSSKFSPWLALGCLSPRYIYEEVKEYEYQRVKNQSTYWLIFELIWRDYFRFICQKHGNKIFHKSGLQGIAIPWQEDWEKFRKWQAGQTGFPLVDANMRELLATGFMSNRGRQNVASFLTKNLGINWQMGAEWFESLLIDYDVCSNWGNWNYTAGVGNDGRGFRYFNIPKQAKDYDPEGKYVKHWLPELGKVPPAKVHEPWKLLPVEQDRFGVKIGVDYPEPIIDLWQSVKENEKKYNRALQMTLGKINKRGRF

SEQ ID NO: 573 - protein, 513 aa, Pinus contorta
MEVSVLMWVLLFYSLLGFQVTTARLDRNNFPSDFMFGTASSAYQYEGAVREDGKGPSTWDALTHMPGRIKDSSNGDVAVDQYHRYMEDIELMASLGLDAYRFSISWSRILPEGRGEINMAGIEYYNNLIDALLQNGIQPFVTLFHFDLPKALEDSYGGWLSPQIINDFEAYAEICFRAFGDRVKYWATVNEPNLFVPLGYTVGIFPPTRCAAPHANPLCMTGNCSSAEPYLAAHHVLLAHASAVEKYREKYQKIQGGSIGLVISAPWYEPLENSPEERSAVDRILSFNLRWFLDPIVFGDYPQEMRERLGSRLPSISSELSAKLRGSFDYMGINHYTTLYATSTPPLSPDHTQYLYPDSRVYLTGERHGVSIGERTGMDGLFVVPHGIQKIVEYVKEFYDNPTIIIAENGYPESEESSSTLQENLNDVRRIRFHGDCLSYLSAAIKNGSDVRGYFVWSLLDNFEWAFGYTIRFGLYHVDFISDQKRYPKLSAQWFRQFLQHDDQGSIRSSSSI

SEQ ID NO: 574 - protein, 496 aa, Neurospora crassa
MSGLATKQQSLKLFEKLKAKPANKICFDCGQKNPTWTSVPFGIYLCLDCSANHRNLGVHISFVRSTNLDQWQWDQLRIMKVGGNESATKFFQQNGGSAALNSKDPKTKYQSAAATKYKEELKKRAARDAREYPEEVVITDGDDATSSNTPAGEPDDDFFSSWDKPAIKKPTPPISRTSTPPVIGRTASPLLGNGKDIQRTSSPLSKTDSDAPTPAPAASRITTSAALRKTTPGSSTTGGPRKVGGGILGAKKPAAKLGVKKISADLIDFDEAEKKAKEEAERIEKLGYDPEAEEEKAAKKAETKTNNIITPAAAPVSSSSSRSAAQEKSAAEVERLGMGVRKLGFGMVGKPGGAGAAAGAGGAAAAKKNAGGFGSVGPIKASEADEEQYARNKFANQKAISSDEFFNKGNYDPSVKAETKARLQGFEGAQAISSNAYFGRPEDDAPAEDYGDLESAAKDFIRKFGITASDDLENLTQMVGEGAGRLQGAIRAYLGS

SEQ ID NO: 575 - protein, 289 aa, Escherichia coli
MEFSVLSNNLKMPMMGFGVFQVTDKNVCKQSVLNAIRTGYRLIDTAAVYGNEDAVGEAVREAISEGLCTREELFITSKLWVQDMLNQDTAAAGIEASLKKSGLEYFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 576 - protein, 157 aa, Brassica napus
MANDIGSFELNTGAKIPSVGLGTWQAAPGVVGDAVAAAVKIGYQHIDCAARYGNEAEIGKVLKKLFEDGVVKRENLFITSKIWLTELDPPDVPEALNRTLQDLQLDYVDLYLMHWPVRLKKGSVEFKPENIMPIDIPSTWKAMEALYDSGKARHPLG

SEQ ID NO: 577 - protein, 644 aa, Prunus persica
MDSCDCIDAQWPPDELLVKYQYISDVFIALAYFSIPLELIYFVQKSSFFPYRWVLMQFGAFIVLCGATHFINVWTFYMHSKTVAVVMTVAKVSCAVVSCATALMLVHIIPDLLSVKTRELFLKNRAEELDREMGRMLTQEETGRHVRMLTHEIRSTLDRHTILKTTLVELGRTLGLQECALWMPSRTGMNLQLSHTLNYQIQVGSTVPINLPIINEVFTSSRAIRIPYTCPLARIRPLVGRYVPPEVIALRVPLLNLSNFQINDWPDLSAKSYAIMVLILPTDSTRKWRDHELELVDVVADQVAVALSHAAILEESMRARDQLMEQNVALDLARREAEMAIHARNDFLAVMNHEMRTPMHAIIALSSLLLETELISEQRVMIETVLKSSNLLETLINDVLDLSRLEDGSLELDIRKFNLHGVFREVINLIQPITSVKKLSMSLILSPDLPLCAVGDENRLMQTILNVAGNAVKFTKEGYISIVASVAKPESSRDWRPPEFYPASTDGHFYLRVQVKDSGCGILPQDIPHLFTKFSQPRSGSNRINDGAGLGLAICRRFINTMGGHIWIESEGIDKGSIVAFIVKLGICDNPCDTTAAHQMAPQALPQPQPQPNYGSGDRIAHRPTVSFRDGGYTSSNPRYQRSI

SEQ ID NO: 578 - protein, 183 aa, Coffea canephora
GAYGIVCSVLNSETNEMVAVKKIANAFDNYMDAKRTLREIKLLRHLDHENVIAIRDVIPPPLRREFSDVYIATELMDTDLHQIIRSNQSLSEEHSQYFLYQIPRGLKYIHSAKVIHRDLKPSNLLVNANCDLKIIDFGLARPNTKNEVMTEYVVTRWYRAPELLLNSSDYTAAIDVWSVGWIF

SEQ ID NO: 579 - protein, 417 aa, Candida albicans
MMNIDQHHQLQQQHQQQMLQQQAQAQAQAQAQAQQQQQAAAAAAAANAAATTSSSSPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPSNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 580 - protein, 507 aa, Brucella melitensis
MKLQEDYSMTDRPIMTTSAGAPIPDNQNSLTAGERGPILMQDYQLIEKLSHQNRERIPERAVHAKGWGAYGTLTITGDISRYTKAKVLQPGAQTPMLARFSTVAGELGAADAERDVRGFALKFYTQEGNWDLVGNNTPVFFVRDPLKFPDFIHTQKRHPRTHLRSATAMWDFWSLSPESLHQVTILMSDRGLPTDVRHINGYGSHTYSFWNDAGERYWVKFHFKTMQGHKHWTNAEAEQVIGRTRESTQEDLFSAIENGEFPKWKVQVQIMPELDADKTPYNPFDLTKVWPHADYPPIDIGVMELNRNPENYFTEVENAAFSPSNIVPGIGFSPDKMLQARIFSYADAHRHRLGTHYESIPVNQPKCPVHHYHRDGQMNVYGGIKTGNPDAYYEPNSFNGPVEQPSAKEPPLCISGNADRYNHRIGNDDYSQPRALFNLFDAAQKQRLFSNIAAAMKGVPGFIVERQLGHFKLIHPEYEAGVRKALKDAHGYDANTIALNEKITAAE

SEQ ID NO: 581 - protein, 310 aa, Candida glabrata
MSLKNSTATLKLNTGAEIPVVGLGTWRSAANDGYDSVLAALKLGYRHIDAAAIYGNEDQVGRAIKDSGVPRQEIFITTKLWGTEHRNPAKALDSSLKRLGLDYVDLYLMHWPVALKAHGSEEKDLLNIPKKPDGKTDIDIEDWDFIKTWELMQELPKTGKTKAIGVSNFSINNLKALKNSPKFNTVPAANQVEIHPLFPQTELIEYCKSENILIEAYSPFGSADAPVLKEPELHKLAEKYNISTAQLIISWSVQRGYVVLPKSVHAERIEANLKVLTLKDEDMETITNLSKVKGEKRLVQLDWSPFPTFE

SEQ ID NO: 582 - protein, 628 aa, Bordetella parapertussis
MCGVLGAWWRHHDEHEDARFAAGLRKLAHRGPDDRGSEHFAAPHGRLSLGHTRLAVIDLSAAGHQPMHADADRLAVVFNGEIYNYRELRSELRQIDAIFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGRAGEPMAWDDPASQECRPIGFQEAAEELRARFLDNVRLHLRSDVPIGAALSGGIDSSAIVCAMRWLEPDLPIQTFSFISDDAHRSEERWVDLVNQHCGATGHKIHIAPHELLDDLDDLIRVQGEPVGSTSIYAQYRVFKLAREHGVVVTLDGQGADELLGGYGGYPTERLASLLETSRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALSLPERYLVSDSGQTKHIFRKAMRGIVPDLILDRDDKIGFATPEQQWMQATAPQMRQWLVDAADIPFLRNAEVTAQFDAMIAGATPFSWQAWRWVNFQRWMQHATVLP

SEQ ID NO: 583 - protein, 470 aa, Unknown
  Petunia x hybrida
MKLLSEKATCNSHGQDSSYFLGWQEYEKNPYDEIQNPKGIIQMGLAENQLSFDLLESWLSQNPDAAGFKRNGESIFRELALFQDYHGLPAFKNALVKFMAEIRGNKVTFDSNKLVLTAGATSANETLMFCLADRGDAFLLPTPYYPGFDRDLKWRTGAEIVPIQCTSSNGFRITESALEEAYQEAKSRNLRVKGVLVTNPSNPLGTTLTRNELELLLSFVDTKGIHLISDEIYSGTVFNSPNFVSVMEVLIENDYMYTEVWDRVHIVYSLSKDLGLPGFRVGAIYSNDELVVSAATKMSSFGLISSQTQYLLSAMLSDKKFRKKYVSENQKRLKKRHAMLVTGLQNAGISCLESNAGLFCWVDMRHLLKSNTFEAEIELWKEIVYQVGLNISPGSSCHCTEPGWFRVCFANMSEDTLTLAMARIKSFVDSSATSTDTHNNQTNQNTNTNSTKKKLFSKWGFRLSFNDRER

SEQ ID NO: 584 - protein, 1513 aa, Desulfovibrio vulgaris
MPRQVDSHRAAKGRAGHHPTTHDAVHLPLVVGIGASAGGLEALEGLFRHMPTTTGAAFVVIQHLSPDFPSFMDELLARQTVMTIVVVQDGMCPAPDHIYLLPPGKEMEITLDGFILRDKSSYDNRPSMPINTFFASLAAWYGENAAGVVLSGTGTDGASGLEAISAAGGLVLVQLPESAAFDGMPKAAAAACRAAVLATPDEMPDILAAFISGSPLPFEHPGLPADPASGGPAPDALQTIFTLLQRHGGLDFRDYKPATIARRIMRRIRLEQHADIEGYARHLRDDPQAVQTLFRDLLIGVTTFFRDETAFDTLAATVIPELFRKQGDRGEIRLWVAGCASGEEAYSLGMLLLEAAPQFDFTGRISIFATDVHRHSLDRASAGVYTKDSLQALSPRRLQRFFIPEGDETYRVAPELRSLVLFTQHNILADPPFTRVDLVSCRNLLIYFGVDAQERAIARLHMALRPGGVLFMGASETTGRLHPIFEPLDPRLRIFTKRPDTLGMTATHLVHPAVIDAHRLATSSPQPSERQLLRDYDALLQRFAPDGMLVDDRFAVLHFFGNGASYLTQHTGRTDRPITDMVEGDLRLALSSALQRASTTGETARFKSIRVPGNGGDRLVDVEVMPIGNKPSDGKHYHVALQSSHPVLIRPLVEPAATGHGTGLLASRVAELEAELAETRSSLRDSIEQVHVTNEELQATNEELLSANEELQATNEELHSINEELYTVNAEFERKNDQLRILGEDYAQLFDTIPIAIASLDESLRVRRFNAGMSAIFHLQPHDVGRPLQQIASCLAEPDNLFKSLALGLSEGGTHDSEARLTDGRWCQQRIHAVRDETGATEHMLLTFMDITHVKHAEAMRQEARSLDEVSRNVPGVVFKLCAPHDGNIRVEYVGGGTVELCGLSQEEIKADPHALVALFGPDVVPHILAGISATDGEGTPVDVEIPLHCTGGTKWVHVQATSTPARGGGTEWYGVAVDATERRYDATRMHNAADRYLRILDHAPMLIWRSDTTGACDWFNTTWLDFTGRTMEQEYGYGWAGGVHPDDYDRCVSIYQKAFALQQAFEMNYRLKRHDGQFRWLVDCGKPLPDLDGTFSGFIGYCYDITDAVNALESMCEASKRAEEANRTKSEFLANVSHELRTPLNGALGMLQLLELSSLSPEQRQYVTTAIRSGQNLVRLLSDILDLSRIEAGKLVIEAIPCDIRELVDEVFSTFSLDATGKGITLETTIAPGTPTYVRTDPLRLRQTLFNLVGNAVKFTEKGGVRVEFSTASMRGDAIVLFCTVRDTGPGIPEDRIESIFQPFTQLDGSYTRRHSGLGLGLGIVCRLMELFGGSIEVESAPDMGTAMHFAIPVGKTRRPQGRKVKETEDEGDRHALYLLVAEDDAINRLTLTRMLEQLGHRAHAVEDGSQALQALAEQHFDAVFLDIQMPVLDGMATLQAIRTGQVAGLPPTIPVVAVTAHAMQGDRERFMAKGADAYVQKPYDFTALEKALATLGRRVRPEGRTREDYSL

SEQ ID NO: 585 - protein, 541 aa, Streptomyces coelicolor
MAKIIAFDEEARRGLERGMNQLADAVKVTLGPKGRNVVLEKKWGAPTITNDGVSIAKEIELEDPYEKIGAELVKEVAKKTDDVAGDGTTTATVLAQALVKEGLRNVAAGANPMALKRGIEKAVEAVSAALLEQAKDVETKEQIASTASISAADTQIGELIAEAMDKVGKEGVITVEESQTFGLELELTEGMRFDKGYISAYFATDMERMEASLDDPYILIANSKIGNVKDLLPLLEKVMQSGKPLLIIAEDVEGEALSTLVVNKIRGTFKSVAVKAPGFGDRRKAMLGDIAILTGGEVISEEVGLKLENATLDLLGSARKVVITKDETTIVDGAGSADQVQGRVNQIRAEIENSDSDYDREKLQERLAKLAGGVAVIKAGAATEVELKERKHRIEDAVRNAKAAVEEGIVAGGGVALLQASQVFEKLELTGDEATGANAVKLALEAPLKQIAVNGGLEGGVVVEKVRNLTVGHGLNAATGEYVDMIAEGIIDPAKVTRSALQNAASIAALFLTTEAVIADKPEKAAPAGAPGGMPGGDMDF

SEQ ID NO: 586 - protein, 563 aa, Zea mays
MAPLVAAATNHTAHRSHIVGPNNENFPRHQPCSSQNRNKRLRLRSRAQRISSQLLASRKLMPWQIPKRDWFPPSFIFGAATAAYQIEGAWNEDGKGPSNWDHFCHNYPDWILDGSNGDTGANSYHMYPADVRLLKEIGMDAYRFSISWSRILPKGTLEGGINQAGIKYYKKLINLLIENGIEPFVTIFHWDVPQALEDKYGGFLGDRIVFAIFFRKDYTDFAKVCFENFGDKVKNWLTFNEPQTFTTFSYGTGVFAPGRCSPGEKCAQPIANSLTEPYIAGHNILRAHAMTVDLYNKNYKGTDGRIGLAFDVMGRVPYGNTFLDEQAQERSLDQNLGWFLEPVVRGDYPFSMRSLARKRLPFFTDNEQAMLAGSYDILGINYYTSRFSKHVDFSEDYSPKLNADDAYATAEIFGPDGNSIGPPMGNPWIYMYPKGLKDLLMIMKNKYGNPPIYITENGIGDVDTKDNPLSMQDALDDYKRLDYLQRHISVIKESIDLGADVRGHFTWSLLDNFEWSSGYTERYGIIYVDRDDGYRRYLKRSAKWLREFNGAAKKAEKKVLTPA

SEQ ID NO: 587 - protein, 376 aa, Streptomyces coelicolor
MTVTPAEAATRAAQLLARPATINGLTVPNRIAMAPMTRMFSPGGVPGEDVVSYYSRRAAAGVGLIVTEGTYVGHDSAGQSDRVPRFHGEEQLAGWAKVAEAVHAAGGTIVPQLWHIGMVRKAGEQPFPDAPAVGPSGLRIGEDEPTGRAMTQRDLDDVIGAFAESAAAAERIGFDGVEIHGAHGYLVDQFLWSGTNRRTDAYGGDPVARTRFAAEIVAAVRETVSADFPVIFRYSQWKQEAYDARLAETPEELEAILTPLASAGVDAFHASTRRYWLPEFEDSDLNLAGWTKKLTGKAAITVGSVGLDGDFNRAFQGEGAPVGSLDNLLDRLERDEFDLVAVGRALLHDPRWAQKVLDGRFDELAPYDAASLKTLS

SEQ ID NO: 588 - protein, 308 aa, Arabidopsis thaliana
MSVTSTVEENHQKNPSTPAAVEEEKKKRRWVFWDRRWRRLDYVKFSASFTVHSLALLAPFYFTWSALWVTFLFYTIGGLGITVSYHRNLAHRSFKVPKWLEYLLAYCALLAIQGDPIDWVSTHRYHHQFTDSERDPHSPKEGFWFSHLLWIYDSAYLVSKCGRRANVEDLKRQWFYRFLQKTVLFHILGLGFFLFYLGGMSFVTWGMGVGAALELHVTCLINSLCHIWGTRTWKTNDTSRNVWWLSVFSFGESWHNNHHAFKSSARQGLEWWQIDISWYIVRFFEIIGLATDVKVPTEAQRRRMAIVR

SEQ ID NO: 589 - protein, 548 aa, Unknown
  Vibrio sp. Ex25
MAAKDVKFGNDARVKMLEGVNVLADAVKVTLGPKGRNVVLDKSFGAPTITKDGVSVAREIELEDKFQNMGAQMVKEVASKANDAAGDGTTTATVLAQSIVNEGLKAVAAGMNPMDLKRGIDKAVAAAVEQLKELSVECNDTKAIAQVGTISANSDASVGNIIAEAMERVGRDGVITVEEGQALQDELDVVEGMQFDRGYLSPYFINNQESGSVDLENPFILLVDKKISNIRELLPTLEAVAKASRPLLIIAEDVEGEALATLVVNNMRGIVKVAAVKAPGFGDRRKAMLQDIAILTGGTVISEEIGLELEKVALEDLGQAKRVSITKENTTIIDGIGEEEMISGRVAQIRQQIEDATSDYDKEKLQERVAKLAGGVAVIKVGAATEVEMKEKKDRVEDALAATRAAVEEGVVAGGGVALIRAASKIAHLTGDNEEQNVGIRVALRAMEAPIRQITKNAGEEDSVVANNVKAGEGSYGYNAATGEYGDMLEMGILDPTKVTRSALQFAASVAGLMITTEAMVTDLPQKDAPAMPDMGGMGGMGGMGGMM

SEQ ID NO: 590 - protein, 183 aa, Coffea canephora
LVIGAYGIVCSALNSETTEHVALKKIANAFDNRIDAKRTLREIKLLRHMDHENVVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 591 - protein, 161 aa, Coffea canephora
RRLRMLLITGSMRRGLCERSSFFAIWIMKTSVVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 592 - protein, 212 aa, Mycobacterium tuberculosis
MMAAIERVITHGTFELDGGSWEVDNNIWLVGDDSEVVVFDAAHHAAPIIDAVGGRKVVAVICTHGHNDHVTVAPELGTALDAPVLMHPGDAVLWRMTHPDKSFRAVSDGDAVRVGGTELRALHTPGHSPGSVCWYAPELGPGTGTVFSGDTLFAGGPGATGRSYSDFPTILRSISGRLGALPGDTVVHTGHGDSTTIGDEIVHYEEWVARGH

SEQ ID NO: 593 - protein, 183 aa, Coffea canephora
LVIGAYGIVCSVLNSETNEMVAVKKIANAFDNYMDAKRTLREIKLLRHLDHENVIAIRDVIPPPLRREFSDVYIATELMDTDLHQIIRSNQSLSEEHSQYFLYQILRGLKYIHSAKVIHRDLKPSNLLVNANCDLKIIDFGLARPNTENEVMTEYVVTRWYRAPELLLNSSDYTAAIDVWSVG

SEQ ID NO: 594 - protein, 364 aa, Arabidopsis thaliana
MEKKSEEDGNNTTKEKIFRADKIDLKSLDRQLEKHLSRVWSRNLEVNPKAKEEWEIDLAKLETSNVIARGTYGTVYKGIYDGQDVAVKVLDWEDDGNETTAKTATNRALFRQEVTVWHKLNHPNVTKFVGASMGTTNLNIRSADSKGSLPQQACCVVVEYLPGGTLKQHLIRHKSKKLAFKAVIKLALDLARGLSYLHSEKIVHRDVKTENMLLDAQKNLKIADFGVARVEALNPKDMTGETGTLGYMAPEVIDGKPYNRRCDVYSFGICLWEIYCCDMPYPDLSFVDVSSAVVLHNLRPEIPRCCPTALAGIMKTCWDGNPQKRPEMKEVVKMLEGVDTSKGGGMIPEDQSRGCFCFAPARGP

SEQ ID NO: 595 - protein, 755 aa, Prochlorococcus marinus
MTVSILLDSLKDDGQRLSECRHESPFSILGPQPFKDKWIIRIWMPEASQVELVTQQTKIKLQNPNHEWIFEGVLEKDPGTDYQIKVNRGGIEHVQHDPWSFRKEWMGEIDRHLFAEGNHHHIWRKMGAHLTEIDKKKGVMFCLWAPHAKSVSVIGDLNSWDGRHHPMQKRLGGIWELFIPGLSEGDLYKYEIRTEKGHCYEKADPYGFQHEVRPAKSSVISKIDSFQWSDQSWISNRDNRDPLEQPISVYEMHLGSWMHASSDDPFINSNGEHRAPVPAADMKPGSRLLTYKELANKVIPYVKERGFTHIELMPISEHPFDGSWGYQVTGWYAPTSRFGSPDEFRAFVDSCHKEGIGIILDWVPGHFPKDQHGLAYFDGSHLYEHSDPRVGEHKEWGTLIFNYSRNEVRNFLVANLIFWFDQFHIDGIRVDAVASMLYKDYLRPEGEWIPNEDGGNENFEAVRFLQQANHVLFQHFPGALSIAEESTTWTGVTKPTDMDGLGFNLKWNMGWMHDMLDYFEIDPWFRQFNQNNITFSICYNFTENFMLALSHDEVVHGKSHLLHKMPGDDWQKYANTRALLAYMWTHPGKKTIFMGMEFGQRQEWNVWDDLQWDLLNYEPHKGIQKLVDDLNNLYKREPALWRNDFDEYGFQWIDCDDNKNSVISFMRREKTDGEWLVIVANFTPQNHSNYRIGVPVDGFYEEIFNTDASQYGGSNLGNMGGKSTDLYNIHGYENSIDLCLPPLSVLVLKHKSKKN

SEQ ID NO: 596 - protein, 494 aa, Cucurbita pepo
MGFHQIDERNQALLSKIAIDDGHGENSAYFDGWKAYDNNPFHPENNPLGVIQMGLAENQLSFGMIVDWIRKHPEASICTPEGLEKFKSIANFQDYHGLQEFRKAMASFMGKVRGGRVKFDPSRIVMGGGATGASETVIFCLADPGDAFLVPSPYYAAFDRDLKWRTRAQIIPVHCNSSNNFQVTEAALEIAYKKAQEANMKVKGVIITNPSNPLGTTYDRDTLKTLVTFVNQHDIHLICDEIYSATVFKAPTFTSIAEIVEQMEHCKKELIHILYSLSKDMGLPGFRVGIIYSYNDVVVRRARQMSSFGLVSSQTQHLLAAMLSDEDFVDKFLAENSKRLGERHARFTKELDKMGITCLNSNAGVFVWMDLRRLLKDQTFKAEMELWRVIINEVKLNVSPGSSFHVTEPGWFRVCFANMDDNTVDVALNRIHSFVENIDKKEDNTVAMPSKTRHRDNKLRLSFSFSGRRYDKGNVLNSPHTMSPHSPLVRARTY

SEQ ID NO: 597 - protein, 605 aa, Legionella pneumophila
MFGFISDLLTAAVSSLDELLQDTPAHQIILGTAALYFLYNQYHNPSISRWCRSRNNASMKQRIIDSAYALAKNLPGVNQIIEKELNKELSSTREKLRIQRSGMTLREEIPEEGLSPQDILSAFDVDVEKCHFDFLSVTNDSPEREFLVGRGDGKDSGALYAIHPKELTELLKEVYGATALTNPLHDKWPRINAMQAEVIRWCQNLFHGSKEGYGLLTHGGTTSIIEAMAAYVIRARAKGIDYPEIVVPETAHAAFKKAAELTGAILITVPVDKKTGAVNPNVMSSYITRNTAVMVGSAPSFMNGIHDPISELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIIRLRNAIQKELTALVEEGNGLTSEDIYVYGNPQWSILGFRSNTCNAHFIADELEKRGWKLNLLQNPDGFHLCLTHVHTLVGSFETQFIKDLREAVIDVKNYPPGKKPSGNVKVYGAVGMMPVELQKEICKQYQKARLDFTAASHGSLGIFAPSSTEEDDGLRNRKVGEQKVQTSL

SEQ ID NO: 598 - protein, 350 aa, Cryptococcus neoformans
MAAPQATLGADLEPPATDLITLTRHILSQQYALGESATGDLTMLLIAIQVTSKYIASNVRKARLINLVGLAGASNVQGEDQKKLDVLSNDIMVNALSASGKCSVMVSEEVDEAIIVSGIKGTYCVVFDPLDGSSNIDAGVNVGTIFGVYKVQEGSRGTVEDVLRPGREMVAAGYTMYGSSCNLVLSTGNGVDGFTLDESLGEFILTHPAIKIPSRGKIYSFNEGNSLHFYPPTNDYLNSIKYPENGKPYSARYIGSMVADVHRTLLYGGIFGYPDDKKSKDGKLRMLYEAFPMSFLTEQAGGVATTGSQRILDIVPTSIHGRCPVFLGSKEDVEDLKKFYVNYKDDSRKW

SEQ ID NO: 599 - protein, 476 aa, Lycopersicon esculentum
MDLETSEISNYKSSVVLSKLASNEQHGENSPYFDGWKAYDNDPFHLVNNLNGVIQMGLAENQLSVDLIEEWIKRNPKASICTNDGIESFRRIANFQDYHGLPEFTNAIAKFMEKTRGGKVKFDAKRVVMAGGATGANETLILCLADPGDAFLVPTPYYPGFNRDLRWRSGVQLLPISCKSCNNFKITIEAIEEAYEKGQQANVKIKGLILTNPCNPLGTILDRDTLKKISTFTNEHNIHLVCDEIYAATVFNSPKFVSIAEIINEDNCINKDLVHIVSSLSKDLGFPGFRVGIVYSFNDDVVNCARKMSSFGLVSTQTQHLLAFMLSDDEFVEEFLIESAKRLRERYEKFTRGLEEIGIKCLESNAGVYCWMDLRSLLKEATLDAEMSLWKLIINEVKLNVSPGSSFNCSEVGWFRVCFANIDDQTMEIALARIRMFMDAYNNVNKNGVMKNKHNGRGTTYDLTPQMGSTMKMLLA

SEQ ID NO: 600 - protein, 546 aa, Ustilago maydis
MADGPSKDELVEIFKSLKTTQKGNKAADRSPRHSTTRQVCFDCGAKNPTWASATYAIYICLDCSSVHRNMGVHITFVRSTNLDSWHWSQLRLMKVGGNAAAAEFFNKKGGAHLLAPSTEGKVKYTSSVAQAYKDELQKRALLDAAGQSLNSPVYFPGLAVASTETATPSSSTKAGGDDDDFFDSWDKPASAAKPAASTTAKPAPAPVSTRAPAAAAAAPKTVTSASLRASSSAARKTLGAVSRTSSASSTPGTTTPTGTGPTTTASALGAPSARPARAGKLGLGVKKAAAPIDFAAAERKAKEEEAARAAEAKAEQKAEETAREAQKASAEQAEAERIAREAVKAAVGKTSAATPASASSNANVRGAAGSVPDAFAAAKANGDMDRLGMGFGRLGMKANAHQAKLAAERAAAAANNAAAGSDLDAGGDEPSYARNQFSGQKSISSDQYFQRGSYDPQATSEAQQRLQSFQGQTSISSNQYFGRDEDEEAEQQAVQGSGDFADIEATAREYYQRFMANPDVQSSIDSFRAGALKLSQYLEDMSRNGA

SEQ ID NO: 601 - protein, 522 aa, Burkholderia vietnamiensis
MIPVKPAIRRVAASRTGAITAAVFIAFAFELAPAALAQTVPASATTATTAMPAPAAAPLPSPCPPDWEAQLCELKAAIEVLKKQHLTDVDIGALLDATVHAGIKTLPYARFFNAAERRQQLDDEGRARDGTPGIGIVFETRPDGLHIIDVIPDAPAEKAGVRPDDLVVAMNDQSVVGLDSADVVKLAKGDAGVPLKLTIRRGPGQATLVVAPVRAIVRPHPASAKRLAGDILYTRLSSFPEPAVGNYIDAVEAARRNGPPVKGVILDLRINGGGALNAAIGITALFAGRERTAMVTLERDGRNRRRITTNWPDYELPVMHGQDPLAPLQADDWWRTVPLVVLVDGQSASAAEATAAALRDLGRARLLGMPTYGKGLAQTGVDLIDGTRLNLTFARNLRPNGCPMDGYGVVPDWLVPPRRDSDVDGVLLWYREVDLARAPYADRLAPDPFATVRDARRKLRDARVRAKVEMSKSAALPQREFGTAADWQLRQALAALAGQPVQTVAAPAQLMPAQPVCERRDD

SEQ ID NO: 602 - protein, 184 aa, Avicennia marina
MASKESADNNPGLHTSLDEATKGYFLQQTMLRVKDPKVSLDFYSRIMGMSLLKRLDFPEMKFSLYFLGYEDTSSAPSDPVERTSWTFGQKAVLELTHNWGTESDPEFKGYHNGNSDPRGFGHIGVTVDDVHKACERFESLGVEFVKKPRDGKIMDVAFIKDPDGYWIEIFDTRTIAKSTADAAV

SEQ ID NO: 603 - protein, 589 aa, Zea mays
  misc_feature (559)..(559): Xaa can be any naturally occurring amino acid
  misc_feature (572)..(572): Xaa can be any naturally occurring amino acid
MCGILAVLGCSDCSQARRARILACSRRLKHRGPDWSGLYQHEGNFLAQQRLAIVSPLSGDQPLFNEDRTVVVVANGEIYNHKNVRKQFTGAHSFSTGSDCEVIIPLYEKYGENFVDMLDGVFAFVLYDTRDRTYVAARDAIGVNPLYIGWGSDGSVWMSSEMKALNEDCVRFEIFPPGHLYSSAGGGFRRWYTPHWFQEQVPRTPYQSLVLREAFEKAVIKRLMTDVPFGVLLSGGLDSSLVASVTKRHLVETDAAEKFGTELHSFVVGLEGSPDLKAAREVADYLGTTHHEFHFTVQDGIDAIEEVIYHDETYDVTTIRASTPMFLMARKIKSLGVKMVLSGEGSDELLGGYLYFHFAPNREELHRETCRKVKALHQYDCLRANKATSAWGLEVRVPFLDKEFVDVAMGMDPEWKMYDKNLGRIEKWVLRKAFDDEEHPYLPEHILYRQKEQFSDGVGYNWIDGLKSFTEQQVTDEMMNSAAQMFPYNTPVNKEAYYYRMIFERLFPQDSARETVPWGPSIACSTPAAIEWVEQWKASNDPSGRFISSHDSAATDRTXATSWRWPTAAGTXAANGTVNGNDVAVAIAV

SEQ ID NO: 604 - protein, 684 aa, Arabidopsis thaliana
MEVGSATKKLQCQRIGCNAMFTDDDNPQGKHTTEKPVLAKSVPKHPVAAPTSSPDANAATKDSCSRCRQGFFCSDHGSQPKEQIKQTLNTPGQAEEEKIEPLAPPVQKAVIDINQPQVCKNKGCGQTFKERDNHETACSHHPGPAVFHDRLRGWKCCDVHVKEFDEFMEIPPCTKGWHSSSPDPAATTISAAEHFPMRLIVPLRGVIQGRGGLFVGSLIPCCLFYFLQLYLKRRRPPPSDPTDLPRTFSRTNLFSRGNSIGRVRVSSRAVPVAKPSDSPYYIGLERVKTDPYDRITNTDGIIQLGLAESTRWMSENLMESMMQSDDGEFDISSIAMYKPFEGLLELRVAFADFMSRIMGGNVSFDPSNMVITAGGTPAIEVLAFCLADHGNAFLIPTPYYPGFDRDIKFRTGVELIPVHCRSSDNFTVTVSALEQALNQARKRGSKVSGILFSNPSNPVGNILSRETLCDILRFAQEKNIHVISDEIFAGSVYGDKEFVSMAEIAGSGEFDKTRVHIIYGLSKDLSIPGFRAGVIYSFHEDVVNAAKKLMRFSSVPVLVQRILISLLSDVRFIEGYMAAHRQRIRDKHIRFVEGLKQLGIPCAESGGGLYCWVDMSSLLTSYSEKGELELFEKLLTVAKINATPGTACYCIEPGWFRCCFTALADEDIPVIMERIRQLAESFRS

SEQ ID NO: 605 - protein, 201 aa, Lilium longiflorum
ELSVLCDAEVALIIFSNHGRLSEFCSSSSMMKTLERYHKCSYNATEDIIPSKETENSYHEYLKLKTRVDYLQRSQRNLLGEDLGPLSTKELEQLENQLEISLKHIRSTKTQLMLDELSDLKGKEHMLQDANQLLRRKSWKNCSRDSGPSMPSDCQPARPERFFQPLACDSSLQIGFHPVGIDQLNNGVSPQNGDDYAPAWM

SEQ ID NO: 606 - protein, 397 aa, Rickettsia rickettsii
MLSKLNKPALFALIFYPIFIISLVVKYSFDYGIGLTEVIFIIASYYINNITVGIGLHRLWSHNAYKINKYAEFVLIMLSAGTLQGPALSWASNHYKHHRYTDQDQDPHTPLKFDNKFLGFMWSHIGWMLVGSGSYKSIDRITWAKHGKNNLLKWQLKYYWQIAAFMNIVVPLFIGYLVGGTMQSAYAGFLFMGLGRFLQQQATFCVNSLCHFAGSKKYYKGTAGDIWWMALFLLGENWHNYHHAFPSDYRNGAKWYHLDVHKWIIFLMSKIGLASELERTTKVRIQAKMQETLSYLSEKQKQKLTLMQTKIDHLLENLCLKIKELEESSITIKEQFKKSFVEIQESLKNLAEQVSAAKQITEKSSEKLLKIVNKKIIDAEQSIYKLYNQLNTLKVSN

SEQ ID NO: 607 - protein, 476 aa, Neurospora crassa
MSLPKDFLWGFATAAYQIEGAIHADGRGPSIWDTFCNIPGKIADGSSGAVACDSYNRTKEDIDLLKSLGATAYRFSISWSRIIPVGGRNDPINQKGIDHYVKFVDDLLEAGITPFITLFHWDLPDGLDKRYGGLLNREEFPLDFEHYARTMFKAIPKCKHWITFNEPWCSSILGYNSGYFAPGHTSDRTKSPVGDSAREPWIVGHNLLIAHGRAVKVYREDFKPTQGGEIGITLNGDATLPWDPEDPLDVEACDRKIEFAISWFADPIYFGKYPDSMRKQLGDRLPEFTPEEVALVKGSNDFYGMNHYTANYIKHKKGVPPEDDFLGNLETLFYNKKGNCIGPETQSFWLRPHAQGFRDLLNWLSKRYGYPKIYVTENGTSLKGENAMPLKQIVEDDFRVKYFNDYVNAMAKAHSEDGVNVKGYLAWSLMDNFEWAEGYETRFGVTYVDYENDQKRYPKKSAKSLKPLFDSLIKKD

SEQ ID NO: 608 - protein, 251 aa, Yersinia pestis
MNLISIPAFQDNYIWLLANRQKHCVIVDPGESAPVLATLAQGQYVPQAILLTHHHNDHVGGVADLRHHFPDIPVYGPQETAKKGATVIVNDGDSLTIAGQNYTIIAVPGHTLGHIAYYSSPYLFCGDTLFSAGCGRLLEGTPEQMYASIQRLAQLPDETLICCAHEYTLSNLKFAHAILPADQDIATYQQQIEQLRSKNLPSLPVKLQFERKINVFLRCNDIDLQRKIGTTSPPDSLVSVFCELRSRKDSF

SEQ ID NO: 609 - protein, 252 aa, Brassica oleracea
MGRGRVEMKRIENKINRQVTFSKRRNGLLKKAYELSVLCDAEVALIVFSSRGKLYEFGSVGVERTIERYHRCYNCSVTNNRPEESKQNWCQEVAKLKAKYESLVRTNRHLLGEDIGEMGVKQLQALERQLEAALTATRQRKTQVMMEEMEDLRKKERQLGDINKQLKIKFEAGGHAFKSFQDFWPNSAASMAGDPNNSKFPVQPSHPDSVDCNTEPFLQIGFQQHYYVQGEGSSVPKSNVACETNFVQDWFL

SEQ ID NO: 610 - protein, 499 aa, Sinapis alba
EITCQENLPFTCGNTDALNSSSFSSDFIFGVASSAYQIEGTIGRGLNIWDGFTHRYPNKSGPDHGNGDTTCDSFSYWQKDIDVLDELNATGYRFSIAWSRIIPRGKRSRGVNEKGIDYYHGLISGLIKKGITPFVTLFHWDLPQTLQDEYEGFLDPQIIDDFKDYADLCFEEFGDSVKYWLTINQLYSVPTRGYGSALDAPGRCSPTVDPSCYAGNSSTEPYIVAHHQLLAHAKVVDLYRKNYTHQGGKIGPTMITRWFLPYNDTDRHSIAATERMKEFFLGWFMGPLTNGTYPQIMIDTVGERLPSFSPEESNLVKGSYDFLGLNYYFTQYAQPSPNPVNSTNHTAMMDAGAKLTYINASGHYIGPLFEKDKADSTDNIYYYPKGIYSVMDYFKNKYYNPLIYVTENGISTPGDENRNQSMLDYTRIDYLCSHLCFLNKVIKEKDVNVKGYLAWALGDNYEFNKGFTVRFGLSYIDWNNVTDRDLKKSGQWYQTFISP

SEQ ID NO: 611 - protein, 627 aa, Bacillus subtilis
MAAASPTAHDVYLFHEGSLFKSYQLFGSHYRELNGKSGYEFCVWAPHASEVRVAGDFNSWSGEEHVMHRVNDNGIWTLFIPGIGEKERYKYEIVTNNGEIRLKADPYAIYSEVRPNTASLTYDLEGYSWQDQKWQKKQKAKTLYEKPVFIYELHLGSWKKHSDGRHYSYKELSQTLIPYIKKHGFTHIELLPVYEHPYDRSWGYQGTGYYSPTSRFGPPHDLMKFVDECHQQNIGVILDWVPGHFCKDAHGLYMFDGEPLYEYKEERDRENWLWGTANFDLGKPEVHSFLISNALYWAEFYHIDGFRVDAVANILYWPNQDERHTNPYAVDFLKKLNQTMREAYPHVMMIAEDSTEWPQVTGAVEEGGLGFHYKWNMGWMNDVLKYMETPPEERRHCHQLISFSLLYAFSEHFVLPFSHDEVVYGKKSLLNKMPGDYWQKFAQYRLLLGYMTVHPGKKLIFMGSEFAQFDEWKDTEQLDWFLDSFPMHQKASVFTQDLLRFYQKSKILYEHDHRAQSFEWIDVHNDEQSIFSFIRYGQKHGEALVIICNFTPVVYHQYDVGVPFFTQYIEVLNSDSETYGGSGQINKKPLSAKKGALHHKPCYITMTIPPYGISILRAVKKRGEIKR

SEQ ID NO: 612 - protein, 317 aa, Debaryomyces hansenii
MSIKLNSGYDMPLVGFGCWKVDNDTCAATIYNAIKVGYRLFDAAQDYGNCKEIGEGINKALDEGLVARDELFITSKLWNSYHDPKNVELALKKVLSDMKLDYLDLFLIHFPIAFKFVPIEERYPPGFYCGDGDKFHYENVPLADTWKAMEKLTKSGKVKSIGISNFSGALIYDLLRSAEIKPAVLQIEHHPYLQQPRLVEYVQSQNIAITGYSSFGPQSFLELKHSKALDTPTLFEHKTIKSIANKNKKTPAQVLLRWASQRNIAVIPKSNNPDRLLQNLEVNDFDLSKEDFEEISKLDQELRFNNPWDWDKIPIFA

SEQ ID NO: 613 - protein, 387 aa, Moorella thermoacetica
MPRIWRQIGRGLLALCVLVTLAVGVGVATHFREVEQGVKTYALLRFQALQPISTDKLMEGAIRGMVEALDDPYSTYLDAETYRKLQESVTGSYGGVGLLITLDEKDKRVVVVSPFKGTPAQRAGIKSGDYITAIDGRDTTGMDLETASNLMQGEPGTRVELTILSAGDSNPRKVALTREIIKVPTVDGRMLPGHPGVGYISVTMFNEQTGADLGRELNDLRQQGMQKLILDLRNNPGGALPAAVDVASYFVPQGPVVYIADQKTSEPLMARGYAQPLPLVVLVNKGSASAAEIVAGAIKDTKSGTLVGETTFGKGIVQTIFPLPGDAAVKITTQKYLTPGKHDINKKGITPDYVVPMDPQLEQQVLAHAPDLERDVQLQKALEVLGK

SEQ ID NO: 614 - protein, 589 aa, Helianthus annuus
MCGILALLGCSDDSQAKRFRVLELSRRLKHRGPDWSGLYQHGDNYLSHQRLAVIDPASGDQPLYNEDETVVVTVNGEIYNHMELREKLMGHKFKTGSDCDVIAHLYEEHGENFVDMLDGMFSFVLLGTRDNSYLVARDAIGITSLYIGWGLDGSVLISSGLKGLNDDCEHFEVFLAGHLYSSKIRGFRRWYNLPWFSESIPSTPYDPLVLRCAFENAVIKRLMTDVPFGVLLSGGLDSSLVASVTARHLAGSKAAKQWGAQLHSFCVGLEGSPDLKAAREVADYLGTLHHEFHFTVQDGIDAIEDVIYHIETYDVTTIRASTPMFLMSRKIKSLGVKMVISGEGSDEIFGGYLYFHKAPNKEEFHQETCRKIKALHQYDCLRANKSTSAWGLEARVPFLDKEFINVAMSIDPEAKMINMDQKRIEKWILRRAFDDEEKPYLPKHILYRQKEQFSDGVGYSWIDGLKSHAEQHVTNKMMLNAERIFPHNTPVTKEAYYYRMIFERFFPQNSAKLTVPGGASVACSTAKAIEWDASWSNNLDPSGRAALGVHNAAYKKNSGSISSANLAPSIADNVPRMMDITGPELVIRS

SEQ ID NO: 615 - protein, 154 aa, Bacillus cereus
MSEEKKDSSRPPVRNYLKQIDDFFEQTPLRNVIADLNHFFQKGNRLLTFPVDLYEVGEELVVTAELPGIQKEQIQIEIQSEYLKVSVKEEILEEEEEQTSHNYYRRERSISEASRLIKLPYSINKKAAKASYQNGVLEIRAPKLPQQHDILSID

SEQ ID NO: 616 - protein, 633 aa, Bacillus cereus
MCGFVGCLCENPREFSETEKHQFENMNTMIFHRGPDDEGYFRDEHVQFGFRRLSIIDLEAGHQPLTYENDRYVIIFNGEIYNYVELREMLLEKGATFATQSDTEVIIALYAHMKEKCVDYLRGMFAFMIWDREEKKLFGARDHFGIKPLYIAQQGDTTFFASEKKSIMHVMEDKGVNPTSLQHYFTYQYGPEPETLTIDVNKIEPGHYFVKEIGKEMEIHRYWKPYFNASSATKEEHIQAIRDVLYDSVKVHMRSDVPVGSFLSGGIDSSIIASIAREMNPNLLTFSVGFEQRGYSEVDVAKETAEKLGVKNHNVFISAKEFMDEFPKNHWHMDDPLADPAAVPLYFVAKEARKHVTVVLSGEGADELFGGYNIYREPNSLKMFSYIPSPGKSVLKALSGALKEGFKGKSFLERGCTPIEERYYGNAKIFREEEKAELMKYYNESVNYMDITKPLYNEIKDYDDVSKMQYIDMFTWLRGDILLKADKMTMANSLELRVPFLDKEVFDVASKIPTEFKIANGTTKAILREAARGIVPDHVLDRKKLGFPVPIRHWLKDEMHDWAINIINESKTEHLIDKQYVLNLLEAHCADKGDYSRKIWTVLAFMVWHQIYVEHKYDTNKFHEETKRAYSLV

SEQ ID NO: 617 - protein, 199 aa, Arabidopsis thaliana
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 618 - protein, 416 aa, Zea mays
MSAAFDAYTDKNAVFRRLKAKPENKMCFDCNAKNPTWASVTYGIFLCLDCSAAHRSLGVHITFVRSTNLDSWTPDQLKMMAFGGNNRAHAFFKQHGWTDGGKVEAKYTSRAAELYRQMLTKEVAKSATTDNALPSSPVASEASKPPSDDFPEFKLPDVPAPPAENLNGKHEPKSPRAAPHSPKAATHPTFATSVKKPIGAKKVGGKTGGLGVRKLTTKPNESLYEQKPEEPKPAVPALAASTKKGGQALHSRFEYVENEPSADLRTGGSGSRVSGHVAPPKSSDFFQEYGMGNGFQKKSSNASKTQVEETDEARKKFSNAKAISSSQFFGTQNREEKEAQLSLQKFAGSSSISSADLFGRNDVDNSNLDLSAADLINRISFQASQDLSSLKDIAGETGKKLTSLASNFISDLDRIL

SEQ ID NO: 619 - protein, 227 aa, Arabidopsis thaliana
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 620 - protein, 510 aa, Neorickettsia risticii
MSKSYGGPEVTKDGYKVINNLNPEDEKIAKIVELLNQATSQANEKAGDGTTTATILVGNMIKNAHKHIAAQRSRTKLKSGMKPRTDEVVKYIQSVAKKINSEEEIAQVGSISANGNSEIGNKIAEAMNKVGKEGVITVEEGKGLDEFSVSVVQGMVFDRGYVSPYFITNPEKMIVEFDNPYVLLANKKLSSIQPMVPLLETIVRSNRAVVIIAEDVEGEALTSLVLSKMRGSLKACAVKAPGFGDRRSEMLEDIRILTGAKTLVSDDLGVTVESLTVEDLGTAKSIIISKDSTTIVDGGGVKTSIDARVKQIKTQIDKTTSDYDKEKLQERLAKLAGGGAVLKVGGATEVEVKERKDRVEDALHATRAAVEEGIVPGGGATLLSAIAVLEKLSSDDDDEQAGINIVKSALKAPISQIVENAGEDASVITYNLLESKDPNRIFDARELKYVDAFKAGIIDPAKVVRVALESAVSVASVLVTTEALIVDLPTKDNGSPSMMPGGGMGGMGGF

SEQ ID NO: 621 - protein, 482 aa, Zea mays
  misc_feature (255)..(255): Xaa can be any naturally occurring amino acid
MAASVTVENLNPKVLKCEYAVRGEIVIHAQRLQQQLQTQPGSLPFDEILYCNIGNPQSLGQQPVTFFREVLALCDHPCLLEKEETKSLFSADAISRAKQILATIPGRATGAYSHSQGIKGLRDAIAAGITSRDGFPANADDIFITDGASPGVHMMMQLLIRNEKDGILCPIPQYPLYSASIALHGGALVPYYLDEKTGWGLEISDLKKQLEDARSKGIDVRALVVINPGNPTGQVLAEDNQYDIVKFCKNEGLVXLADEVYQENIYVDNKKFNSFKKIARSMGYGEDDLPLVSFQSVSKGYYGECGKRGGYMEITGFSAPVREQIYKVASVNLCSNITGQILASLVMNPPKVGDESYASYKAEKDGILQSLARRAKALEDAFNTLEGFSCNKAGGAMYLFPQIHLPHKAIEAAKAAKKAPDAFYALRLLESTGIVVVPGSGFGQVPGTWHVRCTILPQEDKIPAVITRFKAFHEAFMAEYRD

SEQ ID NO: 622 - protein, 176 aa, Triticum aestivum
MVFLSNAISNARIEESHSKGELHHDAVETTIYGTRWASEDIPRFDLPEDEMPSNVAYRLIKDDLALDGNPALNLATFVTTYMEEEAEKLMAENLSKNFIDYEEYPQSVELCNRCVNMIARLYHAPMHSADEEALGCSTVGSSEAIILATLAMKRRWQNARKEKGLPTDKPNLIFGA

SEQ ID NO: 623 - protein, 345 aa, Bacillus cereus
MNSELFSPYTIKDVTLKNRIVMSPMCMYSSENEDGQVTNFHLVHYGTRAAGQVGLVMIEATAVLPEGRISNKDLGIWDDSLIEGLHKTTTFIHDNGAKAAIQLAHAGRKAELETDALAPSAIPFNETMKTPVEMSKHQIKDTILAFQQAAIRSKQAGFDVIEIHGAHGYLINEFLSPLSNKRTDEYGGSPENRYRFLREIIDSINEVWNGPLFVRISANDYHPDGLTVQDYVQYTKWMKEQGVDLIDCSSGAVVPARIDVYPGYQVQYAKHIKEHANIATGAVGLITTGAQAEQILNNNEADLIFIGRELLRNPYFPRIAANELGFELEEPHQYERAPGKISTNK

SEQ ID NO: 624 - protein, 544 aa, Bacillus anthracis
MAKDIKFSEEARRSMLRGVDTLANAVKVTLGPKGRNVVLEKKFGSPLITNDGVTIAKEIELEDAFENMGAKLVAEVASKTNDVAGDGTTTATVLAQAMIREGLKNVTAGANPMGLRKGIEKAVVAAVEELKTISKPIEGKSSIAQVAAISAADEEVGQLIAEAMERVGNDGVITLEESKGFTTELDVVEGMQFDRGYASPYMITDSDKMEAVLDNPYILITDKKISNIQEILPVLEQVVQQGKPLLIIAEDVEGEALATLVVNKLRGTFNVVAVKAPGFGDRRKAMLEDIAILTGGEVITEELGRDLKSATVESLGRAGKVVVTKENTTVVEGVGSTEQIEARIGQIRAQLEETTSEFDREKLQERLAKLVGGVAVIKVGAATETELKERKLRIEDALNSTRAAVEEGIVAGGGTSLMNVYTKVASIVAEGDEATGINIVLRALEEPVRQIAINAGLEGSVVVERLKGEKVGVGFNAATGEWVNMLETGIVDPAKVTRSALQNAASVAAMFLTTEAVVADKPEPNAPAMPDMGGMGMGGMGGMM

SEQ ID NO: 625 - protein, 532 aa, Xylella fastidiosa
MRIKTGIKKAFILMLSVVLVSLVAIAVVAAHQFYIRLPQSRLFYAWKKVDEVYYDRTFAGFDWPAVLATYKKQLPRFDSDGQKTSPIINDMLSLLEVSHLQHFPAFLVPEEKKKTAVLASYFPELRDISGMVMVMDMLPRISRVLSLETWSPLYTHGVRVGDRILLETLDTDISDKNKPVRLYCYHINTAGVKKEFEFDLPAPPLGAQQTAVPAGDHVLHIARFDQGEIQALKHVSEDRNSSITQLHYISLGAVTTALHLPKNKVIDVVKDSEADKAGVEIGSFIGNGTNIKAGPENIGGKKVIKTDSRYEVVLPDGRKVTFSINKIIPKLNDIEGIRSAQLIGKTLVITFNEMSDENTQWALQQIKNTPATAIVLDLRYNTGGSGIAGEKLLAGFLASGTRIATEIRGKKTNEINVPAGYTPTDKPTAVLISLLSASGAELAARTLQFHHRARIYGAQSSGQVLTSRFYKLTDGTYMQIADTNLLDPAGKPIEWYGVMPDVKKWKTLSDVRAGRDPVLECALTDLSGGRCH

SEQ ID NO: 626 - protein, 544 aa, Brucella melitensis
MAAKDVKFGRTAREKMLRGVDILADAVKVTLGPKANVVIEKSFGAPRITKDGVSVAKEVELEDKFENMGAQMLREVASKTNDTAGDGTTTATVLGQAIVQEGAKAVAAGMNPMDLKRGIDLAVNEVVAELLKKAKKINTSEEVAQVGTISANAKQIGKMIAEAMQKVGNEGVITVEEAKTAETELEVVEGMQFDRGYLSPYFVTNPEKMVADLEDAYILLHEKKLSNLQALLPVLEAVVQTSKPLLIIAEDVEGERLATLVVNKLRGGLKIAAVKRPGFGDRRKRMLEDIAILTGGQVISEDLGIKLESVTLDMLGRAKKVSISKENTTIVDGAGQKAEIDARVGQIKQQIEETTSDYDREKLQERLAKLAGGVAVIRVGGATEVEVKEKKDRVDDALNATRAAVEEGIVAGGGTALLRASTKITAKGVNADQEAGINIVRRAIQAPARQITTNAGEEASVIVGKILENTSETFGYNTANGEYGDLISLGIVDPVKVVRTALQNAASVAGLLITTEAMIAELPKKDAAPAGMPGGMGGMGGMDF

SEQ ID NO: 627 - protein, 260 aa, Thermobifida fusca
MARVRGPFVLVDGRGPAVVLRMHLHGQGRGRLRGARRVGGVLSTSRLQLGLVGRPAPPPPVTRNTLNKVEFMGLKFGDDHRRKAARPPHLNPPPPGGHQRVRGGTDMALPVVRSSQPTTGWDPFRELNELHTQLHRWMDSVLERTSGLTADPLSWSPLADLSETEDAYLVEVEVPGVSREDISIDLSGTELVITGERKEREREGWFRHRTRSVGRFHYAVTLPRDIDPDGVDATLSQGVLTVRIPKSKALKPRRIAITER

SEQ ID NO: 628 - protein, 366 aa, Carica papaya
QMGLAENQLCFNLIHEWLLKNPEASICTAQGAAEFRDIAIFQDYHGLAEFREAVAKFMGKVRRNRASFDPDRIVMSGGATGAHEMIAFCLADPGDAFLVPTPYYPGFDRDLRWRTGVKLIPVVCESSNDYQITIEALEAAYETAQEADIKVKGLLITNPSNPLGTIITKDTLEALVTFANHKNIHLVCDEIYAATVFSQPEFTSIAEIIEEDKICCNRDLIHIIYSLSKDMGFPGFRVGIVYSYNDAVVSCARKMSSFGLVSSQTQYLIASMLADDEFVDKFIVESRKRLAMRHSFFTQRLAQVGINCLKSNAGLFVWMDLRRLLKEQTFEAEMVLWRVIINEIKLNVSPGSPFHCSEPGWFRVCF

SEQ ID NO: 629 - protein, 664 aa, Listeria monocytogenes
MTDYPSIFEPLTVKRMTIKNRVIMPPMGTNLAGLNGEFLEEHMNYYEQRAKGGTGLITIENACVDFPYGTNGTTQLRIDNDQYIPGFYKLTERLHKHGTCVSIQINHAGASAYPARLNGLQPVSASDIPSKKGGTVPRPLTVEEIYEIVNKYGDAARRAQQAGFDAVEIHGGHSYLLCQFLSPLYNKRTDEFGGSPENRARIVKLILEKVRAEVGPFFPIVLRFSADEFTEGGNHLEDILELLDYCQEEADILNVSAAINDNLYLQIDQMNLEDGWRSYLAKAVKDKFNKPTITSGNIRSPKAAEKILSEGYADLLAMGRGLIAEPNWVNKVATGQEDMLRKCISCNIGCADHRISKSKPIRCTVNPDIIHEDKYKETKVTRPTNVVVIGGGTAGLEAACTAAEVGCNTTLIEASEQTGGLARAIANLPDKSRIADFPNYLANRAEKLTNLKVITGTKADTALIDTFNPDVVVNATGSKPLLPPIKGLHDVIDKEGSKVHSIFGLISNIDDFTEFSNKKVAVIGGGAVGLDVVEYFSERGSDVTIVEMMPLLGKDLDMITRLSMMDIIEKNNVDVQTETALTEVAADHFKVKHDGVDAEIPFDYGFVCLGMRPERPLMEELAAYGKEKQIEIVNIGDSAATRKILEGVREGRNILTTLEKIGSL

SEQ ID NO: 630 - protein, 590 aa, Asparagus officinalis
MCGILAVLGCSDDSQAKRVRVLELSRRLKHRGPDWSGLCQHGDCFLSHQRLAIIDPASGDQPLYNEDKSIVVTVNGEIYNHEELRRRLPDHKYRTGSDCEVIAHLYEEHGEDFVDMLDGMFSFVLLDTRNNCFVAARDAVGITPLYIGWGLDGSVWLSSEMKGLNDDCEHFEVFPPGNLYSSRSGSFRRWYNPQWYNETIPSAPYDPLVLRKAFEDAVIKRLMTDVPFGVLLSGGLDSSLVAAVTARHLAGSKAAEQWGTQLHSFCVGLEGSPDLKAAKEVAEYLGTVHHEFHFTVQDGIDAIEDVIFHIETYDVTTIRASTPMFLMARKIKSLGVKMVISGEGSDEIFGGYLYFHKAPNKEEFHHETCRKIKALHQYDCLRANKATSAWGLEARVPFLDKEFMDVAMSIDPESKMIKPDLGRIEKWVLRKAFDDEENPYLPKHILYRQKEQFSDGVGYSWIDGLKAHAAKHVTDRMMLNAARIYPHNTPTTKEAYYYRMIFERFFPQNSARFTVPGGPSIACSTAKAIEWDARWSNNLDPSGRAALGVHDSAYDPPLPSSISAGKGAAMITNKKPRIVDVATPGVVIST

SEQ ID NO: 631 - protein, 463 aa, Listeria monocytogenes
MNNNFLWGGATASYQCEGAWDVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTQKTMIAAYNVMYASALGVKAFKEGGYPGQIGIVHSYTPVNGVDESIETKIAMRYADNYCNNWILDTAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVAKVDDAYRIAFMNDHINAIFNAIDAGCDVRGYYAWSPFDLYSWKNGVEKRYGLVAVDFKNNQIRKPKASYYWFKEMIESQGKLIKRREF

SEQ ID NO: 632 - protein, 502 aa, Paracoccidioides brasiliensis
MGADVASSTYRYTETPTYTTSNGCPVMDPESSQRVGMKGPLLLQDFHLIDLAHFDRERIPERVVHAKGAGAYGEFEVLDDISDITVIDMLLGVGKKTKCITRFSTVGGEKGSADSARDPRGFSTKFYTEQGNWDWVFNNTPVFFLRDPSKFPIFIHTQKRNPQNNLKDATMFWDYLSTHQESANRSCMHLFSDRGTPILPTGTCNGILGHHITQWTKPDGTFNYVQIHCKTDQGNKTFNNEEATKMAADNPDWHTEDLFKAIERGEYPSWTCTFRSSAPSRLEIRWNVFDLTKVWPQAEVPLRRFGRFTLCENPQNYFAEIEQAAFSPSHMVPGVEPSADPVLQSRLFSYPDTHRHRLGVNYQQIPVNCPLRAFNPYQRDGAMAINGNYGANPNYPSTFRPMEFKPVKACQEHEQWAGAALSKQIPVTDEDFVQPNGLWQVLGRQPGQQENFVHNVSVHLCGAQEKVRKATYCMFSRINADLGARIEKATERLVASQPQSHL

SEQ ID NO: 633 - protein, 145 aa, Bacillus cereus
MRNLFPEITKRQNGIFDFGPSLLEGMTDAFFKPLNMDTFKVDVHEQSGKYTVKADLPGFQKENIQVDFEQDILTIQATNHNEVDEKNENGTYIRKERSIGSVTRRFNFKQVEEENVKANYKDGVLTIELPKLKEEKSSKTTINIE

SEQ ID NO: 634 - protein, 383 aa, Pyrococcus horikoshii
MKFPRIGLPKEKVIELINEKTKKDLTFSSGKILGSMCTMPHDLAIEVYTKYIDRNLGDPGLHPGTRKIEEEVIEMISDLLHLEKGHGHIVSGGTEANILAVRAFRNLSDVEKPELILPKSAHFSFIKAGEMLGVKLVWAELNPDYTVDVRDVEAKISDNTIGIVGIAGTTGLGVVDDIPALSDLARDYGIPLHVDAAFGGFVIPFAKELGYELPDFDFKLKGVQSITIDPHKMGMAPIPAGGIVFRRKKYLKAISVLAPYLAGGKVWQATITGTRPGASVIAVWALIKHLGFEGYMRIVERAMKLSRWFAEEIKKINNAWLVREPMLNIVSFQTKNLKKVERELKSRGWGISAHRGYIRIVFMPHVTREMIEEFLKDLKEVLS

SEQ ID NO: 635 - protein, 359 aa, Ralstonia metallidurans
MSALFTPVRVGRYTLKNHLVMAPMTRSRASLDGTPGELAAEYYAQRASVGLIVTEGTQPSDDGQGYLATPGIYTEAHVDGWKNVTAAVHERGGRIFIQLMHAGRMSHPDNTPHHRQGVAPSAIAPGVPMFTLKGMQDIPAPRALTTAEVRQTVDDFRFAARQAIAAGADGVEIHGANGYLVQQFFAPNANTRTDKYGGSIDNRARFAIEVATAIAGEIGADRTAIRLSPGTPLWGIDEGAEGPALYRHLVTELDKLGLAYLHVSLQGNEPQLADIRERWRGTLILNRPGRTREAVGADVASGLADLEAYGQMVLANPDFVTRLKLGAPMNDALPNAFFGGDGRGYIDYPALALTDTVTS

SEQ ID NO: 636 - protein, 140 aa, Ralstonia eutropha
MTNLRHFDPFSVEPISDMLQGMLRSFRGTADNGLAFKVDVSESESAYTLAAELPGVKKEDIDVSVDRGTVMISAKVEKSSEQKEGERVIRRERYSGSMQRAFTLDASIDEGKVEASYDNGVLRVVLPKKETSPQQRITVK

SEQ ID NO: 637 - protein, 812 aa, Unknown
  Frankia sp. CcI3
MNNGDVNNGTARTGRLATGLAPDRPNPRGAATAVRNGGGRVALADRDASSASAQPGQTADDPAVPSAPPSAPPSALPADPPAVAPAVSVDLPYDDLERLVSGAHHDPHALLGAHPHPGSDATVVRVLRPDARAVTVLVGPARYPATRLHSGGVFGVAVPGMLPDYRIEVTYPDGPYLIDDPYRHLPTLGEMDLHLIIEGRHEQLWKVLGAHPRALTTPGGATVTGVSFAVWAPSARGVRLVGDFDFWDGRAFPMRSLGRSGIWELFVPGAGTGARYKYEILGFDGIWRQKADPLAFHTEVPPATASVVFASDFTWNDGAWLDRRARTAWRTEPVSVYEVHLGSWRRGLSYRELAEELTAYVVENGFTHVEMLPVAEHPFGGSWGYQVSAYYAPTARFGSPDEFRHLVDTLHRAGIGVIVDWVPAHFPRDTWALGRFDGTPLYEHPDPRRGEQPDWGTYVFDLGRPEVRNFLVANALYWFEEFHIDGLRVDAVASMLYLDYSRPEGGWLPNIHGGRENLDAVSFLQETNATVYRRFPGAMMIAEESTAWPGVTRPTHLGGLGFGFKWNMGWMHDTLDYNSRLPIHRMYHHHQMTFSMVYAYSENFILPFSHDEVVHGKGSLLRKMPGDRWAQLANLRALLAYMWAHPGKKLLFMGCEFAQDNEWNESASLEWPLLDDPAHAGVADLVRDLNGLYRTVPALYQHDADPAGFSWIDANDAENNVFSFLRWSGEDPAGGVLACVTNFAGIGHEGYRIGLPFPGRWREILNTDGYRYGGGNIGNLGSVQAVEEPHHGLDASATLTLPPLGAIWLSPA

SEQ ID NO: 638 - protein, 1177 aa, Methylococcus capsulatus
MSEDLTSPPAMRQRFLRSLGSICLIVILAEVIVMTLLGALHRGGLELVRWQESALDGLLLGLFSAPLLWIMALRPLAQQIARESQRNKELLDALDAHALVSITDLQGRILYANDNFCAVSRYGREELVGQDHRIVNSGYHGKAYIRDMWRTISRGNIWQGEFCNRRKDGTRYWVDSTIVPLMDNAGKPRQYISIRRDITAQKEAEAQLARLKQAMDANSEMILLTDRAGRIIYANPALCRFSGMAEGELLGQSPSILDSPLADQETLAAMQEALQAGQPWSGRLLNRRRTGPAPHDAEDYWAEISTTPIHTDGNGLVGYVQIQHDVSARVERERALAMEQEDTAARLRITETLQQSAPLDERCRQVLRILFELGTFGLQRKGGIFLKAEHGNCLKLFVLEGKFCDEFVRREQTIPMGACLCGRSAVSGEILVSDDCFQDHRHEHRFEDMESHGHYIVPIASGGDLLGVLFLYTDPNPTRSEARMVMLRQVGEMLALAILEDRAKASLKAAHDAAVDAAQAKSAFLANMSHEIRTPMNGVLGMLELLKDTDMSREQWDLVETASNSAESLLEIINSILDFSKLEAGKVEIERTEFNLPDLVEEVCALLAGRAHDKGLELNCFLPADLPRMWIGDPTRIRQILTNLLGNSVKFTERGEVSVKVMQGEAGAKRTDLSFEIRDTGIGIAPDVQARLFQPFTQADGSTSRRFGGTGLGLSICRNLVELMGGTIGLESAPGRGSRFWFTLPLEPLPGASAPALPDFSHRRVLVVDDNATNRVILSHYLTHWGLEVDEAERGDTALNRLRTALHESRPYDIVLLDLHMPYMDGHELARAMNAEPGLKDTPRLLLSSGGLTGEAELRALGIARSLLKPVRQSLLFNAIAEVLAAKATVQRRPAAKTETVLPAYEGRRVLVVEDNRVNQKVIVAMLGKFGIVPDVADNGQAALELLARSSYDLVLMDCQMPVLGGYEATGELRAREMSAGGRRTPVVALTAHAATGEREKCLAAGMDDYLSKPISRDRLAEALERWLGHPAAPASAETGQGAVNDDGGDRPAGLSWNREETLARLDHDEALLAEMIALCIEELPRHLAALQEAGAANDIAALADAAHAIKGMAGHFCAGSVRDLAARLEDQARKAGSMPDAASIGALETAAARLLEDLHGGSPAGDPAKGTNDAAQ

SEQ ID NO: 639 - protein, 546 aa, Brucella melitensis
MAAKDVKFGRTAREKMLRGVDILADAVKVTLGPKGRNVVIEKSFGAPRITKDGVSVAKEVELEDKFENMGAQMLREVASKTNDTAGDGTTTATVLGQAIVQEGAKAVAAGMNPMDLKRGIDLAVNEVVAELLKKAKKINTSEEVAQVGTISANAEAEIGKMIAEAMQKVGNEGVITVEEAKTAETELEVVEGMQFDRGYLSPYFVTNPEKMVADLEDAYILLHEKKLSNLQALLPVLEAVVQTSKPLLIIAEDVEGEALATLVVNKLRGGLKIAAVKAPGFGDRRKAMLEDIAILTGGQVISEDLGIKLESVTLDMLGRAKKVSISKENTTIVDGAGQKAEIDARVGQIKQQIEETTSDYDREKLQERLAKLAGGVAVIRVGGATEVEVKEKKDRVDDALNATRAAVEEGIVAGGGTALLRASTKITAKGVNADQEAGINIVRRAIQAPARQITTNAGEEASVIVGKILENTSETFGYNTANGEYGDLISLGIVDPVKVVRTALQNAASVAGLLITTEAMIAELPKKDAAPAGMPGGMGGMGGMDF

SEQ ID NO: 640 - protein, 154 aa, Streptococcus thermophilus
MLNKIQQRNSDTYSVTPFNFFEDFRRNLFNDFFEDFSHNLFNDFKPNLIKTDIHETDNEYFVEAELPGIPKEDIQINYENGVLTISGQRQIDAATEDKKGKLIRNERSLTSVRRQYLLENVKEDEIKASYSDGILKVTLPKDSNKEIKTSIPIE

SEQ ID NO: 641 - protein, 282 aa, Zea mays
IDPAIVVAVLASDRRATTTTSRSLACAREPGSRRELAIGRRSMGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 642 - protein, 323 aa, Arabidopsis thaliana
MQTISKASSATSFFRCSRLSSQPCVRQLNIRKSLVCRVMKLVSSPLRTLRGAGKSIRVSKFCSVSNVSSLQIELVPCLKDNYAYILHDEDTGTVGVVDPSEAEPIIDSLKRSGRNLTYILNTHHHYDHTGGNLELKDRYGAKVIGSAMDKDRIPGIDMALKDGDKWMFAGHEVHVMDTPGHTKGHISLYFPGSRAIFTGDTMFSLSCGKLFEGTPKQMLASLQKITSLPDDTSIYCGHEYTLSNSKFALSLEPNNEVLQSYAAHVAELRSKKLPTIPTTVKMEKACNPFLRSSNTDIRRALRIPEAADEAEALGIIRKAKDDF

SEQ ID NO: 643 - protein, 361 aa, Escherichia coli
DLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 644 - protein, 547 aa, Pseudomonas aeruginosa
MAAKEVKFGDSARKKMLVGVNVLADAVKATLGPKGRNVVLDKSFGAPTITKDGVSVAKEIELKDKFENMGAQLVKDVASKANDAAGDGTTTATVLAQAIVNEGLKAVAAGMNPMDLKRGIDKATVAIVAQLKELAKPCADTKAIAQVGTISANSDESIGQIIAEAMEKVGKEGVITVEEGSGLENELSVVEGMQFDRGYLSPYFVNKPDTMAAELDSPLLLLVDKKISNIREMLPVLEAVAKAGRPLLIVAEDVEGEALATLVVNNMRGIVKVAAVKAPGFGDRRKAMLQDIAILTGGTVISEEVGLSLEGATLEHLGNAKRVVINKENTTIIDGAGVQADIEARVLQIRKQIEETTSDYDREKLQERLGKLAGGVAVIKVGAATEVEMKEKKARVEDALHATRAAVEEGVVPGGGVALVRALQAIEGLKGDNEEQNVGIALLRRAVESPLRQIVANAGDEPSVVVDKVKQGSGNYGFNAATGVYGDMIEMGILDPAKVTRSALQAAASIGGLMITTEAMVAEIVEDKPAMGGMPDMGGMGGMGGMM

SEQ ID NO: 645 - protein, 702 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTGYVKSAFGGAKGEEHHKGCNSGEIWLDCKPSTFGTV

SEQ ID NO: 646 - protein, 324 aa, Gibberella zeae
MVNVPNIKLNSGFDMPQIGFGLWKVDDNCAEVVYNAIKAGYRLLDGACDYGNEKACGEGVARAIKEGIVKREDLFIVSKLWQTYHDKKNVEPITRRQLADWQIDYFDLFLIHFPVALEYVDPEVRYPPGWHYDDAGTEIRWSKATNQETWEGMEDLVEKGLAKSIGISNFQAQGIYDMLKYAKIRPATLQVELHPYHQQSELVSLAKAEGIALTAYSSFGPTGFIELDMDIAKSASPLMQHEVFTTLASKYNKTSAQVLLRWATQQGLAVIPKSTTPQYMAQNFDCFEWSIDEEDMKRISKMNLNLKFNKPTNYFPTEKLWIFG

SEQ ID NO: 647 - protein, 695 aa, Alkalilimnicola ehrlichei
MRVYDPHAEAVAFEDGTKLPRRPGSDFFEGPLPAGLSAPYRLRRTSQDGAAHTAHDPYAFGPALPDYDLHLFGEGRHYHAQRFLGAHPLEHEGVPGVRFAVWAPNAERVSVVGDFNRWDGRCHPMRVRGGSGVWELFIPGLPDGSLYKFELRNRDSGAVLVKTDPYGRRYQLRPDSAAVVEPPADYAWNDREWMAARREDQWQSIPISIYEVHLGSWQRAGDGSFLDYRTLAHRLVDHVLATGFTHIELLPITEHPFDGSWGYQTTGYFAPTTRFGAPDDFRYFVDHCHRHGIGVILDWVPAHFPRDDWALANFDGTPLYEHADPRRGEHRDWGTLIFNFGRNEVRNFLTASALYWLEEFHIDGLRVDAVASMLYLDYSRDEGDWVPNIHGGNENLEAIDFLQELNRITHGEQPGTMIMAEESTSWPQVTRPTWLGGLGFTMKWNMGWMHDTLTYMGEDPIHRRYHHDQLTFGMLYAFTENFVLPFSHDEVVHGKRSLLWRMPGDEWQRFANLRLLYAYQFTYPGKKLLFMGCEFGQGNEWNAEAALDWYVLDYPLHQGVLRLVGDLNALYREVPALHRHDFDEHGFAWIDCHDTEQSAISYLRRDGGHDGEATPPAATVLNFTPVPRHDYRLGVPAPGYWRERLNTDSTHYGGTNLGNGGGVWAEAVPWMGHPWSVVLTLPPLAGVVLSPEAGP

SEQ ID NO: 648 - protein, 554 aa, Unknown
  Vibrio sp. Ex25
MCSVFGILDIKSDAAALRPIALEMSKKLRHRGPDWSGIYSSERAILAHERLAIVGLNSGAQPLYSPDKKLILAVNGEIYNHKEIRARYEGKYEFQTDSDCEVILALYQDMGADLLEELNGIFAFVLYDEEKDEYLVGRDHIGIIPLYQGHDEHGNYYVASEMKALVPVCKTVSEFPPGSYYSSKDAEPTRYYVRDWNEYAAVQGNTTSKEELTEALEAAVKRQLMTDVPYGVLLSGGLDSSITSAVAKRFAAMRIEDDEKSEAWWPQLHSFAVGLEGAPDLKAAREVADQIGTVHHEMTYTIQEGLDAIRDVIYHIETYDVTTIRASTPMFLMGRKIKAMGIKMVLSGEGADEIFGGYLYFHKAPNAKEFHEETVRKLLALNMFDCARANKSLAAWGVEGRVPFLDKEFIDVAMRLNPADKMCGNGKMEKHILRECFEHYLPESIAWRQKEQFSDGVGYSWIDTLKEVAEQKVTDQQMETAQYRFPYNTPTTKEGYVYREIFEELFPLPSAAECVPGGPSVACSSAKAIEWDESFQNCVDPSGRAVQTVHNDAY

SEQ ID NO: 649 - protein, 529 aa, Bacillus subtilis
MSDDQNKRVNEHSKDEQLEQYRTDNSGKKMTTNQGLRVSEDEHSLKAGVRGPTLMEDFHFREKMTHFDHERIPERVVHARGFGVHGFFQVYEPMTEYTRAKFLQDPSVKTPVFVRFSTVAGSKGSADTVRDARGFATKFYTEEGNYDLVGNNIPVFFIQDAIKFPDLVHAFKPEPHNEMPQAATAHDTFWDFVANNPESAHMVMWTMSDRGIPRSYRMMEGFGVHTFRFVNEQGKARFVKFHWKPVLGVHSLVWDEAQKIAGKDPDFHRRDLWETIENGGKVEYELGVQMIDEEDEFKFDFDILDPTKLWPEELVPVKIIGKMTLNRNQDNVFAETEQVAFHPGNVVPGIDFTNDPLLQGRLFSYTDTQLIRLGGPNFHEIPINRPVCPFHNNQYDGYHRMTINKGPVAYHKNSLQNNDPSPATAEEGGYVHYQEKVEGKKIRQRSDSFNDYYSQAKLFWNSMSPVEKQHIISAFCFEVGKVKSKDVQRQVVDVFSNVDADLAEEIAKGVGVAAPRSVKHLKKFLLRLR

SEQ ID NO: 650 - protein, 1101 aa, Arabidopsis thaliana
MASSSADNLTDKNIVFRKLKSKSENKVCFDCSAKNPTWASVTYGIFLCIDCSATHRNLGVHISFVRSTNLDSWSPEQLRTMMFGGNNRAQVFFKQHGWTDGGKIEAKYTSRAADLYRQILAKEVAKAIAEETNSGLLSSPVATSQLPEVSNGVSSYSVKEELPLSKHEATSATSSPKASNTVVPSTFKKPIGAKRTGKTGGLGARKLTTKPKDNLYEQKPEEVAPVIPAVSSTNNGESKSSAGSSFASRFEYNDDLQSGGQSVGGTQVLNHVAPPKSSSFFSDFGMDSSFPKKSSSNSSKSQVEESDEARKKFTNAKSISSAQYFGDQNKNADLESKATLQKFAGSASISSADFYGHDQDDSNIDITASDLINRLSFQAQQDLSSLVNIAGETKKKLGTLASGIFSDIQDRMLNRTLTTMLMAKPDVPSSILPRSSSILPNSIETLDENESIEAQVNNVQSLALSSPNRDRSDDDDNNNNHDSVSIPPPIYDGYSSSSSDESQSVPSPPINLDHDDDECQIPIRNTSQALDDIDDDIWGDDDLPETRRPWTPNVSPGFGSDDDDDNDDDNSKNEPRKSLFYGFRQEPEPVTGVGAGLWNLGNSCFLNSVFQCFTHTVPLIESLLSFRYEVPCHCGNEFFCVIRAIRYHIEAALRPERYFSPDFQRYQQEDAHEFLQAFLEKLEICGSDRTSFRGDITSQDVFSGRLISGLRCCNCDYVSETYEKSVGLSLEIEDVDTLGSALESFTRVEKLDEQLTCDNCNEKVSKEKQLLLDKLPLVATFHLKRFKNNGLYMEKIYKHVKIPLEIDLQPYMRNIQENEVSTKYHLYALVEHFGYSVAYGHYSSYVRSAPKIWHHFDDSKVTRIDEDMVLSQDSYILFYAREGTRWFSSVYEEMQPLVEASLLNSSPKSVLDSSTNGECLSEISYENGDKASKPCDSAGVCNQHVKTKEDFVSLSNDDVFLSAESSSGEESPMGELLDPLDPDDSYSPCTEKESDSCLAIERATIRDDFFPLLLDQNQESSTSSPKLQERTFEMQLLQMEETTKSQEPWKQPLSSISNIADSMEAEFVYGDLMKKPSPRARELLDQAISTNGSPPKKLKTT

SEQ ID NO: 651 - protein, 372 aa, Xanthomonas campestris
MSAVDAALSQLFSPITFGPLALANRIVIAPMCQYSAQDGRASDWHRIHLGTLSQSGAGLLILEAAAVVPEGRISYADLGLYDDATEQALAEVLQSVRRWSPMPIGIQLAHAGRKASTDLPWKGGEAIAPDHAHGWQTVSASALPFRQGQPVPQALDEAGIDAVVDAFVASAKRAERLGLELIELHAAHGYLMHQFLSPLSNQRSDAYGGSLENRMRLTLRIFDAVRAAVSEKIAVGVRISATDWVQGGWDVQQSIALSQALDARGAHYIHVSSGGLDPRQQIPLQAGYQIPFAQEIRAQVNTPVIGVGLITEPAQAEAILQEGQADAIALARGILYDPRWPWHAAAALGASVTPAPQYLRCEPRDARGVFAN

SEQ ID NO: 652 - protein, 439 aa, Musa acuminata
MVNCAESCVPLSEVATSNTHGEDSPYFAGWKAYDEDPYDAASNPAGVIQMGLAENQVSFDLLEKYLDQHPGASGWGCGISGFRENALFQDYHGLQTFRQAIATFMEQIREGRAKFDPERIVLTAATAANELLTFILADPGDCLLIPTPYYPGFDRDLRWRTGVRIIPVHCSSSNGFQVTLQALEDAYVKAEGMKIRVRGLLLTNPSNPLGTAIARHVLEEVLDFVTQKDIHLISDEIYSGSVFSSDEFVSVAEIVEARGYKDCGRVHIVYSLSKDLGLPGFRVGAIYSYNDRMVTAARRMSSFTLVSSQTQRMLASMLADRGFTENYLKTNRERLKNRRDFITEGLKNAGIECLPGNAGLFCWMNLAPLLEEPTREGELRLWSLIVHEAKLNISPGSSCHCSEAGWFRVCFANMSQQTLEVALRRIKDFMKNMKAKQEK

SEQ ID NO: 653 - protein, 545 aa, Eutrema wasabi
MKLHGLALVFLLAVATCKAVEDITCQEKEPFTCSNTDSLNSKSFGKDFIFGVASSAYQIEGGRGRGPNTWDAFTHRYPEKGGPDLANGDTTCESYTNWQKDIDIMDELNATGYRFSFAWSRIIPKGKVSRGVNQGGLDYYHQLIDGLIAKKITPFVTLYHWDLPQTLQDEYEGFLNRTIIDDFRDYADLCFKEFGGKVKHWITINQLYTVPTRGYGIATDAPGRCSPAIDKRCYGGNSSTEPYIVAHNQLLAHAAVVNLYRTKYKFQGGKIGTVMITRWFLPFDENDKDCIDATERMKEFFFGWFMEPLTKGRYPDIMRKIVGSKLPNFTEAEARQVAGSYDFLGLNYYVTQYAQPTKTIVPPENHTAMMDANVTLTYVNSRGELIGPLFAKDDDPKKNSYYYPKGIYFVMDHFRTRYFNPLIYVTENGISSPGTEPREVAIADSKRIDYLCSHLCFLRKVIKETGVNVKGYFAWSLGDNYEFCKGFTVRFGLSYVNWTDVTDRNLKDSGKWYQRFINVTTNNPPAKQDFLRSSLSFHNKNLADA

SEQ ID NO: 654 - protein, 319 aa, Aspergillus niger
MASPTVKLNSGYDMPLVGFGLWKVNNDTCADQIYHAIKEGYRLFDGACDYGNEVEAGQGIARAIKDGLVKREELFIVSKLWNSFHDGDRVEPICRKQLADWGIDYFDLYIVHFPISLKYVDPAVRYPPGWKSEKDELEFGNATIQETWTAMESLVDKKLARSIGISNFSAQLVMDLLRYARIRPATLQIEHHPYLTQTRLVEYAQKEGLTVTAYSSFGPLSFLELSVQNAVDSPPLFEHQLVKSIAEKHGRTPAQVLLRWATQRGIAVIPKSNNPQRLKQNLDVTGWNLEEEEIKAISGLDRGLRFNDPLGYGLYAPIF

SEQ ID NO: 655 - protein, 1131 aa, Sorghum bicolor
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAENAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHIREAGMSTFILTAELAAAPSAVGQ

SEQ ID NO: 656 - protein, 642 aa, Unknown
  Azoarcus sp. EbN1
MCGIAGLFDLRGKRDFSRDLVRRMNDVQVHRGPDEGGYHFEPGIALAHRRLSIIDLSTGQQPLFNEDGSVAVVFNGEIYNFQELVPELEALGHAFHTRSDTEVIVHAWEAWGEDCVQRFRGMFAFALWDRNRETLFLARDRLAVKPLFYALLPDGTFAFGSELKVLMQHPLLDRRIDAHAVEEYFALGYVAEPRTIFAGAKKLGAAETLCVRRGQPVPQPRCYWDVHFMLDNPLSLAEASAELTARLRESVRLRMIAEVPLGAFLSGGVDSSAVVATMAGLSDEPVHTCSIAFDDPAFNESDFAQKVADRYRTNHYVETVKSDDFDLIDTLAGLYDEPYADSSAIPTWRVCQLARKRVTVALSGDGGDESFGGYRRYRLHLMEERMRGALPLGVRQPMFGLLGRLYPKADWAPRMFRAKTTFQALARDSLQAYFHSVSILRDAMRRQLFSNRFRSELAGYNAIEVFRRHAATAHTDDALALIQYVDLKTYLVGDINTKVDRASMAHSLEVREPLMDHKLVEWLATLPSGLKVKGQEGKYLFKKAMEPLLPNDVLYRPKMGFSVPLSRWFRGPLRERVRQTVLGETLAATGIFNPDYLRHLVDAHQSGARDYSSPLWSLMMFEAFVRSSGGCPARAPELAAAV

SEQ ID NO: 657 - protein, 1131 aa, Sorghum bicolor
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHIREAGMSTFILTAELAAAPSAVGQ

SEQ ID NO: 658 - protein, 207 aa, Moorella thermoacetica
MFLKTLVVGPLGANCYLIGCPETGEGAVIDPGAEGERILAAAREAGLNIKQIINTHGHGDHIGANGAIKAATGAAILIHRADAHYLTDPGRNLSVLLGSREASPPADRLLEEDDTIAIGKTVTLRVIHTPGHTPGGICLHGEGLVFTGDTLFAGSIGRTDFPGGSYSQLISSIKEKLFTLDDALEVYPGHGPASTIGAERVDNPFFT

SEQ ID NO: 659 - protein, 540 aa, Unknown
  Methylovorus sp. SS1
MAAKEVKFHDHARTRIVQGVNVLADAVKVTLAPRAVMCLIERSFGAPVITKDGVSVAKEIELQDKFENMGAQMVKQVASKTADIAGDGTTTATVLAQAIVQEGMKHVVAGVNPMDLKRGIDKAVATVVDELHKLSKPITTNKEIAQVGSISANSDHPIGKIIADAMDKVGKEGVITVEDGKSLDNELDVVEGMQFDRGYLSPYFINNPEKQTVEFDDPLILLYDKKISSIRDLLPTLENVAKAGKPLLIIAEDLEGEALATLVVNSMRGILKVAAVKAPGFGDRRKAMLEDIAILTGATVISEETGKQLEKASLEDLGRAKRVELQKENTIIIDGAGEQKAIEARVKAIQAQIDESTSDYDREKLQERVAKLSGGVAVIKVGAATEVEMKEKKDRVDDALHATRAAVEEGIVPGGGVALLRARSRIVNLKGDNGDQDAGIRIVLRAIEAPLRAIAANAGDEPSVVINKVLAGSGNFGYNAATGEYADLVETGVVDPTKVTRTALQNAASVASLILTTDASIAELPKEEKAAVPAMPDMGY

SEQ ID NO: 660 - protein, 767 aa, Xanthomonas campestris
MAARAGGLRGWSTLVALAALVAASAAALQWLGVAGPWRIVTTAASVLALVCGICTAVAAYRASRTLSALTRQLDDTNTAQARMQQELQRHGELEQELLRAKQAAEAASLAKGEFLATMSHEIRTPLNGIIPMLELISRGQLSLDQRDMLQTATGSSLQLLRIVDDILDYSKLEANKLELEITTFNLRELLDGVAQLMQRTAEGKQLRLGLDIEPSVRLLVRGDPIRLRQVLGNLIGNAIKFTERGSVDIQLRRLGETRAQHLLRFQVRDTGIGIAADQQARLFRSFAQADASTTRLYGGTGLGLAICKRIIDLMGGRIGVESEPGRGATFWFEIPLLKVIGDLQQTTGADAARVMVISSDARLSQRLKRLLDSWGISHVLMETTQEALERVRRHTDDEGFRCVIADHETLRYSARAVHRALARPEDLSGSRLIWLYGDEPVPDELQANATLVPRQSPDETLRALVLPPEPKPSVAPTLASAMIPEPLPPPVAHARDVRILLVEDNPVNLLVAQKLLGVLGFEADTATDGEAALSSMESTRYDMVFMDCQMPVLDGYAATRRWRAMETESGGRPIPIVAMTANAMAGDRERCLAAGMDDYLSKPVAREQLNACLQRWLPRQALLPGPSTGAPSADAESAASAAQARALPILESGVIDELYEVAGADTIRILQLFLEDAPGIIEGLEAAASNRDSMHLRDLAHTLKSSSANVGAQALANAARRIELAARTGTIERPSVMVALVIAEYARARLALLGQVTRLQAASRAAG

SEQ ID NO: 661 - protein, 312 aa, Saccharomyces cerevisiae
MPATLHDSTKILSLNTGAQIPQIGLGTWQSKENDAYKAVLTALKDGYRHIDTAAIYRNEDQVGQAIKDSGVPREEIFVTTKLWCTQHHEPEVALDQSLKRLGLDYVDLYLMHWPARLDPAYIKNEDILSVPTKKDGSRAVDITNWNFIKTWELMQELPKTGKTKAVGVSNFSINNLKDLLASQGNKLTPAANQVEIHPLLPQDELINFCKSKGIVVEAYSPLGSTDAPLLKEPVILEIAKKNNVQPGHVVISWHVQRGYVVLPKSVNPDRIKTNRKIFTLSTEDFEAINNISKEKGEKRVVHPNWSPFEVFK

SEQ ID NO: 662 - protein, 478 aa, Ashbya gossypii
MEQVDLPNANKIAAGANKASVRVVNGLGALMGSKAMAAVDFEKDSMAEMLARDQREKEHYRHHKHISEQPWTLNNWHLHVNWVNIVLVVVVPIIGLYLALSGRVPPRFEVLALAIVYYSLGGLGITAGYHRLWAHRSYSARWPLRVMYALFGASSVEGSIKWWGHSHRIHHRYTDTPRDPYDARRGLWYSHMGWMLLQPNPRYRARADIEDLMNDWVVRLQHRHYVLIMAFMAFLLPAIICHFIFRDFWGGLVYAGILRVFAIQQATFCINSLAHYLGDQPFDDRRTPRDNWITALVTLGEGYHNFHHEFPTDYRNAIRWYQYDPTKVFIYCASLVGLAYDLKKFSQNAIQQGLIQQKQKKLDNARSRLNWGTPLSQLPVWDRSEFVRASRENSGLVVISGIVHDVSGYITEHPGGETLIQAALGKDATRAFNGGVYMHSNAAHNILATMRVAVVKEGQDAATRFAARRGEALEKKTA

SEQ ID NO: 663 - protein, 352 aa, Glycine max
MEKYELVKDIGSGNFGVARLMRHKDTKELVAMKYIERGHKIDENVAREIINHRSLRHPNIIRFKEVVLTPTHLGIVMEYAAGGELFERICSAGRFSEDEARYFFQQLISGVSYCHSMQICHRDLKLENTLLDGSPAPRLKICDFGYSKSSLLHSRPKSTVGTPAYIAPEVLSRREYDGKLADVWSCGVTLYVMLVGAYPFEDQEDPKNFRKTINRIMAVQYKIPDYVHISQDCRHLLSRIFVANPARRITIKEIKSHPWFVKNLPRELTEVAQAAYYRKENPTFSLQSIEDIMNIVEEAKAPPPASRSIGGFGWGGEEEEEDETKEAVAETEEDEYEKRVKEAQASGEFHVS

SEQ ID NO: 664 - protein, 630 aa, Unknown
  Magnetococcus sp. MC-1
MCGLSAILDLTGQRLPEAEQLTAMTRALAHRGPDGEGMHREPGVGLGHRRLSIIDLAGGAQPLWNEDRSVAVVFNGEIYNFPDLMQRLQGLGHQFHSRSDTEVIVHAWEQWGEQCVEALQGMFAFALWDRCQGVLFVARDRLGIKPLYYGFSEDGWLLVGSELKALTAHPGLSRSLDPKGVMDYFAYGYIPDPHSIYRQVKKLEPGYCARFTLGSGDWRLRCYWDLSFAAQPLTEAAALQQLQELLGQTVQSHTLADVPLGAFLSGGVDSSLITALLAKQSQTPLQALTVAFTGSREDEAPHARAVAQHLGVQQQLLTVDPLDFERLERLPGLYDEPFADSSAWPTFLLCEAAASRMKVVLSGDGGDELCAGYSRYRLFMAEQQVRQRVPSWLRRGLFGPMGMLYPKLDNAPRWLRAKSTLQALGEGPLEGLFRGASMMDPAMGQGLLAPDLMLLDYHPIEHFYRLNARLPEQVAFHDRMLYLDFKTFLAGRVLTKVDRASMAVGLEVRVPLLDHRLVEWAGRLPWCLKMQGGQGKYLLKKLAAQQVPATAVYRSKQGFIPPLAAWLRGPLQERLQDRLSSRVITESGLFHPRWIHWMLEQHRKKKQDLSMPLWSLLMFEGMLRKAQNKG

SEQ ID NO: 665 - protein, 716 aa, Gibberella zeae
MVSSKLLVVLGLASLTAAQCPYADPAKLAARDEGSSREHLKDYEVDDSKGHMSSDAGGPFEEQESLKAGERGPTLLEDFIFRQKITHFDHERVPERAVHARGAGAHGYFKSYSDWSNITAASFLSSKDKNTPVFVRFSTVAGSRGSADTVRDVHGFATRFYTDAGLFDIVGNNIPVFFIQDAIQFPDLIHAVKPSPDSEIPQAATAHDSAWDFFSQQTTTLHTLFWAMAGYGIPRSFRHVDGFGVHTFRLVTDEGDTKFVKWHWKSKQGKASLVWDEAQHLAGKNADYHRADLWNAIESGNGPEWELNAQIFDEDQALAFGFDVLDATKIIPEELAPLQPIGVMKLDTNPVNYFAETEQVMFQPGHIVRGIDFTEDPLLQGRIFSYLDTQLNRHGGPNFEQLPINRPLSPIHNNNRDGAGQNFIHKNTAASDSLDTPNTLNKGYPVQANQTQGKGFFTAPGRKVSGNLVRARASTFSDHWSQPRLFYNSLTKVEQQFLINAIRFETSQLMSETVQKNVLYQLNKISHDIAVRVGRALGLKAPEADDKYYHDNTTAGISIFGTKLPSIATLSVGVLVSINSNNSIQQAKALKKALGEDKVTVSIIGEVLGDDVEVTYSAATAAQFDSVVVTSGTESLFNGTGKSTLFPPGRPTQIIVDGYHWGKPVGFIGGAKAAAQAARVSKGKGVYFPKNVNSLVEDLKDGLATFKFTDRFPLDH

SEQ ID NO: 666 - protein, 408 aa, Arabidopsis thaliana
MGSLRRSTSNRSRKKGTAVKMNRMPSSLLPPTPPCSAIVGGTGKSKKRRGGVCLWTRFDRTGFMEVAGCDKSTIIERSSVSAKDLRTAFSHSSKILAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLD

SEQ ID NO: 667 - protein, 276 aa, Arabidopsis thaliana
MKGEYREQKSNEMFSKLPHHQQQQQQQQQQHSLTSHFHLSSTVTPTVDDSSIEVVRRPRGRPPGSKNKPKPPVFVTRDTDPPMSPYILEVPSGNDVVEAINRFCRRKSIGVCVLSGSGSVANVTLRQPSPAALGSTITFHGKFDLLSVSATFLPPPPRTSLSPPVSNFFTVSLAGPQGQIIGGFVAGPLISAGTVYVIAASFNNPSYHRLPAEEEQKHSAGTGEREGQSPPVSGGGEESGQMAGSGGESCGVSMYSCHMGGSDVIWAPTARAPPPY

SEQ ID NO: 668 - protein, 642 aa, Unknown
  Azoarcus sp. EbN1
MCGIHGIYRFDAAPVSPAQLSAMGDVTRHRGPDDEGRYIDADGRCGIAMRRLSIIDLAGGHQPISNADDTLWGVCNGEIYNFRELRAELQERGYRFKTGSDSEVLVHLYDAFGDDFVHRLDGMFNFALWDARRKRLLIGRDPLGVKPLYVHRSASMLAFATEAKALLELPGVTRELDHDVVADYLHLGYVAAPHSMFRDIRKLPPATLLSVENGEVRQWRYWRLPSSVARYVTEAEWIGRIRDGMERAVHRQMVSDVPIGAFLSGGVDSSAVVAFMAKHSAHPIRTYAIGFEGGEAEQLYNELPYARQVAQLIGTEHHEIVVTPDVVGLLPKLLWHMDEPVSDSAFITTFLVSEFARRDVKVILSGVGGDELFGGYRRYLGGHYVRKLQRLPRWSRQLMSRTAAMLPSDRHSKVLNTMRLARGFLASAELSPDERYRHYLQVLDRASIAELMNGRTGTTDALRDAFAAAGDEDALNRMFAVDAETQLPDDLLLLTDKMSMAVSLECRVPLLDRELVELAAAIPEALKVRDGRLKHLMKEALADVLPASILDRKKRGFGTPMGAWLKRDLAPVLRRLLSADVVRDRALFEPKVIARLMADHDANRIDGTDALLALMNLEIWSRIFLDRRSPDDVTTELKAYLP

SEQ ID NO: 669 - protein, 1131 aa, Sorghum bicolor
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAENAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHLREAGMSTFILTAELAAAPSAVGQ

SEQ ID NO: 670 - protein, 243 aa, Glycine max
MAFPDPSMSASPQRKMGRGKIEIKRIENTTNRQVTFCKRRNGLLKKAYELSVLCDAEVALIVFSSRGRLYEYANNSVKATIERYKKASSDSSGAGSASEANAQFYQQEADKLRQQISNLQNNNRQMMGDSLGSLTAKDLKNLETKLEKGISRIRSKKNELLFAEIEYMQKREIDLHNNNQLLRAKIAESERNHHNMAVLPGGSNYDSMQSSQQQFDSRGYFQVTGLQPNNQYARQDQMSLQLV

SEQ ID NO: 671 - protein, 1131 aa, Sorghum bicolor
MSSSRPAHSSSSSSRTRQSSRARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHLREAGMSTFILTAELAAAPSAVGQ

SEQ ID NO: 672 - protein, 478 aa, Enterococcus faecalis
MKNQHLTTSQGSPVGDNQNSLTAGEFGPVLIQDVHLLEKLAHFNRERVPERVVHAKGAGAHGIFKVSQSMAQYTKADFLSEVGKETPLFARFSTVAGELGSSDTLRDPRGFALKFYTDEGNYDLVGNNTPIFFIRDAIKFPDFIHSQKRNPRTHLKSPEAVWDFWSHSPESLHQVTILMSDRGIPLSFRHMHGFGSHTFKWVNAAGEVFFVKYHFKTNQGIKNLESQLAEEIAGKNPDFHIEDLHNAIENQEFPSWTLSVQIIPYADALTMKETLFDVTKTVSQKEYPLIEVGTMTLNRNPENYFAEVEQVTFSPGNFVPGIEASPDKLLQGRLFAYGDAHRHRVGANSHQLPINQAKAPVNNYQKDGNMRFNNGNSEINYEPNSYTETPKEDPTAKISSFEVEGNVGNYSYNQDHFTQANALYNLLPSEEKENLINNIAASLGQVKNQEIIARQIDLFTRVNPEYGARVAQAIKQQA

SEQ ID NO: 673 - protein, 477 aa, Enterococcus faecalis
MKRVIWFRRDLRLQDNKALAHALQNSAADELILLFQMNPQQFIQESANHNAFFASLASFKERIDQEAHLQIMVGEPLDLFSRLKRKLPDWQAIYFNEDTCGFGAKRDQQAMRFFEENNIQSFSFQDAYLHGSEEIKKNDGSKYQVFTPYYNKWKEAPKETPIPVSYTAEKIFSACLFPEEEAAYREQIARIPLTHYSVGEETARRRLNTFIDQKLQSYENKRDFPYQDQTSHLSTFLRTGELSIRTIWQELASVPSSLSKETFKKELAWRDFYNMIYSAFPQQKEEAIQEKFRYIQWTNDPEMFVKWQKGETGYPIIDAAMRQLNQTGWMHNRLRMITASFLVKNLHIDWRWGEKYFQKMLIDYDAANNIGGWQWAASTGTDAVPYFRIFNPIIQSKKFDNDGQFIKKYVPELKQVPQKYIHQPNLMNEALQTQYHVHLGENYPKPIVDYASSKKQTLFLYEASKEIHQEMNNPRFQ

SEQ ID NO: 674 - protein, 478 aa, Helicobacter hepaticus
MSKKFTTATGTPLGDNQNSITAGKKGPTLLQDTWLLEKLAHFDRERIPERVVHAKGSAAYGELTITNDITQYTKAELFNKVGKKTKAFLRFSVVAGERGAADAERDVRGFALKLYTNEGNWDIVGNNTPVFFIKDAIKFPDFIHTQKRDPKTNMKSPTAMWDFWSLHPESLHQVTILMSDRGIPRSYREMHGFGSHTYSFINAKNERFWVKFHFVCLQGIHNLTNKESEAVIAKDRESHQKDLFENIEKGNFPKWRFCIQVMSEKEAENYRFNPFDLTKVWSHKDYPLIEVGILELNKNPENYFAEVEQAAFNPANIVPGVGYSPDKVLQGRLFSYGDTQRYRLGINHTQLPVNAPIVPVNNTHRDGFMQQGQFGDRRNYEPSYFNDYVEDKNALEPPLFVQEGDVMYKYDHREYEDDYFVQAGDLYRLMTAEQKEALCQNIKESMEGVPDEIKKRQLEHFKKADKAYGKRVAELLGL

SEQ ID NO: 675 - protein, 285 aa, Andrographis paniculata
ISNLTCADFLRAPGVQTPVIVRFSTVIHERGSPETLRDPRGFAVKFYTREGNFDLVGNNFPVFFIRDGIKFPDMVHSLKPNPKSHIQENWRILDFFSHHPESLHMFTFLFDDIGIPQDYRHMDGSGVNTYTLINTAGKVHYVKFHWRPTCGVKSLLEEEAIRVGGANHSHATQDLYDSIAAGNYPEWKLFIQTIDPVHEDRFDFDPLDVTKTWPEDILPLQPVGRMVLNKNIDNFFAENEQLAFCPGIIVPGIYYSDDKLLQTRVFSYSDTQRHRLGPNYLLLPA

SEQ ID NO: 676 - protein, 326 aa, Glycine max
MLSKPSSAMPTFPSSMVRSGLCVWPNVRQLCFRKGILYGFMRLFSTPLKTLRGASRSLRVAQFCSVANMSSSLQIELVPCLKDNYAYLLHDVDTGTVGVVDPSEAVPVIDALSRKNRNLTYILNTHHHHDHTGGNVELKARYGAKVIGSGTDKKRIPGIDIHLNDGDKWMFAGHEVRVMDTPGHTQGHISFYFPGSGAIFTGDTLFSLSCGKLFEGTPQQMLSSLKKIMSLPDNTNIYCGHEYTLNNTKFALSIEPENEELQSYAAQVAYLRSKGLPTIPTTLKMEKACNPFLRTSSAAIRQSLNIAATANDAEALGGIRQAKDNF

SEQ ID NO: 677 - protein, 830 aa, Arabidopsis thaliana
MSEPKVRRWVGKYEVGRLIGECNFGKLRSAVDTETGDPVALMILDKDKVLKHKMAEQIKREISIMKLINHPNVVQLYEVLASKAKIYIVLEFISGGKLFDKIKNDGRMNEDEAQRYFQQLINAVDYCHSRGVYHRDLKPENLLLDAQENLKVAEFGLIALSQQAGGDGLRHTACGNPDYPAPEVLNDQGYDGAKADLWSCGVILFVLLAGYLPFEDSSLTTLYKKISSADFSCPPWLSSGVKNLIVRILDPNPMTRITIPEILEDVWFKKDYKPAVFEEKKEANLADVEAVFKDSEEGRVQLRSFPCVICSGGTTCGDVRSRTKLMNGLIERGRPQEAHSIFNTLIEEGHKPSLITYTTLVTALTRQKHFHSLLSLISKVEKNGLKPDTILFNAIINASSESGNLDQAMKIFEKMKESGCKPTASTFNTLIKGYGKIGKLEESSRLLDMMLRDEMLQPNDRTCNILVQAWCNQRKIEEAWNIVYKMQSYGVKPDVVTFNTLAKAYARIGSTLFCFFLQKKKKNNKVKPNVRTCGTIVNGYCEEGKMEEALRFFYRMKELGVHPNLFVFNSLIKGFLNINDMDGVGEVVDLMEEFGVKPDVVTFSTLMNAWSSVGDMKRCEEIYTDMLEGGIDPDIHAFSILAKGYARAGEPEKAEQILNQMRKFGVRPNVVIYTQIISGWCSAGEMKKAMQVYKKMCGIVGLSPNLTTYETLIWGFGEAKQPWKAEELLKDMEGKNVVPTRKTMQLIADGWKSIGVSNSNDANTLGSSFSTSSKLNIPNNIASSRSPLFLKGMPEKPKLCIKSQFGLRQTLLVVLCRDQIGEAGRFCKFM

SEQ ID NO: 678 - protein, 378 aa, Vibrio vulnificus
MRSILQQQKPPFIWLNIVIFVTSLILALVVTPWYGIKEGFGFEHLIWLLVTFSFTNLSITAGYHRLWSHKTYEAHPLLRVVFAIGGAFSLQNSALHWSSDHRMHHKFVDHHDKDPYSASRGFWFSHIGWMLRDYNQSTYNDYTNCRDLRKDPVIMWQHKYYVPLAIATNLGIPLLLGWYYQDIIGMLLVVGALRLTLSHHSTFFINSLAHIWGKQTFTDKNSARDNGFLAVLTFGEGYHNFHHIFENDYRNGIYWWQYDPTKWLIKSCSWLGLTRNLRLTPQMKIDKARAATRLKNALNQLAQRGEQESLKQQLQLEFDGLVATMKDYYDAKKQLLECKKQTALKKYEVALVKIRYQQAKEDLLSRYKRWHALTAHYA

SEQ ID NO: 679 - protein, 546 aa, Unknown
  Burkholderia sp. 383
MAAKDVVFGDSARSKMVEGVNILANAVKVTLGPKGRNVVLERSFGGPTVTKDGVSVAKEIELKDKLQNMGAQMVKEVASKTSDNAGDGTTTATVLAQSIVREGMKYVASGMNPMDLKRGIDKAVAAAVEELKKISKPCTTNKEIAQVGSISANSDTSIGDRIAEAMDKVGKEGVITVEDGKSLADELDVVEGMQFDRGYLSPYFINNPEKQVAVLDNPFVLLHDKKVSNIRDLLPVLEQVAKAGRPLLIIAEDIEGEALATLVVNNIRGILKTVAVKAPGFGDRRKAMLEDIAILTGGQVIAEETGLTLEKATLAELGQAKRIEVGKENTTIIDGAGEAVNIEARVKQVRAQIEEATSDYDREKLQERVAKLAGGVAVIKVGAATEVEMKEKKARVEDALHATRAAVEEGIVAGGGVALIRARTAIAALTGANADQNAGIKIVLRAMEEPLRQIVTNGGEEASVVVAAVAAGTGNYGYNAATGEYVDMVEAGVVDPTKVTRTALQNAASVAGLLLTTDAAVAELPKEDAPMPGGMPGGMGGMGMDM

SEQ ID NO: 680 - protein, 128 aa, Brassica napus
  misc_feature (116)..(116): Xaa can be any naturally occurring amino acid
MCDPTRDDGSSQSGLVRKENRAYFQREWNSFDVMRTLTVTIVHLLCLLAPFNYKWEALRFGLVLFAVVQLGITFSYHRNLSHRSFKLPKWLEYPFAYSAVFALQGDPMDWVSIHRXHHQFTDTDRDPH

SEQ ID NO: 681 - protein, 718 aa, Blumeria graminis
MRLSLWNLLGLSGLVVASCPYMSGEDQEYHISHIQARGTDSEFLDQFKVEDSNSYLTTDAGGPIQDDASLKAGERGPTLLEDFIFRQKIQHFDHERVPERAVHARGAGAYGTFTSYADWTNITAASFLNSKGKETPVFVRFSTVAGSRGSADTVRDVHGFATRFYTDEGNFDIVGNNIPVFFIQDAILFPDLVHAVKPSPDSEIPQAATGHDSAWDFFSQQPSTLHTLFWAMSGHGIPRSYRHMDGFGVHTMRLVTDDGKSKLVKWHWKTKQGKASLVWEEAQILAGKNPDFHRQDLWDDINAGNGPEWELGVQIVDEEDVQAFGFDLLDPTKFLPEELVPVTILGKMKLTDNPTNYFAETEQVMFQPGHIVRGVDFSDDPLLQGRIYSYLDTQLNRNGGPNFEQLPVNRPRTKVHNNNRDGAGQMFIHTNKAPYSPNSLSGGNPKQANQTKGRGFFTAPSRKVVGSLHRGTASSFADVWSQPRMFYNSLIPSEQQFLVNAIRFEISQLKSDLIKKNTLMQLNRVSNDLATRVAAVIGYKPLDPSPEFYTNATTDYVTIFGKPLPSVVGFTVGILASTSSSTSISQAAQLATSFSSRGIRAVIVGESLLSGTDQTYSSADATAFDAVVVTMGAETLFGPVAKPNTLFPSGRPSQILHDAYRWGKPVGAVSKASVVLEPLPGTKNQGGVYRVESVNELATSIAKGLETFRFVDRFPLDS

SEQ ID NO: 682 - protein, 455 aa, Arabidopsis thaliana
MSFTIPRLFLFTLFFCSVFFVCLLMAEDSNSSESIIVNVTGDDNKSALFGKYDLGKLLGSGAFAKVYQAEDLQNGGESVAIKVVQKKRLKDGLTAHVKREISVMRRLRHPHIVLLSEVLATKTKIYFVMELAKGGELFSRVTSNRFTESLSRKYFRQLISAVRYCHARGVFHRDLKPENLLLDENRDLKVSDFGLSAMKEQIHPDGMLHTLCGTPAYVAPELLLKKGYDGSKADIWSCGVVLFLLNAGYLPFRDPNIMGLYRKIHKAQYKLPDWTSSDLRKLLRRLLEPNPELRITVEEILKDPWFNHGVDPSEIIGIQADDYDLEENGKILNAFDLISSASSSNLSGLFGNFVTPDHCDQFVSDESTAVIMRKVEEVAKQLNLRIAKKKERAIKLEGPHGVANVVVKVRRLTNELVMVEMKNKQRDVGLVWADALRQKLRRLINQPVYKVPDKP

SEQ ID NO: 683 - protein, 214 aa, Arabidopsis thaliana
MYDFMAVDRPSTPLIDRGIALHKMIRLITMGLGGEGYLNFMGNEFGHPEWIDFPRGEQRLSDGSVIPGNNFSYDKCRRRFDLGDADYLRYRGLQEFDQAMQHLEENYGFMTSEHQFISRKDEADRVIVFERGDLVFVFNFHWTSSYFDYRIGCSKPGKYKIVLDSDDPLFGGFNRLDRKAEYFTYDGLYDERPCSFMVYAPCRTAVVYALANHD

SEQ ID NO: 684 - protein, 246 aa, Oryza sativa
  misc_feature (137)..(137): Xaa can be any naturally occurring amino acid
MIRPRRPGSKSGVFQCILELTRIIRIPPLNAAHSPYKSGLPSRSAAQTKIESNSQIAIPCAHIPSFPSTHCFSVHKHSLPSRPNPSTMSLIRRGNAFDPFSLDLWDPVDGFPFGSGGSSSSSGSLFPRANSDAAAFXGARIDWKETPEVHVFKADVPGLKKEEVKVEVDDGNILQISGERSREQEEKSDKWHRVERSSGKFLRRFRLPENTKPEQIKASMENGVLTVTVPKEEPKKPDVKSIQISG

SEQ ID NO: 685 - protein, 158 aa, Xanthomonas campestris
MNIVRYPQWPTHALQNEIKQVFDRFFEQSGDTDESAVVTAQWVPRVDIKEEANQFVLYADLPGIDPSQIEVQMDKGILSIKGERKSESSSETERFSRIERRYGSFHRRFALPDSADADGITADGRNGVLEIRIPKRPAATPRRIQVGGGQDGGGTTVQ

SEQ ID NO: 686 - protein, 206 aa, Alkaliphilus metalliredigenes
MFLEKIAAGVFGVNCYVISDDETGKAAVVDPGGDADKILELIKDNQFELTHILLTHGHGDHIGAVNELHEKTKAPVYVHEDDLYILKDANINYSARMGGPVVTIDTDVFLKDGEVLTIGNLKLHVLHTPGHSPGGVCIRGEGVVFTGDTLFANSIGRSDLEGGNYDQLIASIQSKLMTLDDELTVLPGHGPASTIGIERMTNPYIK

SEQ ID NO: 687 - protein, 640 aa, Corynebacterium diphtheriae
MCGLLGMLSSTGQASKYAAAIESALPCMHHRGPDEAGTWHDDHAVFGFNRLSIIDLEHSHQPLRWGPEGEPDRYAMTFNGEIYNYVELRKKLQDLGYTFNTSGDGETIAVGFHHWGADVVLHLRGMFGIAIWDTKEQRLFLARDQFGIKPLYFATTEAGTVFASEKKCILGMADAIGLDLGLDQRAIEHYIDLQYVPEPESLHQHIRRLESGCFAFVSVGGNVEQTRYFRPQFPAQEFPKDKEQDLFDRIAKALEDSVEKHMRADVTVGSFLSGGIDSTAIATLAKRHNPNLLTFTTGFEREGYSEVDVAAESAAAIGVEHIVKIVSPEEYANAIPQIMWYLDDPVADPSLVPLFFVAQEARKHVKVVLSGEGADELFGGYTIYKEPLSLAPFEKIPSPLRRGLGKVAEVFPDGMRGKSLLQRGSMTMEERYYGNARSFNFDQMKRVIPWAKKEWDHREVTAPIYAQSEHMDPVARMQHLDLFTWMRGDILVKADKINMAHSLELRVPFLDKEVFEVAETIPYDLKIANGTTKYALRKAMEQIVPPHVLHRKKLGFPVPMRHWLAGDELFGWAQDTINESMTDQYFDKAAVLAMLNEHKNGVSDHSRRLWTVLAFMIWHGIFVEHRIDPGIEKRDYPVYL

SEQ ID NO: 688 - protein, 502 aa, Lycopersicon esculentum
MVLTTTSIRDSEESLHCTFASRYVQEPLPKFKMPKKSMPKEAAYQIVNDELMLDGNPRLNLASFVSTWMEPECDKLIMSSINKNYVDMDEYPVTTELQNRCVNMLAHLFHAPVGDDETAVGVGTVGSSEAIMLAGLAFKRKWQSKRKAEGKPFDKPNIVTGANVQVCWEKFARYFEVELKEVKLKEGYYVMDPAKAVEIVDENTICVAAILGSTLTGEFEDVKLLNELLTKKNKETGWETPIHVDAASGGFIAPFLWPDLEWDFRLPLVKSINVSGHKYGLVYAGVGWVIWRSKEDLPDELVFHINYLGSDQPTFTLNFSKGSYQIIAQYYQLIRLGFEGYKNVMKNCLSNAKVLTEGITKMGRFDIVSKDVGVPVVAFSLRDSSKYTVFEVSEHLRRFGWIVPAYTMPPDAEHIAVLRVVIREDFSHSLAERLVSDIEKILSELDTQPPRLPTKAVRVTAEEVRDDKGDGLHHFHMDTVETQKDIIKHWRKIAGKKTSGVC

SEQ ID NO: 689 - protein, 262 aa, Glycine max
MVNAMEWQKQRCWQPNRNAEMMCVKVMTDEQLEILRKQIAVYATICEQLIEMHKNISAHQDLAGIRLGNMYCDPLLGSGGLKIASRQRWTPTAMQLQILERIFDQGIGTPTKEKIKEITNELSQHGQISETNVYNGSKTRRARSNPQQQNVAPSANAESEVETEVDSKDKKTKPDEFQAPPSVSAGPADNLGFQNHDSLQYLNPESNKPDSVFPSDGTRNFHHVPAFDGLLSNSRSNYLTGKLETPENYELYQPAGDYNIAG

SEQ ID NO: 690 - protein, 135 aa, Arabidopsis thaliana
  misc_feature (49)..(49): Xaa can be any naturally occurring amino acid
  misc_feature (58)..(58): Xaa can be any naturally occurring amino acid
  misc_feature (68)..(68): Xaa can be any naturally occurring amino acid
  misc_feature (94)..(94): Xaa can be any naturally occurring amino acid
  misc_feature (125)..(125): Xaa can be any naturally occurring amino acid
MDPYRFRPASSYNSPGLTSNYGAAVCNINYFMTVRPRGPILLKDYHLVXKLVIFNREXIPQRLTHARXTSAKDSFVATHYIFHLTCTDFMQAAXLHTPDIVRDSTLIHVRVYPLTFKDPFGCRCXFYTINGNFHL

SEQ ID NO: 691 - protein, 1131 aa, Sorghum arundinaceum
MSSSRPAHSSSSSSRTRQSSRARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGNIRHIREAGMSTFILTAELAAAPSAVGQ

SEQ ID NO: 692 - protein, 1131 aa, Sorghum arundinaceum
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGNIRHIREAGMSTFILTAELAAAPSAVGQ

SEQ ID NO: 693 - protein, 1131 aa, Sorghum arundinaceum
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGNIRHLREAGMSTFILTAELAAAPSAVGQ

SEQ ID NO: 694 - protein, 314 aa, Debaryomyces hansenii
MSEINILTIFRSTKVLKFYNGQEIPATGLGTWQSKDEEVYNAVLAALKIGYKHIDTAACYGNEEPIGRAIRDAGVKREDIFITTKVWGTDHTRVEQALNTSLQKLGLDYVDLYLMHWPVPLNPNGNHPLFPTLPDGNRDISQDWDFTKTYNLMQKLLDLGKTKSIGVSNFSVTNLKKLLNAPTTTVKPVVNQVELHPYLPQHKLLQFAKENDIVLESYSPLGSTDSPLLSDEVVVKIAEKNKVSPATILISWALWRGTVVLPKSVSAHRIESNFNVIDLPDADGKELDDLHKLRGIRRLVLPNWAPVVVFDSDE

SEQ ID NO: 695 - protein, 458 aa, Bdellovibrio bacteriovorus
MQSLKRYWKTYILGGALLLVLFIMAETGFQVRSFAQERYADLQNFSKVLNLIQQYYVEEVNTKKLVYGAIKGMLRELDPHTNFMPPEMFKDFETETSGEFGGLGIEISIQNGILTIISPIEDAPAWEAGIKAGDKVVSIDGTTTKGMSLAEASVMMRGKKGSKIVLRVVRDNEEKPRDITVVRGSVKIKSVKYTDLGDGFAYVRITSFIENTSKDLQKTVENHIKNNKNMAGLLIDMRRNPGGLLDQAIKVSDMFLKDGTIVSTIGRNKNEKEVATASKKGQYTNFPIVILVNEYTASASEIVSGALQDNKRALIVGQRTFGKGSVQSVIKLGDGSGLKLTVARYYTPNGVSIQAEGIHPDIEIEDVDPDAFSKAIVKSVTTREGDIAGHLKGDREKAAEKLDVKEGAEEGALAWWKDVGSKKDEKLSPRDKLFKSDYQAYQAFSYLKAWDTLKALTR

SEQ ID NO: 696 - protein, 455 aa, Staphylococcus aureus
MSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAESDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKLHFRTQQGIENLTDEEAAEIIATGRDSSQRDLFEAIEKGDYPKWTMYIQVMTEEQAKNHKDNPFDLTKVWYHDEYPLIEVGEFELNRNPDNYFMDVEQVAFASTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEGAKERILQIQQMQWKA

SEQ ID NO: 697 - protein, 505 aa, Staphylococcus aureus
MSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFTDVEQAAFAPTNIIPGLDFSPDKMLQGRLFSYGDAQRYRLGVNHWQIPVNQPKGVGIENICPFSRDGQMRVVDNNQGGGTHHYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 698 - protein, 253 aa, Brassica napus
  misc_feature (50)..(50): Xaa can be any naturally occurring amino acid
  misc_feature (58)..(58): Xaa can be any naturally occurring amino acid
NHREYQDLQRLYSEIGHPPSDAFLFLRSYPNRRKQNPPTRFLRLTHKLRXTSTDFILXGNHHHSTIIRIFGYYDECKRRFNVRLWKIFTDCFNCLPVAALIDDKILCMHGGLSPELDNLNQIREIQRPTEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPALASSSGHPLKKVPKMGKS

SEQ ID NO: 699 - protein, 354 aa, Arabidopsis thaliana
MMSLSTTLKPLSHFSPFVKRHNPKTNNTLFTLDTHNFTNSFWSKRGGSVSAVYEAPDHVESSWRRLLSEVVVVRTKRSFWERSWTSWDVSKLVIFVGTHLLSLLAPFYFSWEAFWVFPWLVFINGICITLSYHRNLSHRSFDLPKWLEYLFAYGGVLAFQGDPIEWVSNHRYHHKHCETQRDPHSPTQGFWFSHMAWIFDTSSILENCGGEENVDDLVRQPFYRFLQRTVLLHMMAYSFLFYFCGGMPLLVWGIGITIAVRLHLTFLVNSVCHIWGTRAWNTSDFSKNNWWVAILTLGEGWHNNHHAFEFSARHGLEWWQLDITWCLIRFLEAIGLATNVKLPTETQMKGKALV

SEQ ID NO: 700 - protein, 746 aa, Shewanella oneidensis
MMTQAQTYFYDGSDVALLNGQYTDVFSLLGMHSINEGKALVVRCFLRNAQKVDVISLKDGRKVASLERVNEAGLFAGTLGRRIKPFLYALRVTYPLCELDIIDPYQFGSLLNREDLYLFGEGSSEQAYRFLGANWRQVDNVEGVHFCVWAPNAKRVSVVGDFNHWDDTRHVMRQHVANGLWEIFLPGVVEGSHYKFDLVYQNGERHAKSDPMATQMECAPHNASIVPKKQQHQWADTQWMDKRAATAWHRAPMSIYEVQLGSWRRKGEFGEQYFDYQDLIEQLIPYVKEQGFTHIELMPVSEYPFDGSWGYQPVGLYAPTYRFGDANGFKAFIDACHQAEIGVLLDWVAAHFPKDPHGLVRFDGTCLYEHEDPRKGTHPDWDTLIYNYGRGEVRSFLLSNACYWLREFHLDGLRLDAVSSMLYLDYSREPGQWLPNAYGGRENLEAIDFLQMLNQRLYQAIPGICMIAEESTAFAGVTKPTDSSGLGFGFKWNMGWMNDSLSYLGRDPIYRQYHHNQLTFSLMYAYSEQFMLSISHDEVVHGKGSLLHKIPGDDWQKFATLRAYYGFMWGHPGKKLLFMGSEFAQRDEWDHDHSLDWHLLAFEPHQGVQRWLRDLNQLYRQFPALSVLDYEPQGFRWLDCDNGRDSIFSFVRYGEGNDVPLVFVVNMTPTVHQGFRIGLPQGGDFCEYLNSDSYLYGGSNQGNGGKIIAQALPWQGMASSALITVPPLGCLILGPATENILRESAL

SEQ ID NO: 701 - protein, 323 aa, Arabidopsis thaliana
MKVRTINIIASSEIPNLGLAVNLAKQMHWQVATATAAIAISLWTLEGEQRKKRLQIDILSEKLRVFEEKRIWEKEREREFPKAELSWVKQILRMGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 702 - protein, 609 aa, Unknown
  Magnetococcus sp. MC-1
MCGILAEVGQQSPAAARQRALDRLRHRGPDHGGQWSAQQPVPVWLGHRRLAIVDTSSAGNQPLHLHAADLHLVGNGEIYNAPALQKTLEALGHVFHSHSDNEAILHAYREWGSDCLAHLEGMFAFVLWDARQQTLLAARDRMGIKPLFYAATPAGGLVLASEASALVGLDGVAQQGYEPQALSHVLAYGHIPDPYAIWRGVNKLSPGQFLRWTPQQGLRLHTYWSPPSQSDAPSDDQAWGQRFEQVLQEHLLSDVPLSLFLSGGLDSTSVAVGVKRLGHQLKAFSLGFPGHPRDESALAQATAERLGHPFEAVVMDGRDLLQQVDAALLQQDEPHLFGSYLTMLNICSAVAKEYKVVLSGDGGDELFAGYNWYRDIPTALPTLAPWKAALAKPLLRHSPLPAALLERARLAFACCSPLHRHAWRTSQRFLPAEVEALLRPAAIRYDDEAFLAPLQRWFTPELPLVRALQRIDLMSFCSNHVCAKVDRASMAHALEVRVPYLDRRLVEWAISRPADPREAQGSKPLIRDYIAPHVPAQVLEQRKQGFSLRTTPPANLESTFVAWIEQSPLISQSILRRDWPRFLRADDRLRAQKLWHLALLARWMHHHPA

SEQ ID NO: 703 - protein, 439 aa, Thermus thermophilus
MKRRAWFMVGLGVLLALVYAQLPRPQAETFLQNPNGQALLEVYQRIQQDYLEPLSKEKLDKLLEGAIGGMVQALEDPFTSYSPPQRSTLRQEDLRGEFFGIGATLSAANPDGTGARIEGVMKGLPAQRAGLRAGDVILEVDGEDVTKLPLLDIVAKIRGREGTKVTLKVRREGVPAPLVFELVRERVEIISVSTAKVGDVGYVALETFANFKVEDQLKRAIEELKAQGVKKLIFDLRDNGGGLLDQGCAVASAFLKEGPIVYTRTKNLTRVWCEATGQTLWDGPMVVLVNGNSASASEIVAGALQDYGRAKVIGEKTFGKGVGQTPYTLANGGELTLVTFEWLTPKRRSINKEGITPDIVVKDTRFPTPFSLQGAGAPPGAEIAVTLNGKTVKVKADAEGKFSYAEPQRQRPLPEDRGQAVLDLENDAILKRALEELNR

SEQ ID NO: 704 - protein, 492 aa, Triticum aestivum
  misc_feature (41)..(41): Xaa can be any naturally occurring amino acid
  misc_feature (302)..(302): Xaa can be any naturally occurring amino acid
  misc_feature (384)..(384): Xaa can be any naturally occurring amino acid
MVVTVAATGSDTAEPLHSTTFASRYVRDQLPRYRMPSGSIXPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNDLLVEKNKETGWNVPIHVDAASGGFIAPFLHPELEWDFRLPLVKSINVSGHKYGLVYPGVGWVVWRSKADLPXELIFHINYLGTDQPTFTLNFSKGASQIIAQYYQLIRLGFEGYKHIMENCKLNAAVLKEGIDATGRFDVLSKADGVPLVAIRXLKDSTNFSVFDISENLRRFGWIVPAYTMPADAEHVAVLRIVIREDFNRSLAQRLLADINKIVGELDAHAVHAIKLSTAAAAEGASKSTVDAVTEAFKGLPGNKKAGVC

SEQ ID NO: 705 - protein, 1131 aa, Sorghum arundinaceum
MSSSRPAHSSSSSSRTRQSSRARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGDIRHIREAGMSTFILTAELAAAPSAVGQ

SEQ ID NO: 706 - protein, 208 aa, Schizosaccharomyces pombe
MSAQKRVFLKVVILGDSGVGKTCLMNQFVNQKFSREYKATIGADFLTKDVVVDDKLVTLQLWDTAGQERFQSLGMAFYRGADCCVIVYNVNNSKSFDSVENWRQEFLYQTSQDECAFPFIIVGNQIDKDASKRAVSLHRALDYCKSKHGSNMIHFEASAKENTNVTDLFETVSRLALENESSRDDFVNDFSEPLLLSKPLNNTSSCNC

SEQ ID NO: 707 - protein, 1131 aa, Sorghum arundinaceum
MSSSRPAHSSSSSSRTRQSSRARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGNIRHLREAGMSTFILTAELAAAPSAVGQ

SEQ ID NO: 708 - protein, 452 aa, Bartonella vinsonii
EDRFENMGAQMLREVASKTNDIAGDGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKAEINARVNQIKAQIEETTSDYDREKLQERLAKLAGGVAVIRVGGATEVEVKEKKDRVDDALNATRAAVEEGIVAGGGTALLRAANALTVKGSNPDQEAGINIVRRALQAPARQIATNAGEEAAIIVGKVLENNADTYGYNTATGQFGDLIALGIVDPVKVVRSALQNAASIARLL

SEQ ID NO: 709 - protein, 174 aa, Glycine max
  misc_feature (65)..(65): Xaa can be any naturally occurring amino acid
MSDAPASPSHESGGEQSPRGSLSGAAREQDRYLPIANISRIMKKALPPNGKIAKDAKDTMQECVXEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 710 - protein, 557 aa, Debaryomyces hansenii
MVSEYIQNTKKDPAVYSTSNGVPYANHPYGAQTAGPGGPLLLQDFNLMDDISHFDHERIPERVVHAKGGGAHGYFELTDSLSDLTYARPLQSPGYKCPVSVRFSTVGGERGTPDTIRDPRGFSIKLKTDIGNMDWVFNNTPIFFIRDPIKFSKFIHTQKRDPSTNLNQLTDPYHTWDYFIQNPECLHQITYMFGKRGIPKSWAEMHGYSGHTFKLINDKDEITYIQIHCLADGGFDGFSDKEGKELAGSSPEYNTKDLYERIAAGNYPSYSFYVQTMTPKQAEEFRYSINDLTKVWPHKEFPLRKFGRMVLDKNPVNYHDEIEQIAFSPAHLVPGIEPSNDPVLQSRLYSYSDTHRHRLGANYQQLPVNKPRTFDSNSGCPFLAGNFQREGIASIDNQGSRPNYLSSLLPINSVSNDPKSYKNGLPPVEEKKYLGVVPKRSTDKYEILQKERNLKAHEEKIWLKSYDYISGFSELDVEQPRALYKNIISKQDKGDFIEAIVGHASKISVPQIKERVPQLWGLIDGDLGSEVAKGLGVSYKHLTVDEYIEDLGIAPAN

SEQ ID NO: 711 - protein, 1131 aa, Unknown
  Sorghum x drummondii
MSSSRPAHSSSSSSRTRQSSRARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGDIRHLREAGMSTFILTAELAAAPSAVGQ

SEQ ID NO: 712 - protein, 365 aa, Burkholderia fungorum
MSALFQPYKLKDVSLRNRIAVPPMCQYSAEEGLINDWHSVHLAALARGGAGLVIVEATAVSPEGRITPGCAGIWTDEQAQAFAPVVASIKAAGAVPGIQIGHAGRKASANRPWEGDDHIAADDSRGWPTIAPSAIAFGANLPKVPKAMTLDDIARVREDFVAAAKRARDAGFEWLELHFAHGYLGQSFFSTHSNQRDDAYGGSLENRSRFLLETLAAVRKVWPEHLPLTARFGVIEYDGRDEQTLVESIELAKNFKREGLDMLSVSVGFSTPTAAIPWAPAFLAPIAQRVRREAGIPVSSAWGIDTPELADGAVKSEQLDLVMVGRAHLANPHWPYYAAKKLGIERPSWTLPAPYAHWLERYAVA

SEQ ID NO: 713 - protein, 359 aa, Unknown
  uncultured bacterium 442
MNYAHLYSPLEMGDLRLRNRIVMAPMTRSRARQDDDAVSELQANYYGQRGDAGLIVTEGVHPSADGKGYNRTPGIYNDTHTKAWSTVTDRVHGRGGLIACQLMHCGRVGHALNKGRNTRFLAPSALAANAEIFTESGMMPMPTPEAMTLAEIKTVVADYQAAAARALKAGFDAVELHCASGYLPAQFLATGSNLRDDQYGGSLENRLRFVEEVLQAIKVETGAGRIGLRISPGNPYNDHVDDNPTETYAALLEVADRLGLAWVHAIRMASTGIDSLALSREYFSGALIGSDSFNAAEADQFIAEHCVDAVSFGRAYIANPDLVTRFACDAPLNTLDKRTIYAGEGSGGYTDYPSLTASG

SEQ ID NO: 714 - protein, 454 aa, Bartonella taylorii
EDRFENMGAQMLREVASKTNDIAGDGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKSEITARVNQIKAQIEETTSDYDREKLQERLAKLAGGVAVIRVGGATEVEVKEKKDRVDDALNATRAAVEEGIVAGGGTALLRAANALTVKGSNPDQEAGINIVRRALQAPARQIATNAGEEAAIIVGKVLENNADTYGYNTATGQFGDLIALGIVDPVKVVRSALQNAAFNCQASHD

SEQ ID NO: 715 - protein, 1131 aa, Sorghum propinquum
MSSSRPAHSSSSSSRTRQSSRARILAQTTLDAELNAEYEESGDSFDYSKLVEAQRSTPSEQQGRSGKVIAYLQHIQRGKLIQPFGCLLAFDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDARYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGREEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAQFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGDIRHLREAGMSTFILTAELAAAPSAVGQ

SEQ ID NO: 716 - protein, 423 aa, Bartonella tribocorum
MAGDGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEAFGNARGQQIARWFENCLLVKAPGFGDRRKAMLEDIAILTSGQVISEDVGIKLENVTLDMLGRAKKVNISKENTTIIDGAGQKAEITARVNQIKAQIEETTSDYDREKLQERLAKLAGGVAVIRVGGATEVEVKEKKDRVDDALNATRAAVEEGIVAGGGTALLRAASALTVKGGNPDQEAGINIVRRALQAPARQIATNAGEEAAIIVGKVLENNADTYGYNTATGEFGDLIALGIVDPVKVVRSAAS

SEQ ID NO: 717 - protein, 146 aa, Triticum aestivum
MAAAAGGTSSEGAARVLLQRYQPFGSPPGEYHHFGPADGGGSADMTEAVVLRTPLKRKHNREDNEVAESNDWMMSPGYANAANSPIPTPPSGKGSKMSAKPKAAKGQKSCPQTPLFSGSPGNPATPVGGCRYDSSLGLLTKKFLNL

SEQ ID NO: 718 - protein, 157 aa, Helianthus annuus
MSIVSSLFGGRRSSVFDPFSLDVWDPFRDFPISSSSDVSRETSALVNARVDWKETPEAHVFKADLPGIKKEEVKVEVEDGNILKITGERNIEKEDKNDKWHRVERSSGKFTRRFRLPENAKMDQVKAAMENGVLTITVPKEEVKKPDVKSIGDLWLE

SEQ ID NO: 719 - protein, 368 aa, Xylella fastidiosa
MADTSSMPSIVGLLEPTTFGAIPLNNRVVMAPMTRLRAQADGAPGDLMVEYYRQRAGMGLIVTEGTYPSLESQTGVGQPGIATEEQAGGWRKMTDAVHLAGGHIVLQIMHGGRTAHPGVNGGRRVIAPSAVTLGGEVYTANGKEAFTTPAPMAEADIRDVIAEHVAAAQRAVAAGFDGVEIHGANGYLGQQFLSPASNQRTDQYGGSPENRARFVVELVQAVAEAVGPGRVGLRISPEHNYQETFEPDRSDVLATYGALLDALRPLGLAYLSVLHQEPTGALVEELARRFAGKVAANSGFATFTSLEEAEQIVAAPFIDAVVVGRAALANPDLIERWKSEQPLTEPRYDLFYTHDAAGYTDYPTLAGR

SEQ ID NO: 720 - protein, 467 aa, Methanococcoides burtonii
MTSRLNRSLFVFRRDMRVDDNSALLAALDMSDVVIPCFILDPRLCDPKGKAFNSNALQFLLESLYDLKGQLEKVNGRLYLFSGLPEGVIGQLLENLEIDAVFVNHDYTPFSIKRDMQIASICTDKGVDMLQFHDCLLHEPGSIRTKKGTPYKVFTQFFREASKRDVAVPSMFSGGSFFTGDCGVDEVDEGSFLKRSLPERNEQIFVHGGRANGLSVLQSLSQFVNYDTERDLPSVKGTTGLSAHNKLGTISIREFYYSVIDELGRGHTLINELYWRDFFTQISFEFPDVFKHAFKKKFDHLSWDNDRIFFDAWCLGKTGFPIVDAGMRELNTTGYMHNRVRMIVASFLVKDLHIDWKRGERYFASKLVDYDPCVNNGNWQWAASTGADSQPYFRIFNPWLQQKKFDKDCKYIKKWIPELEDIEPQRIHKLEKGDMDIPGYPAPIVDHSKEREVALFMFKAASQIMDV

SEQ ID NO: 721 - protein, 120 aa, Brassica napus
  misc_feature (40)..(40): Xaa can be any naturally occurring amino acid
MVASKMVAKEAIPLLTTHRMGRFELSHRVVLAPLTRCRSXANVPQPHAAVYYSQRATKGGLLIAEATGVSATAQGYAETPGIWTQQQVDAWKPIVDAVHRKGALFFCQLWHVGRVSTNDF

SEQ ID NO: 722 - protein, 368 aa, Pseudomonas syringae
MNKLFTPFDLAGTSLKNRVVMAPMTRTRTLNNIPNEANALYYAQRASAGLLITEGLPISDESRGYLYTPGIYEDVHLPGWRNVTDAVHAKGGKIFAQLWHVGRMSHISVHGIVPVSSGTVPAVDTTVYAWIEPGKAGPVQPSAPRALETEEVKRVIADFVKSARMAMDAGFDGIEIMAANGFLFDQFLSSSLNTRTDQYGGSIANRQRFLLETIDAIAAEIGGSKIGVRFSPFGRLYDFGVYEGEEETWMSMASALNERELAFVHLNYQPTILAAQTPPGFGAAFREAYKGTVMAAGGFTKEIAESELAKGELDLVAFGTAYIANPDLVERMQNNWPLAESDRATYYGVSGSIEKGYTDYPEYAAAEA

SEQ ID NO: 723 - protein, 248 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGWEGGEQNVTYAHHQAQSQGLYQPLECNPTLQMGYDNPVCSEQITATTQAQAQPGNGYIPGWML

SEQ ID NO: 724 - protein, 406 aa, Candida albicans
MTVESTNSFVVPAGTKQIEIAPLGSTKLFQPIKVGKNILPHRVAHAPTTRFRAAKNHTPSDLQLEYYKTHSQYPGTLIITEATFTSEQGGMDLHVPGIYNDAQTKAWKKINDEIHANGSFSSMQLWYLGRVANPKDLKDAGLPLIGPSAVYWDEESEKLAKSVGNELRELTEKEIDHIVEVEYPNAAKRAIEAGFDYIEVHSAPGYFLDQFLNPASNKRTDKYGGSIENRARLLLRIIDKLIGIVGAEKLAVRLAPWSSFLGMEIEGEEIHSYILQQLQQRADNGQQLAYVSLIEPRVIGIFDASLEDQKGRSNEFAYKYWKGNFVRAGNYTYDAPEFKTLLHDLDNDRTIVGFARFFTSNPDLVEKLKLGKPLNHYDREEFYKYYNYGYNSYDESEKQVIGKPLV

SEQ ID NO: 725 - protein, 429 aa, Methylobacillus flagellatus
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLCANVPGQLAIQTALGGYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEGKASKEAQTTSQSASA

SEQ ID NO: 726 - protein, 492 aa, Oryza sativa
MVLSHGVSGSDESVHSTFASRYVRTSLPRFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 727 - protein, 206 aa, Zea mays
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLHNWREEFLIQASPSDPDNFPFVLLGNKVDVDGGNSRVVSEKKAKAWCASKGNIPYFETSAKDGTNVEDAFQCIVKNALKNEPEEELYVPDTVDVVGGNRAQRSSGCC

SEQ ID NO: 728 - protein, 542 aa, Unknown
  Candidatus Tremblaya princeps
MPAKDVIFGDCARLRLMEGVNTLTDAVKVTLGPKGRNVVLERSYGSPAVTKDGVTVAKDIELRDRLQNMGAQMVKEVAAKTSDNAGDGTTTATVLAQSIVREGMRYVASGVNPMDIKRGIDQAVSSAVMELKKISRPCTTGKEIAQVGSVSANNDRTVGEMIAEAMNKVGKEGVITVEDGKSLADELEVVEGMQFDRGYLSPYFINNPDRQVAVLDSPFVLLCEKKVASIRDLLPIMERVAKAGRPLLIVAEDVEGEALATLVVNNARGILKAAAVKAPGFGDRRKAMLQDIAILTGGHVVSEETGLSLEKVSLPELGQAKRAEVAKDTTTIIDGAGDAKAINARIKHIRLQIEEAASDYDKEKLQERVAKLAGGVAVIRVGAATEVEMKEKKARVEDALHATRAAVEEGIVPGGGVALIRARNAISNLRCDNPDQDAGIRIVLRAMEEPLRQIVANGGEEASVVASSVASGKSISYGYNAAMRVYGDLMDAGVVDPTKVTRSALQNAASVAGLMLTTDVAVCDSPKREEAAPTQPVHGGVG

SEQ ID NO: 729 - protein, 393 aa, Oryza sativa
LKRKHDREENEAAESNDWMMSPGYTNPAGSPVPTPLSGKGSKAFAKSKAAKGQKSCPQTPLCASSPGNPVTPVGGCRYDSSLGLLTKKFLNLLKGAPGGIVDLNNAAETLEVQKRRIYDITNVLEGIGLIEKKLKNNIRWKGIDDSRPGEVSDDMSILQADIEALSLQEHSVDQQISEMRDKLRGLTEDENNQKWLYVTEDDIKSLPCFQNQTLIAIKAPHGTTLEVPDPDEVNDYPQRRYRIVLRSTMGPIDVYLVSQFEEMSGMETPPRTVQPVSMDSLENPRTPLAAEPNKAAESQPNIQDGLLMPSDAPSSSQDIGGMMKIVPSELDTDADYWLLSDAGVSITDMWKTAPEVEWEGIEKFNAEDFLEVSTPRQQDKPSSDIMDGDSCIS

SEQ ID NO: 730 - protein, 519 aa, Unknown
  Candidatus Blochmannia sayi
  misc_feature (510)..(510): Xaa can be any naturally occurring amino acid
  misc_feature (513)..(513): Xaa can be any naturally occurring amino acid
  misc_feature (519)..(519): Xaa can be any naturally occurring amino acid
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKAGKPLLIIAEDVEGEALATLVVNNMRGIVKVTAVKAPGFGDRRKAMLQDIAILTAGTVISEEIGLELEKSTLEDMGQAKRVVITKDATTIIDGVGNKSAINSRIAQINQQRDEATSDYDREKLQERVAKLAGGVAVIKVGAATEVEMKEKKARVEDALHATRAAVEEGVVAGGGVALIRVANAIRDLCGDNEDQNVGIKVARRAMEAPLRQIMANAGEEPSVIANNVRSGEGNTGYNAATEKYGNMIELGILDPTKVTRSALQYAASXAGXIITTEX

SEQ ID NO: 731 - protein, 434 aa, Bartonella henselae
IAGDGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKSEINARVNQIKVQIEETTSDYDREKLQERLAKLAGGVAVIRVGGATEVEVKEKKDRVDDALNATRAAVEEGIVAGGGTALLRAANALTVKGSNPDQEAGINIVRRALQAPARQIATNAGEEAAIIVGKVLENNADTFGYNTATGEFGDLIALGIVDPVKVVRSALQNAASIASLLITT

SEQ ID NO: 732 - protein, 755 aa, Symbiobacterium thermophilum
MDVTHILREVYWHSLDGIVVADKDTVILDVNPAYEAVTGYSRDELIGRKTNIVRSGLTPPEVFRDMWTQLGRQGKWVGEVINRHKNGNLWYSFLSITRIVDEGGSVVAYVGIARDITQRKAMEQQLRQNLAEIQSARELAQAQATRLTALLDSVGEAIIMVDTLGICVVANHQAGGMLGLPAEQIVGKSVHELHALALRSLGVSAFQWQPAPNGGPPIEPETNVIETREQRPRVFHEFAAPVTDTEGHVLGRIYVYRDITKETELDRMKTEFIATVSHELRTPMTSIKGALGLVLGGAAGDLPPEARELLTIARNNTDRLIRLINDILDISRIEAGKMEIRRAPLSPADVVRRAVEEMNAFARQRNITLTTDVPEGLARVMADADRLHQVLDNLISNAIKFSPQGSEVLIRARETGDGVRFDVIDRGPGIPADQTGLIFERFYRVDNAASRKTGGTGLGLTICKAIVEEHGGQIWVESALGEGSTFSFTIPVEPGGHVAEPPIPVGSRTVLVVDDDPDIVRIIMLALEREGFHAVGATSGEQALEIARSRHVDVITLDLMMPGADGVQVLRQLKHDPATRDIPVVVVSAYGAGKEPELVATGVSGIVAKPIDENDLLATIRTVLGTWRGERPQPSILVVDDDPDVRRIVSVMLERAGYAVRTAQDGQEAFRMIMAERPDLLILDLMMPNLDGFQLVRLLRQRRWTQQIPLLVLTALDLTEGEKTLLQLGPTRHVTKGPVIQEEIVARVRELLASH

SEQ ID NO: 733 - protein, 535 aa, Unknown
  Candidatus Blochmannia festinatus
  misc_feature (529)..(529): Xaa can be any naturally occurring amino acid
  misc_feature (532)..(532): Xaa can be any naturally occurring amino acid
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGAVELEHPFILLADKKISNIREMLPILESVAKAGKPLLIIAEDVEGEALATLVVNNMRGIVKVTAVKAPGFGDRRKAMLQDIAILTAGTVISEEIGLELEKATLDDMGQAKRVVITKDATTIIDGVGNKLAIDSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAATEKYGNMIELGILDPTKVTRSALQYAASIAGLMITTECMVTDFLKKIXLIXGSK

SEQ ID NO: 734 - protein, 458 aa, Bartonella henselae
MTLLVIGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKSEINARVNQIKVQIEETTSDYDREKLQERLAKLAGGVAVIRVGGATEVEVKEKKDRVDDALNATRAAVEEGIVAGGGTALLRAANALTVKGSNPDQEAGINIVRRALQAPARQIATNAGEEAAIIVGKVLENNADTFGYNTATGEFGDLIALGIVDPVKVVRSALQNAASIASLLITTEAMVAEVPKKDTPVPPSAWWRN

SEQ ID NO: 735 - protein, 371 aa, Unknown
  Exiguobacterium sp. 255-15
MANEKMFDTFTLPNGVTLKNRIMMAPMTNYAAEENGEVSEAELAYYAARSGGVGAVITACANVTADGQGFPNEFGAERDELVPSLKRLATTIQDQGAKAILQIFHAGRMAPPELVGGQTVSASAVAPEREGAMTPRALEAAEVEAIIEAFGQATRRAMEAGFDGVEIHGANTYLIQQFVSPHSNRREDKWGGSLEKRLAFPLAVVDAVEAVAKQDPSFIVGYRFSPEEVENPGITLDDTMQLVDALAKKDLDYLHVSVMDFFAGSIRDQNETRSPISLVQERVGQQVPVIGVGSLHTPEEVERSLEVVPLVALGRELIMEPKWVEKVEAGETESIRTELDPSAQAELVVPDALWQGITSRPGWFPIKQTTK

SEQ ID NO: 736 - protein, 527 aa, Unknown
  Candidatus Blochmannia ocreatus
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGAVELEHPFILLADKKISNIREMLPILESVAKAGKPLLIIAEDVEGEALATLVVNNMRGIVKVTAVKAPGFGDRRKAMLQDIAVLTAGTVISEEIGLELEKSTLEDMGQAKRVVITKDATTIIDGVGNKSAINSRVAQINQQRDEATSDYDREKLQERVAKLAGGVAVIKVGAATEVEMKEKKARVEDALHATRAAVEEGVVAGGGVALIRVANAIRNLSGDNEDQDVGIKVARRAMEAPLRQIMANAGEEPSVIANNVRSGEGNTGYNAATEKYGNMIELGILDPTKVTRSALQYAASIAGLMITTECMVTELPKE

SEQ ID NO: 737 - protein, 409 aa, Unknown
  uncultured bacterium 442
MLARAYTPLQVGPVTLPNRFIKAGANENMSLRGMPTLAMLKHHESMAAGGVGMTTMAYLSVNKVGRTLPDQIWLHDGVLDELRAVTDAVHAKGGKIAAQITHGGSFVTGVFVPKRLQSSVSGFNPAGLLRGNVLRRGMTEDDMQNMVDDFVTAAEHCVSAGFDAVEIHMGHGYLLNQFLSPMDNKRKDAYGGSAENRARFPTRVLAAVKQRVGQDIAVLAKINVSDGRRRGANVEDAIVTAKLLEAAGADMLVLSGGRNVESGWFMFGSNMNLEAMYRVLGKWSLSGMAIGATAKSAPSIDFRELYFWEYSKKIREAVSLPLTYLGGVKSADNVAQCMAAGFEAVALARALLREPDLVNKWQVHPEEPSLCDNCNSCVAYIYHPAGTWCIHRPANVLEDNQLLASSGGA

SEQ ID NO: 738 - protein, 445 aa, Bartonella henselae
LGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKSEINARVNQIKVQIEETTSDYDREKLQERLAKLAGGVAVIRVGGATEVEVKEKKDRVDDALNATRAAVEEGIVAGGGTALLRAANALTVKGSNPDQEAGINIVRRALQAPARQIATNAGEEAAIIVGKVLENNADTFGYNTATGEFGDLIALGIVDPVKVVRSALQNAASIASLLITTEAMIAEVPKKDTPVPPSAWWRN

SEQ ID NO: 739 - protein, 509 aa, Unknown
  Candidatus Blochmannia schaefferi
  misc_feature (500)..(500): Xaa can be any naturally occurring amino acid
MAAKDVKFGNDARIKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPERGIVELEHPFILLADKKISNIREMLPVLESVAKAGKPLLIIAEDVEGEALATLVVNNMRGIVKVTAVKAPGFGDRRKAMLQDIAILTAGTVISEEIGLELEKATLEDMGQAKRVVITKDATTIIDGVGNKSAINSRIAQINQQRDEATSDYDREKLQERVAKLAGGVAVIKVGAATEVEMKEKKARVEDALHATRAAVEEGVVAGGGVALIRVANAIGNLCGDNEDQNVGIKVARRAMEAPLRQIMANAGEEPSVIANNVRAGEGNTGYNAATEKYGDMIELGILDPTKVXRSALQYAAS

SEQ ID NO: 740 - protein, 467 aa, Bartonella henselae
LREVASKTNDIAGDGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRIAMLEDIAILTSGQVISEDVGIKLENVTLDMLGRAKKVNISKENTTIIDGAGQKSEINARVNQIKVQIEETTSDYDREKLQERLAKLAGGVAVIRVGGATEVEVKEKKDRVDDALNATRAAVEEGIVAGGGTALLRAANALTVKGSNPDQEAGINNVRRALQAPARQNATNAGEEAAVIVGKVLEKNTDIFGYNTATGEFGDLIALGIVDPVKVVRSALQNAASIASLFITTEAMVAEVPKKDTPVPHTCTVAEW

SEQ ID NO: 741 - protein, 516 aa, Unknown
  Candidatus Blochmannia vicinus
  misc_feature (510)..(510): Xaa can be any naturally occurring amino acid
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKAGKPLLIIAEDVEGEALATLVVNNMRGIVKVTAVKAPGFGDRRKAMLQDIAILTAGTVISEEIGLDLEKATLEDMGQAKRVLITKDATTIIDGVGNKSAINSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAATEKYGNMIELGILDPTKVTRSALQYAASXAGLMIT

SEQ ID NO: 742 - protein, 510 aa, Pseudomonas syringae
MPLLNWSRHMVHLTAIGLISIPAAYAADTLTRDNGAAVGDNQNSQTAGAQGPVLLQDVQLLQKLQRFDRERIPERVVHARGTGVKGEFTASADISDLSKATVFKSGEKTPVFVRFSSVVHGNHSPETLRDPHGFATKFYTADGNWDLVGNNFPTFFIRDAIKFPDMVHAFKPDPRTNLDNDSRRFDFFSHVPEATRTLTLLYSNEGTPTGYRFMDGNGVHAYKLVNAKGEVHYVKFHWKTLQGIKNLDPKEVAQVQSKDYSHLTNDLVGAIKKGDFPKWDLYIQVLKPEDLAKFDFDPLDATKIWPDVPEKKIGQMVLNKNVDNFFQETEQVAMAPANLVPGIEPSEDRLLQGRVFSYADTQMYRLGANGLSLPVNQPKVAVNNGNQDGAMNSGKTTSGVNYEPSRLEPRPADEKARYSELPISGTTQQAKITREQNFKQAGDLYRSYNAKEQTDLVQSFGESLADTDTESKNIMLSFLYKADPTYGTRVTEAAKGDLAKVKSLAASLKD

SEQ ID NO: 743 - protein, 467 aa, Bartonella henselae
LREVASKTNDIAGDGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTVIDGAGQKSEINARVNQIKVQIEETTSDYDREKLQERLAKLAGGVAVIRVGGATEVEVKEKKDRVDDALNATRAAVEEGIVAGGGTALLRAANALTVKGSNPDQEAGINIVRRALQAPARQIATNAGEEAAIIVGKVLENNADTFGYNTATGEFGDLIALGIVDPVKVVRSALQNAASIASLLITTEAMVAEVPKKDTPVPHTCRVAEW

SEQ ID NO: 744 - protein, 244 aa, Glycine max
MGRGKVELKRIENKINRQVTFAKRRNGLLKKAYELSVLCDAEVALIIFSNRGKLYEFCSGHSMAKTLERYHRCSYGALEVQHQPEIETQRRYQEYLKLKSRVEALQQTQRNLLGEELEHLDVKDLEQLERQLDSSLKQIRSNKTQQMLDQLADLHRKEEMLLETNNILRNKLEEINVALQPTWETREQNAPYNYHPSQSEGYYETAHCNSTLRIGYDSSGLNEAGGAAGTSAQNASEFMNGWMN

SEQ ID NO: 745 - protein, 256 aa, Unknown
  Candidatus Blochmannia floridanus
MNIIKCISLQTNYIWIIYNHIRQCIIIDPGESLKVIKMLNHLQLIPEAILLTHNHRDHTNGVFTLIQHFPKIKIYGPIETQNQNFATITVSEGDTLQILNQEIKVLNFPGHTPHHIGFYYKSWLFSGDTIFSAGCGTIQTGYTQAMYKSLLKIQCLPKNTLIYSGHEYTLLNLNFAISILPQDTLIINYLKKITKVLKKNKLLQPTTLQLELKINPFLRCNDINIQKSLNLFPKPGEEWKILQALRNKKDLYLVKN

SEQ ID NO: 746 - protein, 539 aa, Burkholderia pseudomallei
MAAKDVVFGDSARAKMVEGVNILANAVKVTLGPKGRNVVLERSFGGPTVTKDGVSVAKEIELKDKLQNMGAQMVKEVASKTSDNAGDGTTTATVLAQSIVREGMKYVASGMNPMDLKRGIDKAVAAAVEELKKISKPCTTNKEIAQVGAISANSDSSIGDRIAEAMDKVGKEGVITVEDGKSLADELDVVEGMQFDRGYLSPYFINNPDKQVAVLENPFVLLHDKKVSNIRDLLPVLEQVAKAGRPLLIIAEDVEGEALATLVVNNIRGILKTVAVKAPGFGDRRKAMLEDIAILTGGQVIAEETGLTLEKATLAELGQAKRIEVGKENTTIIDGAGEAVNIEARVKQIRTQIEEATSDYDREKLQERVAKLAGGVAVIKVGAATEVEMKEKKARVEDALHATRAAVEEGIVPGGGVALIRARTAIASLTGVNADQNAGIKIVLRAMEEPLRQIVTNGGEEASVVVAAVAAGKGNYGYNAATGEYVDMVEAGVVDPTKVTRTALQNAASVAGLLLTTDAAVAELPKEDAPMPGGMPGGM

SEQ ID NO: 747 - protein, 153 aa, Bdellovibrio bacteriovorus
MANLPNPWRERSLANPFREFGRHQERIDRLLNELMELRSGTLGEDMSLMPSSELVEEEKNYLLKVDLPGIKKEDVKVEVEGDRLTIRAERRSEKEEKSKKRYFSEISYGSCMRSFALPQSIDEKKVDAKFENGVLSVTIPKTTESKSKQISVH

SEQ ID NO: 748 - protein, 524 aa, Burkholderia pseudomallei
MRMKLKNIGLIAAGLATGVFATLQISASAQQAVTTAAAPLPLDQLRLFAEVFGQIKREYVEPVDDKKLLTAAIKGMVSSLDPHSSYLDKTDYQELQEQTKGRFAGLGIEISQEDGLVKVISPIEDTPAFRAGIRPGDLITRINDRPVRGMTLDKAVKQMRGEPGTKVTLTIFRKSDDRTFPVTVTRAVIRVQSVKMKLLDPGYAYIRITSFQERTTPDLAAKLQDIARQQPNLKGLILDLRNNGGGLLQSAVGVAGAFLPPDSVVVSTNGQIPDSKQIYRDNYENYRLPSFDSDPLKNLPAVFKTVPMIVLTNAYSASASEIVAGALQDSHRAVIMGKATFGKGSVQTVRPMTADSALRLTTAYYYTPSGRSIQNKGILPDIPVDQYADGDPDDVLVTREVDYTNHLANTQDPNEKKELEEREQRRMEQLRILEEQNDKKTPEQRQKDRERKPIEFGSADDFMMQQALNKLEGKPVEQSKMIAADSTAKSAAAKAGVASAAKGASGAAAKPASAAKPASAPQPQ

SEQ ID NO: 749 - protein, 546 aa, Xanthomonas campestris
MAAKDIRFGEDARTRMVRGVNVLANAVKATLGPKGRNVVLEKSFGAPTITKDGVSVAKEIELADKFENMGAQMVKEVASKTNDNAGDGTTTATVLAQALIREGAKAVAAGMNPMDLKRGIDQAVKAAVIELKNISKPTTDDKAIAQVGTISANSDESIGNIIAEAMQKVGKEGVITVEEGSGLENELDVVEGMQFDRGYLSPYFINNQQSQSADLDDPFILLHDKKISNVRDLLPVLEGVAKAGKPLLIVAEEVEGEALATLVVNTIRGIVKVVAVKAPGFGDRRKAMLEDMAVLTGGTVISEEVGLALEKATIKDLGRAKKVQVSKENTTIIDGAGDSATIEARVGQIKTQIEDTSSDYDREKLQERVAKLAGGVAVIKVGASTEIEMKEKKARVEDALHATRAAVEEGVVPGGGVALVRALVAVGNLTGANEDQTHGIQIALRAMEAPLREIVANAGEEPSVILNKVKEGTGNYGYNAANGEFGDMVEFGILDPTKVTRSALQNAASIAGLMITTEAMVADAPKKDEPAMPAGGGMGGMGGMDF

SEQ ID NO: 750 - protein, 479 aa, Gluconobacter oxydans
MSSSQNRPAIVWFRDDLRMADHPALHEAAASGWPLICLYILDDVTPALHPLGAAARWWLRGALADLRRNLEKQGGTLLTLSGSAEKLLPQLAKQTDAASVHWHHRLHERERAQDNRIRRTLEEQECEVHAQWGTVLVDPDTVQTKQGGFYKVCGSFWKALQTHAVPEPLEAPSRLSFHAIPASVLSDARLNEDSLCPQAPDWAAGFRKTWEPGEAEGQEHLEDFLKNSVAGYPRGRDRVAEEGTSRLSPYLASGAVSPRQVWAALQKHGAHTDGPRIFLSELGWREFARYTLYHLPKLPFENLSPKFSGMHWRRSAADLKAWQRGQTGVPIVDAGMRQLWQTGWMHNRARMIVGSFLTKHLLIDWKEGDAWFRDTLVDADFANNAMNWQWVAGTGIEATPFFRIFNPTRQAEKFDPNGDYIRQWVPELRRLSGKALFEPWAAKDEELEKAGVRLGKSYPRPIVDLKEGRDRALQAFRSL

SEQ ID NO: 751 - protein, 487 aa, Yersinia pseudotuberculosis
MSTHLVWFRNDLRVTDNLALHAACQDPQASVIAVFIATPVQWAAHGMAPRQAAFLRQNLQHLQAALAARGIPLHYHQCDDFQASNTWLVDFCQQQQVDSLFYSQQYELNERLRDDALAVQLSGRAITCQSFHDSVLLAPGTVLTGNNEMYKVFTPFRRAFIQRLLMSDNHCVPAPKARHAPPVLLSPLPFDYPQQSVDSQLFPAGEDAALQRLRRFCREQVQDYRQYRDLPAVPGTSCLSPYLVLGVLSPRQCFNRLWAESPEMLENADSGAFTWLNELIWREFYRHLLVAYPRLCQHHPFIGWTDGLVWNRSESQLKAWQQGQTGYPIVDAAMRQMNETGWMHNRLRMISASFLVKDLLIDWRQGERYFMSQLVDGDLAANNGGWQWAASTGTDAAPYFRIFNPTTQGERFDKDGVFIRRWLPELAAVPDSDIHQPWRWAERQQQHLDYPVPLVDHKQARLATLAAFEAAKRDSTRIPNRKEPSCY

SEQ ID NO: 752 - protein, 260 aa, Lolium perenne
MGRGRVELKRIENKINRQVTFSKRRNGLLKKAYELSVLCDAEVALIIFSSRGKLYEFGSAGTTKTLERYQHCCYNAQDSSSALSETQSWYQEMSKLKAKFEALQRTQRHLLGEDLGPLSVKELQQLEKQLECSLSQARQRKTQLMMEQVEELRRKERQLGEINRQLKHKLDAEGSSSNSFRAMQQITWAAGTVVDEGAGAYHMHHQQQPNHSAAMDCEPTLQIGYPHQFAAAEQAANNIPRSSAPGGENNFMLGWVLGAN

SEQ ID NO: 753 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDLRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVRYKLKDDANVNWTLYDLADRLQMRGWQVPAYPLPKSLENIIIQRYVCRADLGFNMAEEFIQDFQASIQELNNAHILFHDTQQSGVHGFTH

SEQ ID NO: 754 - protein, 454 aa, Oryza sativa
MVKGGREALLGGYEMGRTLGEGNFGKVKYARHLATGGHFAVKILDRGRVVSLRAGDQIRREIATLKLLRHPHVVRLHEVAASKTKIYMVLEFVNGGELFERIAVKGKLSEKEGRRLFQQLIDGVSYCHDRGVYHRDLKPENVLVDQKGNIKISDFGLSALPQHLGNDGLLHTTCGSPNYIAPEVLQNKGYDGSLSDIWSCGVILYVMLIGYLPFDDRNIVVLYQKIFKGDTQIPKWLSHSAQNLLRRILEPNPMKRIDMAGIKSHEWFQKDYIPVLPYDDDDEDVQFGARLPAKEQINDEPGDKNSHQINAFQLIGMASSLDLSGFFEDEEVSQRRIRFTSTHPPKDAFDKIESSATELGFQVQRGHSKLKLMRNCKGSKNPESFMVSAEVFELGPSVNVVELRKSNGDPALYRQLCERISSDMGARNTEQIFATASLEDDLQNSNAGTPLFAL

SEQ ID NO: 755 - protein, 331 aa, Arabidopsis thaliana
MPVISKASSTTTNSSIPSCSRIGGQLCVWPGLRQLCLRKSLLYGVMWLLSMPLKTLRGARKTLKITHFCSISNMPSSLKIELVPCSKDNYAYLLHDEDTGTVGVVDPSEAAPVIEALSRKNWNLTYILNTHHHDDHIGGNAELKERYGAKVIGSAVDKHRIPGIDILLKDSDKWMFAGHEVRILDTPGHTQGHISFYFPGSATIFTGDLIYSLSCGTLSEGTPEQMLSSLQKIVSLPDDTNIYCGRENTAGNLKFALSVEPKNETLQSYATRVAHLRSQGLPSIPTTVKVEKACNPFLRISSKDIRKSLSIPDSATEAEALRRIQRARDRF

SEQ ID NO: 756 - protein, 439 aa, Oryza sativa
MESKGKILMERYELGKLLGKGTFGKVHYAGNLESNQSVAIKMMDKQQVLKFGLSEQIRREITTMRLVAHKNIVQLHEVMATRNKIYFVMEYVKGGELFEKVAKRGKLTEVVAISTSSNSLSAVDYCHSRGVYHRDLKPENLLLDENENLKVSDFGLSALSESKRQDGLLHTTCGTPAYVAPEVISKIGYDGAKSDIWSCGVILFVLVGGYLPFQGPNLMEMYRKIQHGEFRCPGWFSRKLQNLLYKIMDPNPSTRISIQKIKESTWFRKGPEENRILKERTLNENPPKNVALVLGVRPKKNAHEDVKPMSVTNLNAFEIISFSKGFDLSGMFIVKEWRNEARFTSNKSASTIISKLEDVAKALNLRVRKKDNGVVKMQGRKEGRNGVLQFDIKIFEVTTSYHIIEMKQTSGDSLEYRQLLEEGIRPALKDIVLAWHGDE

SEQ ID NO: 757 - protein, 235 aa, Oryza sativa
MGRGKIVIRRIDNSTSRQVTFSKRRNGIFKKAKELAILCDAEVGLVIFSSTGRLYEYASTSMKSVIDRYGRAKEEQQHVANPNSELKFWQREAASLRQQLHSLQENHRQLMGQDLSGLGVKELQTLENQLEMSIRCIRTKKDQLMIDEIHELNRKGSLIHQENMELYRKVNLIRQENAELYKKLYETGAENEANRDSTTPYNFAVIEEANTPARLELNPPSQQNDAEQTTPPKLG

SEQ ID NO: 758 - protein, 508 aa, Unknown
  Candidatus Blochmannia ulcerosus
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKAGKPLLIIAEDVEGEALATLVVNNMRGIVKVTAVKAPGFGDRRKAMLQDIAILTAGTVISEEIGLELEKSTLEDMGQAKRVLITKDATTIIDGIGNKLAIDSRVAQINQQRDEATSDYDREKLQERVAKLAGGVAVIKVGAATEVEMKEKKARVEDALHATRAAVEEGVVAGGGVALIRVANAIGSLCGDNEDQNVGIKVARRAMEAPLRQIMENAGEDPSVIANNVRSGEGNTGYNAATEKYGNMIELGILDPTKVTRSALQYAA

SEQ ID NO: 759 - protein, 518 aa, Unknown
  Candidatus Blochmannia pennsylvanicus
  misc_feature (510)..(510): Xaa can be any naturally occurring amino acid
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKAGKPLLIIAEDVEGEALATLVVNNMRGIVKVTAVKAPGFGDRRKAMLQDIAVLTAGTVISEEIGLELEKATLEDMGQAKRVVITKDATTIIDGVGNKSAINSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAATEKYGNMIELGILDPTKVTRSALQYAASXAGLMITTE

SEQ ID NO: 760 - protein, 538 aa, Unknown
  primary endosymbiont of Sitophilus oryzae
MAAKDVKFGNDARVKMLRGVNVLADAVKVTLGPKGRNVVLDKSFGAPVITKDGVSVAREIELEDKFENMGAQMVKEVASKANDAAGDGTTTATVLAQSIVNEGLKAVAAGMNPMDLKRGIDKAVIAAVEELKKLSVPCSDSKAIAQVGTISANSDETVGTLIAEAMAKVGKEGVITVEEGSGLQDELDVVEGMQFDRGYLSPYFVNKPETGAIELESPFILLADKKISNIREMLPVLEAVAKAGKPLLIIAEDVEGEALATLVVNTMRGIVKVAAVKAPGFGDRRKAMLQDIAILTAGTVISEEIGLELEKATLEDMGQAKRVVITKDTTTIIDGVGDKALIDSRVTQINQQRDEATSDYDREKLQERVAKLAGGVAVIKVGAATEVEMKEKKARVEDALHATRAAVEEGVVAGGGVALIRVANSIAELRGDNEDQNVGIKVARRAMEAPLRQIVANAGEEPSVIANKVKAGEGNTGYNAATEEYGNMIDMGILDPTKVTRSALQYAASIAGLMITTECMVTDQPKEDKPDLGGMGGM

SEQ ID NO: 761 - protein, 541 aa, Glycine max
  misc_feature (194)..(194): Xaa can be any naturally occurring amino acid
  misc_feature (202)..(202): Xaa can be any naturally occurring amino acid
MRKYAADRFRHLFNRSLLLLRHRHHHNHHPFPYSSSVSSLSPFSRSRFLSSTPFSMASDSPFPVTAQNINPKVLKCEYAVRGEVVTLAQNLQKDLQANPGSHPFDEILYCNIGNPQSLGQQPITFFREVLALCDHPAILDKSETQGLFSTDAIQRAWQIVDQIPGRATGAYSHSQGVKGLRDTIAAGIEERDGXPANPDDIXMTDGASPAVHNMMQLLIRSENDGILCPIPQYPLYSASIALHGGCLVPYYLDEATGWGLEIPELKKQLEAAKSKGINVRALVVINPGNPTGQVLGEANQRDIVEFCKQEGLVLLADEVYQENVYVPEKKFHSFKKVSRSMGYGENDITLVSFQSVSKGYHGECGKRGGYMEVTGFSAEVREQIYKVASVNLCSNISGQILASLVMSPPKVGDESYDSFMAEKENILASLARRAKTLEDAFNKLEGVTCNKAEGAMYLFPQIRLSEKAIKAAEAANATPDNFYCKRLLNATGVVVVPGSGFGQVPGTWHFRCTILPPEEKIPAIVTRLTEFHEKFMDEFRD

SEQ ID NO: 762 - protein, 493 aa, Triticum aestivum
  misc_feature (376)..(376): Xaa can be any naturally occurring amino acid
MVLTHVQSDEAAASAAVFASRYVQEPVPSYELGARSISKDAAYQIIHDELLLDGSPRLNLASFVTTWMEPECDRLILEGMNKNYADMDEYPVTTELQNRCVNIIARLFNAPVGAGETAVGVGTVGSSEAIMLAGLAFKRRWQNRRKAEGKPYDKPNIVTGANVQVCWEKFARYFEVELKEVKLSEGCYVMDPDKAVEMVDENTIFVAAILGSTLTGEFEDVKRLNDLLAAKNKRTRWDTPIHVDAASGGFIAPFLYPELEWDFRLPLVKSINVSGHKYGLVYPGVGWVIWRNKEDLPDELIFHINYLGADQPTFTLNFSKGSSQIIAQYYQFLRLGFEGYRNVMDNCMENAMVLKEGLVRTGRFNIVSKDQGVPLXAFSLKDSSRHDEFEISEFLRRFGWIVPAYTMPPDAQHVTVLRVVIREDFSRTFAERLVIDIEKVLHELDALPSRSSGPALQHPNGDTVSEKDLARQREVVSVWKRAVAARKKTQGVC

SEQ ID NO: 763 - protein, 514 aa, Unknown
  Candidatus Blochmannia chromaiodes
  misc_feature (2)..(3): Xaa can be any naturally occurring amino acid
  misc_feature (510)..(510): Xaa can be any naturally occurring amino acid
  misc_feature (514)..(514): Xaa can be any naturally occurring amino acid
MXXKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKAGKPLLIIAEDVEGEALATLVVNNMRGIVKVTAVKAPGFGDRRKAMLQDIAVLTAGTVISEEIGLELEKATLEDMGQAKRVVITKDATTIIDGVGNKSAINSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAATEKYGNMIELGILDPTKVTRSALQYAASXAGLX

SEQ ID NO: 764 - protein, 322 aa, Schizosaccharomyces pombe
MDYDIDAIIEKLVKARNGKPSKQVQLSDAEIRYLCTTSRSIFLSQPMLLELEAPLKICGDIHGQYSDLLRLFEYGGYPPDANYLFLGDYVDRGKQSLEVICLLFAYKIKYPENFFLLRGNHEFASINRIYGFYDECKRRYSIKLWKTFTDCFNCMPVAAVIDEKIFCMHGGLSPDLNSLDQIQRIIRPTDIPDTGLLCDLVWSDPEKDLTGWGENDRGVSYTFGADVVSRFLQKHDLDLICRAHQVVEDGYEFFGKRQLVTIFSAPNYCGEFDNVGAMMSVNEDLLCSFQILKPAEKRQRVSQSSIKESKSATNSLKKSKNN

SEQ ID NO: 765 - protein, 545 aa, Unknown
  Candidatus Blochmannia castaneus
MAAKDVKFGNDARVKMLRGVNVLADAVKVTLGPKGRNVVLDKSFGAPVITKDGVSVAREIELEDRFENMGAQMVKEVASKANDSAGDGTTTATVLAQSIVNEGLKAVAAGMNPMDLKRGIDKAVVAAVEELKKLSVPCSGPKAIAQVGTISANSDETVGKLIAQAMDKVGKEGVITVEEGSGLQDELDVVEGMQFDRGYLSPYFVNKPESGTVELEHPFILLADKKISNIREVLPILESVAKAGKPLLIIAEDVEGEALATLVVNNMRGIVKVTAVKAPGFGDRRKAMLQDIAILTAGTVISEEIGLELEKATLEDMGQAKRIVITKDATTIIDGVGNKFAINSRVSQINQQRDEATSDYDREKLQERVAKLAGRVAVIKVGAATEVEMKEKKARVEDALHATRAAVEEGVVAGGGVALIRVANAIRNLCGNNEDQNVGIKVARRAMEAPLRQIMANAGEEPSVIANNVRSGEGNTGYNAATEKYGNMIELGILDPTKVTRSALQYAASIAGLMITTECMVTESPKEDKPDLGNAGGAGGMGGMM

SEQ ID NO: 766 - protein, 397 aa, Thermococcus litoralis
MVKASKRAMSIEYAIRDVVLPARELEKQGIKIIKLNIGDPVKFDFQPPEHMKKAYCEAIMEGHNYYGDSEGDRELREAIVEREKKKNGVDITPEDVQVTAAVTEALQFIFGALIDGGEEILIPGPSYPPYVGLVKFYGGVPKAYRTVEEEGWQPDIDDMRKKITEKTKAIAVINPNNPTGALYEKKTLQEIIDLAGEYDLPIISDEIYDLMTYEGKHVSPGSLTKDVPVIVMNGLSKVYFATGWRLGYMYFVDPENKLAEVREAIGKLARIRLCPNTPAQKAAIAGLRGPMDYLEEYMAKLKERRDYIYKRLNEMPGISTQKPQGAFYIFPKIEEGPWKSDKEFVLDVLHNAHVLFVHGSGFGEGGEMHFRSIFLAPVPVLEEAMDNLEKFMKERLG

SEQ ID NO: 767 - protein, 518 aa, Unknown
  Candidatus Blochmannia noveboracensis
  misc_feature (510)..(510): Xaa can be any naturally occurring amino acid
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKAGKPLLIIAEDVEGEALATLVVNNMRGIVKVTAVKAPGFGDRRKAMLQDIAVLTAGTVISEEIGLELEKATLEDMGQAKRVVITKDATTIIDGIGNKSAINSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAATEKYGNMIELGILDPTKVTRSALQYAASXAGLMITTE

SEQ ID NO: 768 - protein, 413 aa, Candida albicans
MSNSNPLKDSLVFQPIKVGDNTLSNRIVYCPTTRFRAAKGNEEPTYRHVPSDLMLKYYSDRAQYPGTLLVTEATLISNRAGGYDGCPKISTQEETKAWKKIVDAVHSKGSFLSCQFWFLGRVGYPSLLKHRKLDYLAPSPIYENEKHQKQAEKAGLPLREVTEQEIHDIIYNDYTIAAKNAIAAGFDFIELHGAHGYFIDQFLHECSNQRTDKYGGSIENRCRFVLELIDHLITIVGAHRLAIRLSPWAEVQGIVEKESPIPTFSYLINELQKRADQGNQLAYLSVVEPRVQGTITADIKTMKGDNEFVAEIWKGVLLRAGNYTYDAPEFKGIVADTSNNRTLVGFSRFFISNPDLVSKLKNNPSSLVKYDRKLFYEQFNWGYNTYGQDQPVDEEKERKKFPKVIGNIDEARL

SEQ ID NO: 769 - protein, 264 aa, Photobacterium profundum
MLNTLKRLEKKFMLTVQSIPAFNDNYIWLIHNSHNHCVVVDPGDATPVLKVLEEQSLTLDAILITHHHHDHIGGISELKRHYPNLNVVGPASEPIPGISQSVEDGDQVELFGERFMVLGVPGHTLGHVAYVGDGKLFCGDTLFSVGCGRLFEGTPAQMFQSLKKLAALPDETEIYCAHEYTSSNLAFALVAEQDNPHLQRYREDVSRMRAQGISTIPSTLRQEKLVNPFLRCEQPSIKKSVADKAFDDSDLETFAALRRWKDNF

SEQ ID NO: 770 - protein, 403 aa, Candida albicans
MTIDNEGIVIKPLGSTKLFQPIKLGFNTLSQRIAFAPSTRYRATKDNIPTDLQLEYYSQRSEYPGTLIITEATYTSRQGGLVPYVPGIYNDAQTKSWKKINDAIHANGSFSSVQLWYLGRVANPKNLKDAGLPFVGASSVYWNEESEKLAKEAGNELRELTEEEIDHIVEVEYPNAAKRAIEAGFDYIEVHSAHGYLLDQFLNLASNKRTDKYGCGSIENRARLLLRIIDKLIDIVGAERLAIRLSPWATFQNVDVEGEEIHSYIIDQLQERANSGNELAYISLVEPRVQASWDIAKENQVGSNEFILKHWKGKVIRAGTYAHELNKINEDINNDRTLIAFSRFFISNPDLVKKLHDGISLTPYERATFYNHDNFGYNTWIKYGENKVFNEQEERKKLGKPLA

SEQ ID NO: 771 - protein, 733 aa, Leifsonia xyli
MTPLPERAAALPGIDDAVLHAVATGSYHDPHSVLGQHQVAAAGIADPVTVIRTLRPLAEAVFAVLPTGAYLELAHLAHGIWQGVDIAGPGAYEIEARYADGSAWSADDPYRFLPTIGELDLHLIREGRHERLWTALGARLRDLGGVTGTAFTVWAPHARAVRVVGDFNGWDGTLHSLRNMGSSGVWELFVPGVGEGAIYKFDLLAQSGDWVRKIDPMAQLAETPPDTASRIAVSRHEWQDGEWMRRRAASDPHTGPMSIYELHFGSWRPDLGYREAADQLIDYLGALGYTHVEFLPLAEHPFGGSWGYQVTGYYAPTSRFGSPDDLKYLIDRLHRAGIGVLLDWVPGHFPKDDWALARFDGQPLYEHADPRRGEHADWGTYVFDYGNSQVRNFLVANALYWLEEFHIDGLRVDAVASMLYLDYSRDADGWEPNIHGGRENLEAIAFLQEVTATAYKRNPGTIVIAEESTSYPGVTAPTSSGGLGFGLKWNMGWMHDSLQYIREDPLYRSWHHSRITFSFVYAWSESFLLPISHDEVVHGKGSLLGKMPGDHWQQLANMRAYLAFMWAHPGKQLLFMGQEFGQPSEWSEERGLDWWILDQPAHRGLWNLVCELNAVYRGAPALWAHDNDPSGFEWLDGSDAAGNVLAFLRKDGRGEPIAVILNFSGAPHTEYRVGLPFAGGWEELLNTDADVFGGSGVGNFGGVTAVEEPWMGSPASAVLTLPPLGALFLKTGR

SEQ ID NO: 772 - protein, 541 aa, Thermoanaerobacter brockii
MAKQIKYGEEARRALERGVNAVADTVKVTLGPRGRNVVLDKKYGSPTVTNDGVTIAREIELEDPFENQGAQLLKEAATKTNDIAGDGTTTATLLAQAMVREGLKNLAAGANPMLLRRGIAKAVDAAVEGLKRISKPIDNKESIAHVASISAADEEIGKLIAEAMDKVGKDGVITVEESKTLGTTLEVVEGMQFDRGYISPYMVTDAEKMEAVLEEPVILITDKKISNIQDLLPLLEQIVQQGKKLLIIADDVEGEALATLIVNKLRGTFTCVAVKAPGFGDRRKEMLQDIAILTGGQVISEELGYDLKDVRLDMLGRARQVKVTKEYTTIVGGAGDPSEIKKRVNQIKAQIEETTSDYDREKLQERLAKLAGGVAVIQAGAATETELKEKKHRIEDALAATKAAVEEGIVPGGGIALLNVIEDVQKVVDSLEGDFKTGAKIVLRALEEPVRQIATNAGVDGSVIVEKIKAAKDPNFGYDAYKEEFTDMFKAGIVDPTKVTRTALQNAASIASMILTTEAIVVDIPEKNTGMPNPGAGMDMM

SEQ ID NO: 773 - protein, 548 aa, Stenotrophomonas maltophilia
  misc_feature (482)..(482): Xaa can be any naturally occurring amino acid
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIILKVMKAVAAGMNPMDLKRGIDKAVTVAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAVXRRIRQHDRHGYPGSNQITRSALQYAASVAGLMITTECMVTDLPKNDAADLGAAGGMGGMGGMGGMM

SEQ ID NO: 774 - protein, 541 aa, Cyanophora paradoxa
MAKQILYHESARRALEKGMDILAEAVAVTLGPKGRNVVLEKKFGAPQIVNDGVTIAKEIELEDHIENTGVALIRQAASKTNDVAGDGTTTATVLAYAMVKEGMRNVAAGANPMAIKRGIDRATQKVVETIAAHAKPVEDSRAITQVASISAGNDDEVGKMIADAIEKVGKEGVISLEEGKSTTTELEITEGMRFDKGYISPYFVTDPERMEVIQKDAMFLITDKKITLVQDLVPILEQVARARKPLFIIAEDIEKEALATLVVNKLRGNLNVSAVKAPGFGDRRKAMMQDIAVLTNTQVISEQTGLRLDSIKLDVLGKARQVNITKDYTTVIAEGNEEGVSARCEQIRRQIEETDSAYEKEKLQERLAKLAGGVAVIKVGAATETEMKDKKLRLEDAINATKAAVEEGIVPGGGTTLAHLAIELENWVQSNLEHEELIGGMIVARSLTAPLKRIVENAGQNGAVIAEQVKDKPFNIGYNAANAQFVDMFEAGIVDPAKVTRSGLQNAASIAGMVLTTECIVVDKAESQQKAASVNRNSFDY

SEQ ID NO: 775 - protein, 569 aa, Euglena gracilis
MNRAGVLARRGYSSKGKDILFGVDARVKMLAGVNRLSQAVSVTLGPKGRNVVIEQPFGAPKITKDGVTVAKAIEFKDSFENLGAQLVRQVANTTNEIAGDGTTTSTVLANTIFSEGYKAVTQGTSPVDMKRGIDRAVEVVLQSLTEQSKTIVSKEEVTQVATISANGDVEIGQLIGHAMEKVGKAGVITVSDGKTLDTELEVVEGMSLDRGYISPYFVTNAKTQKVEIEDAFILLCQKKVSTIQQILPVLEHIAKANRPLVIIADDVDSEALATLIINKINGKLKVCAVKAPGFGDNKTNMLHDVAIFTGGEVYNEELGMNLEQHFDHRILGFAKKVSVGKDQTIILNGAGDPKAVEERKELIQGMLGKTDSSYEKEKLNERLAKLSGGVAVIKVGGASDVEVGEKKDRVTDALNATRAAVSEGIVPGGGAALLYASSALAELAADPTLTEDQKTGVRIVMSAIKLPAITIVKNAGGEGAVVIHQLLAEKKMQQGYDAQQGKYVNMFEAGIIDPAKVVKTALVDAASVAGLMITTEAAITDIPAPAPAAGGGMDGMGGMGGMGGMGGMY

SEQ ID NO: 776 - protein, 580 aa, Chlamydomonas reinhardtii
MAQSQLAKGSRQTTGRPFQNKPARAARRLVIRAADAKEIVFDQESRRRLQAGINKVADAVGVTLGPRGRNVVLEQKFGVPQVINDGVSIRRAIELKDPVENAGAQLIKEVAGRTNDAAGDGTTTASVLAREMIHYGLQSVTAGANPIAVKRGLDKTAEYLVAKLKEHAKPVKGRDDIKNVASISAGNDNAIGEMIADALDKVGSNGVLSIETSNSTETVVEVQEGMEIDRGYISPQFVTNQERLLVEYDNCRVLVTDQKIDAIRDIIPILEQVTRLNAPLLIIAEDVSGEALATLVVNKLRGVLNVCAIKAPGFGERRKSLLQDIAIVTGAEFIAKDLGMKVEQAVVEQLGVARKVTVANNTTTLIADAASKDEIEMRIAQLKKELAETDSVYDTEKLSERIAKLSGGVAVIKVGAATEAELEDRKLRIEDAKNATFAAVEEGIVPGGGAALLHLSELVPAFKETLTDAEEKLGADIVMKSLRAPCRLIADNAGVEGEVIVQRLLGKPFEVGYNAMIDKVENLLDAGVIDPAKVTRNGLLNSVSIAGIMLTTQAVMVEKHKPSEIPGGMTASGMPSGMTI

SEQ ID NO: 777 - protein, 479 aa, Unknown
  Nostoc sp. PCC 7120
MSDLVLFWHRRDLRIADNIGLAAARQQSSKVVGVFCLDPNILERDDVAPARVTYMIGSLQELQQRYVQAGSQLLILHGDPVQAIPHLAEALNAKAVFWNWDVEPYSQTRDRAILDILKDKGIQFLTHKWDQILHSPDEIRSGSNTPYTVYTPFWKNWSSKPKAKPVETLQNAEGLTESEQELAQKAGVKTLPTAKDLGFFWDADLIIAPGEAAAQAKLEEFTAKAITEYQEQRNFPAVDGTSQLSAALKFGVIGIRTVWQATLEALENSRSEEASAAIRTWQQELAWREFYQHAMYNFPELADGAYRETFKNFPWETNEEHFQAWREGKTGYPIVDAAMRQMNESGWMHNRCRMIVASFLTKDLLINPQLGEKYFMQKLIDGDLSANNGGWQWSASSGMDPKPLRIFNPASQSQKFDPDAEYIRRWVPELRSMDTEYLVTGKITPLERHAVGYVKPIVDHQKQQQLFKQRYQQQKATSL

SEQ ID NO: 778 - protein, 518 aa, Unknown
  Candidatus Blochmannia americanus
  misc_feature (509)..(514): Xaa can be any naturally occurring amino acid
  misc_feature (516)..(518): Xaa can be any naturally occurring amino acid
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKAGKPLLIIAEDVEGEALATLVVNNMRGIVKVTAVKAPGFGDRRKAMLQDIAILTAGTVISEEIGLELEKATLEDMGQAKRIVITKDATTIIDGVGNKFSINSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAATEKYGNMIELGILDPTKVTRSALQYAAXXXXXXIXXX

SEQ ID NO: 779 - protein, 542 aa, Ruminococcus flavefaciens
MAKDIKYGEDARKALQAGIDKLADTVRITMGPKGRNVVLDKKFGAPLITNDGVTIAKDIELEDAFENMGAQLVKEVATKTNDAAGDGTTTATLLAQTIVREGMKNIAAGANPMVLKKGIAKAVDAAVKAIVDNSKAVQGSEDIARVGTVSSADENVGKLIAEAMEKVTSDGVITIEESKTAETYSEVVEGMQFDRGYISPLHGLQMPDKMEAVYDDAYVLITDKKISSIQEDPPALEQIVKMGQKVVIIAEDVEGEALTNYHPQQPSRGTFKVAAVKAPGFGDRRKEMLKDIAVLTGGEVISSELGLELSETQLSQLGQAKQVVIQKENTIIVDGAGDKEAIKSRVAQIRAAIENTTSDFDREKLQERLAKLAGGVAVIKVGAATEIEMKEKKLRIEDALAATKAAVEEGIVAGGGTAFVNAIPAVIKLVPTLEGDEKTGAKIILKALEAPVRQIAENAGLEGSVIVDKIIRSRKVGYGFDAYNEVYTDMIPAGIVDPTKVTRSALQNAASVASMVLTTESLVADIKEDAPAAPAMPAGGMY

SEQ ID NO: 780 - protein, 546 aa, Acetobacter aceti
MAAKDVKFGADARQRMRAGVDILADAVKVTLGPKGRNVVLDKSFGAPRITKDGVSVAKEIELADKFENMGAQMLREVASKTNDIAGDGTTTATVLAQAIVREGHKAVAAGMNPMDLKRGIDKAVAVVIEELKKNAKKVTTPAETAQVGTISANGESEIGQMISEAMQKVGSEGVITVEEAKHFQTELDVVEGMQFDRGYISPYFVTNPEKMTADLENPYILIHEKKLSSLQPMLPLLESVVQSGRPLLIIAEDVDGEALATLVVNKLRGGLKIAAVKAPGFGDRRNVMLEDIAILTGGQVISEDLGIKLETVTLNMLGTAKKVHIDKENTTIVDGAGKADDIKGRVKQIRAQIEETSSDYDREKLQERLAKLAGGVAVIRVGGSTEVEVKERKDRVDDALHATRAAVEEGIVPGGGTALARATLKLEGLHYHNDDQRVGGDIIRRALQAPLRQIAHNAGEDGAVIANKVLENSDYNFGFDAQAGEYKNLVEAGIIDPAKVVRTALQDAASVAGLLITTEAMVAERPEKKAAPAGGPDMGGMGGMDF

SEQ ID NO: 781 - protein, 505 aa, Unknown
  Candidatus Blochmannia nearcticus
  misc_feature (3)..(3): Xaa can be any naturally occurring amino acid
  misc_feature (481)..(481): Xaa can be any naturally occurring amino acid
MAXKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKAGKPLLIIAEDVEGEALATLVVNNMRGIVKVTAVKAPGFGDRRKAMLQDIAILTAGTVISEEIGLELEKSTLEDMGQAKRVVITKDATTIIDGVGNKSAINSRIAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAXTEKYGNMIELGILDPTKVTRSALQ

SEQ ID NO: 782 - protein, 140 aa, Oryza sativa
MRKYRVAGLVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANA

SEQ ID NO: 783 - protein, 1208 aa, Magnaporthe grisea
MEVRPQARVPPRPVLEEASMRTNYSISQNSATPPNYQHGGLKTENIRPAQPQKTRRDIPVSSSHVPLNPRLYEIREEAQSTPQSKRESQASTASYKSSSSNTFRKPKTHVGPWQLGKTLGKGSSARVRLARHTSTHQYVAVKIVAKSTCKMTQAGSLAKLDEIDSAAPEKVEGMRRMPIALEREVAILKLIEHPNIVKLYDIWENSNEIYLILEYVERGDLFDFISKHGPMPEEEAIFVFRQIMSALEYCHSYGICHRDLKPENILLKSNGQVKIADFGMAALHQGPRTPLWTFCGSPHYAAPELLREKAYRGEKSDIWSMGVILFAMMAARLPFDDEDMNLMFAKARKAIYHMPSFFSDEAKDLIHRLLQVDPRKRLSMRQMWQHPVVWKYGYLDELGGEGIPEVPNPRTRQEIKPLDLCDIDPQILRPIQSMWHTLSEDELVKKLISDDYRERQLENYDPSLTHSPSDYHHIRPPLWLTKVSTRQFMTNKANGQGRSISKFTVISNVTETGTGANLGTVRSYDPYKSPAVKQPQATHARIVIHRDSTDTDRNAASLGSTSHRRPRANSTGSWKRPARRSQLGSRILTPRSTASSVQSSRKFHARSRTSSRQKRAMDFSTARRKAAAAKLSNQQTLLGTDGSKTVTGWNIQCSSDPDIPGDTADSSNARLRSKDRLHEELRHFSSSIAKDCDEAFNSSLLSVSQFDGDRSRQGSPFSLSLGTPVSATPVTPVVTPTIPRPSARPWDSRPLPPTPPSSSHEKESAVNFGENPSILARRGQPPTQGYNLRSGPVAMTPTPSDRRVVSAPVHGGQYGGCATGKLPSIEEATPNTIQDEVNRSRIVSLPAKPVATAPTSNEARGLEFLSNAEQTIRIVHSPSAQRESGITRRPHPIQANAKPSKMVGTSTGPVKQASIDLYHADDSIISHRNAQLAQTSSHGSASTFAMRKKTSSWFKRLSRESKGSKGSLCDELDDTKSIDVPHGLTSGPIKNERDNSSINMSHRPPEKTSNKKKSFFLPFWRHKSEPRMSLAEPDFEESPSPETNAAVKSHKTSGNNLLNFGDAESAERMIKPQQNWLARLFRVKPVTRVICLSISRRRARQEVAILLRDWRKYGIRDVEVDKKRNVVFARLSSKNHLNIKEVALACEIITVIEHGKRNHLSIVRFTQEKGAASSFQRVVDTMRDVLGNRNLLVTDKSKAKMMIKTLNS

SEQ ID NO: 784 - protein, 508 aa, Unknown
  Candidatus Blochmannia floridanus
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKSGKPLLIIAEDVEGEALATLVVNNMRGIVKVTAVKAPGFGDRRKAMLQDIAILTSGTVISEEIGLELEKATLEDMGQAKRVLITKDATTIIDGVGNKSSIDSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAATEKYGNMIELGILDPTKVTRSALQYAA

SEQ ID NO: 785 - protein, 492 aa, Nicotiana tabacum
MDPYKYRPSSAFNSPFCTTNSGAPVFNNNSSLTVGARGPVLLEDYHLVEKLANFDRERVPERVVHARGASAKGFFEVTHDITHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHVPESLHMFTFLFDDIGIPQDYRHMDGSGVHTFTLINKAGKSTYVKFHWKPTCGVKSLLEEEAARIGGANHSHATQDLYDSIAAGNYPEWKLFIQTMDPDHEDRFDFDPLDVTKTWPEDILPLQPVGRLVLNKNIDNFFNENEQLAFCPSIVVPGVYYSDDKMLQTRIFSYSDTQRYRLGPNYLQLPANAPKCAHHNNHYDGSMNFMHRDEEIDYFPSRYDPVRHAEKYPIPSTMCTGKREKCVIQKENNFKQPGDRYRSFTPDRQERFIRRWVEALSDPRITYEIRTIWISYWSQADKSLGQKLASRLNVRPSI

SEQ ID NO: 786 - protein, 255 aa, Silicibacter pomeroyi
MPLEIVTVPCLSDNYAYLIHDADAGKTALVDAPEAAPIQSELDRRGWSLDQVWLTHHHWDHVDGLAALRDRYKPTVIGAEADAHRLPPLDLAVSEGDRFDLGGAPVEVLDVSGHTVGHIAFHLPTGKAVFTADSLMALGCGRLFEGTPDQMWASLSKLAALPDDTLVCSGHEYTQSNARFALSVDPDNAALKTRAAEIDQARAEGRPTVPSLLSLEKSTNPFLRAADPGIQSLLGMQGADPARVFAEIRARKDHF

SEQ ID NO: 787 - protein, 241 aa, Unknown
  Petunia x hybrida
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLQDLQRKEHALNEANRTLKQRLMEGSTLNLQWQQNAQDVGYGRQATQTQGDGFFHPLECEPTLQIGYQNDPITVGGAGPSVNNYMAGWLP

SEQ ID NO: 788 - protein, 187 aa, Glycine max
  misc_feature (146)..(146): Xaa can be any naturally occurring amino acid
  misc_feature (153)..(153): Xaa can be any naturally occurring amino acid
MLHMFSKASSAMATFPCSRVKSGLCVWPDVRQLCFRKGMLYGFMRLFSTPLKTLRGASRSLRVTQFCSVANMSSSLQIELVPCLKDNYAYLLHDVDTGTVGVVDPSEAVPIIDALSRKNRNLTYILNTHHHHDHTGGNVELKARYXAKVIGSXTDKERIPGIDIHLNDGDKWMFAGHEVRVMDTPGH

SEQ ID NO: 789 - protein, 338 aa, Bacillus subtilis
  misc_feature (1)..(1): Xaa can be any naturally occurring amino acid
  misc_feature (14)..(14): Xaa can be any naturally occurring amino acid
  misc_feature (22)..(22): Xaa can be any naturally occurring amino acid
  misc_feature (25)..(25): Xaa can be any naturally occurring amino acid
  misc_feature (27)..(27): Xaa can be any naturally occurring amino acid
  misc_feature (42)..(42): Xaa can be any naturally occurring amino acid
  misc_feature (134)..(134): Xaa can be any naturally occurring amino acid
  misc_feature (238)..(238): Xaa can be any naturally occurring amino acid
  misc_feature (278)..(278): Xaa can be any naturally occurring amino acid
  misc_feature (285)..(285): Xaa can be any naturally occurring amino acid
  misc_feature (291)..(291): Xaa can be any naturally occurring amino acid
XARKLFTPITIKDXTLKNRIVXSPXCXYSSHEKDGKLTPFHXAHYISRAIGQVGLIIVEASAVNPQGRITDQDLGIWSDEHIEGFAKLTEQVKEQGSKIGIQLAHAGRKAELEGDIFAPSAIAFDEQSATPVEXSAEKVKETVQEFKQAAARAKEAGFDVIEIHAAHGYLIHEFLSPLSNHRTDEYGGSPENRYRFLREIIDEVKQVWDGPLFVRVSASDYTDKGLDIADHIGFAKWXKEQGVDLIDCSSGALVHADINVFPGYQVSFAEKIREQADXATGAVGXITDGSXAEEILQNGRADLIFIGRELLRDPFFARTAAKQLNTEIPAPVQYERGW

SEQ ID NO: 790 - protein, 251 aa, Salmonella enterica
MNLNSIPAFQDNYIWVLTNDEGRCVIVDPGEAAPVLKAIAAHKWMPEAIFLTHHHYDHVGGVKELLQHFPQMTVYGPAETQDKGATHLVGDGDTIRVLGEKFTLFATPGHTLGHVCYFSHPYLFCGDTLFSGGCGRLFEGTPSQMYQSLMKINSLPDDTLICSAHEYTLANIKFALSILPHDSFINEYYRKVKELRVKKQMTLPVILKNERKINLFLRTEDIDLINEINKETILQQPEARFAWLRSKKDTF

SEQ ID NO: 791 - protein, 485 aa, Oryza sativa
MFGGGGGGGRKPLDYEELNENVKKVQYAVRGELYLRASELQKEGKKIIFTNVGNPHALGQKPLTFPRQVVALCQAPFLLDDPNVGLIFPADAIARAKHYLAMAPGGLGAYSDSRGIPGIRKEVAEFIERRDGYPSDPELIYLTDGASKGVMQMLNTIIRNERDGILVPVPQYPLYSAAISLFGGSLVPYYLEEEANWGLDFVNLRQTVASARSKGITVRAMVIINPGNPTGQCLSEGNIKELLKFCFHENLVLLADEVYQQNIYQDERPFISARKVLFDMGPPMSREVQLVSFHTVSKGYWGECGQRGGYFEMTNLPPKTVDEIYKVASIALSPNVPGQIFMGLMVNPPKPGDISYLKFSAESKSILESLRRRARLMTDGFNSCRNVVCNFTEGAMYSFPQIRLPPKAIDAAKRAGKAADVFYCLKLLEATGISTVPGSGFGQKEGVFHLRTTILPAEEDMPAIMTSFKKFNDTFMDQYDGYSRM

SEQ ID NO: 792 - protein, 439 aa, Oryza sativa
MESRGKILMERYELGRLLGKGTFGKVHYARNLESNQSVAIKMMDKQQVLKVGLSEQIRREITTMRLVAHKNIVQLHEVMATRNKIYFVMEYVKGGELFEKVAKRGKLTEVVAHKYFQQLISAVDYCHSRGVYHRDLKPENLLLDENENLKVSDFGLSALSESKRQDGLLHTTCGTPAYVAPEVISKIGYDGAKSDIWSCGVILFVLVAGYLPFQGPNLMEMYRKIQHGEFRCPGWFSRKLQKLLYKIMDPNPSTRISIQKIKESTWFRKGPEENRILKERTLNENTTKNVALVLGVRRKKNAHEDVKPMSVTNLNAFEIISFSKGFDLSGMFIVKEWRNEARFTSDKSASTIISKLEDVAKALNLRVRKKDNGVVKMQGRKEGRNGVLQFDIEIFEVTTSYHIIEMKQTSGDSLEYRQLLEEGIRPALKDIVLAWHGDE

SEQ ID NO: 793 - protein, 453 aa, Ralstonia metallidurans
MPPGLPRLASLIADAPPDAQDNPEIPRFRCRQRPAACPDIANTAVKPIQKSHKLQNVCYDIRGPVLEKAKQMEEEGHKIIKLNIGNLAVFGFDAPEEIQQDMMRNLPNSAGYSDSKGIFAARKAIMHYTQEKKIQGVGLDDIYVGNGASELIVMAMNALLNSGDEMLVPAPDYPLWTAAVSLSGGTPVHYVCDEANEWMPDLDDIRRKITPNTRGIVIINPNNPTGALYSDELLKEIVAIAREHGLIIFADEIYDKVLYDGNTHTSIGSLSTDVLTVTFNGLSKNYRSCGYRAGWMVVSGDKRPALDYIEGLNMLSSMRLCANVPGQWAIQTALGGYQSINDLVTEGGRLRRQRDLAYELITKIPGVTCVKPKAALYLFPKLDLSMYPIQDDQEFIYELLQESKVLLVQGTGFNWGAPDHFRIVFLPHEEDLREAITRVGRFLESYRKRHGTA

SEQ ID NO: 794 - protein, 210 aa, Unknown
  Gerbera hybrid cv. 'Terra Regina'
MGRGKVQLKRIENKINRQVTFSKRRGGLLKKAHEISVLCDAEVALIVFSAKGKLFEYSTDSCMENILDRYEQYSNIDRQHVAVDTDSPIRWTQECNKLKSRAELLQRNLRHYMGEDIESLGLREIQNLEQQLDTALKRIHSKKNQLLHQSISELQKKEKAIQEQNNTLIKNIKEKEKTITQKAQWEPHNYGPNTTPLLFSLPPHSSLNIG

SEQ ID NO: 795 - protein, 209 aa, Bacillus thuringiensis
MKWIQMPLGPLQTNAYILKNDQNECVIFDPGHEGEKLVTYLQEEQLKPLAVLLTHAHFDHIGAVDAVREAFHIPVYVHKEEEDWLGDATVNGSQIFMMNRSITAKPADHIIDAEGTLAIGSFNFEIFETPGHSPGSISYYCKEANAVFSGDVLFQMSIGRTDLPGGSFAELIGSIEEKLFVLPDETAVLCGHGPETSIGFEKENNPFLQ

SEQ ID NO: 796 - protein, 479 aa, Triticum aestivum
MMGRKALDYEELNENVKKVQYAVRGELYLRASELQKEGKRIIFTNVGNPHALGQKPLTFPRQVVALCQAPFLLDDPNVGLIFPADAIARAKHYLSLAPGGLGAYSDSRGIPGVRQEVAEFIQRRDGYPSDPELIYLTDGASKGVMQMLNAIIRNERDGILVPVPQYPLYSAAISLFGGSLVPYYLEEEANWGLDLVSTRQSVAEARSKGITVRAMVIINPGNPTGQCLSEANIRELLNFCYQENLVLLADEVYQQNVYQDERPFISARKVMFDMGPPVSREVQLISFHTVSKGYWGECGQRGGYFEMTNIPPKTVDEIYKVASIALSPNVPGQIFMGLMVNPPKPGDISYLKYSAESKSILESLRRRAQIMTDGFNSCRNVVCNFTEGAMYSFPQIRLPQRAMDVAKSAGKAPDVYYCLKLLEATGISTVPGSGFGQKEGVFHLRTTILPAEEDMPAIMSSFKKFNDSFMEQYQDHSRL

SEQ ID NO: 797 - protein, 323 aa, Yarrowia lipolytica
MAGGPTLKLNSGHEIPQIGLGTWLSKPNEVAKAVESALKDGYRHIDGATIYQNENEVGAGWKASGVPREEIFLTTKNWNNARTKEGVKKQLDQSLKELQTDYVDLLLIHWPVVFKTGEELFPHNADGTVALGEVPVEETWEAFEELVKEGKVKSIGVSNFTEERIEKLLKTAKIPPAVNQIEYHPYLQQPGLAKYLASKNIVLEAYSPLGNNTYGFPRAIDDERVIDLAKKKGKDAAALIVNWIRSKNHVVLPKSVTPSRIKSNFEVFDLSPEEIKFLDSLDEESRRNDPIEWGVDIFGTATPEEIKKRVDEAAKKYLAEQKK

SEQ ID NO: 798 - protein, 485 aa, Gluconobacter oxydans
MKFRSGLLLGTAFLAGLAVGPGALRLAGSGDFPGAALAREISHDNSAETVRLLTLLGTVMDVVKAEYVHPVSDKDLINNALDGMVGNLDPHSSYMTAAQFHDMQTEISGKFGGLGLQVQGESGHVRVVSPIDGTPAARAGIQPGDFITMVDHKSIDDLTLDQAVRKMRGDPGTKISLTIVRPKTGKTLTFDMTREIVHVQIVKSALYGSTGYIRLTEFDDDLESAMHAAFDKLKAQATKASGGKLTGIILDLRSNPGGKLDQAIAVSDDFIKDGEIVSIRGRHAENNQRWDAKGTDITNGLPIVVLTNGGSASASEIVAGALKDHHRAIILGEKTFGKGSVQTLIPIGDQGAVRLTTARYYTPSGRSIQGLGITPDIPVAETKDDDAYGYREADLSHILTNIGGNRTNETPRTDIPPIAKSIPKMPDASWPAFDATKPATDFQLQQAIKVINAMAGLSNPAPATAPATEVKAAAPTAPKPPEAHH

SEQ ID NO: 799 - protein, 670 aa, Bacteroides fragilis
MEKTLNLIKNDPWLEPYKDAIVGRFEHAMDKKAELTNGGKSTLSDFASGYLYFGLHRTDKGWIFREWAPNASHIYMVGTFSNWEEKPAYKLKRLKNGSWEIKLPIDTIQHGDLYKLHVYWEGGQGERIPAWANRVVQDDNTKIFSAQVWAPEKPFKFKKKTFKPSTDPLLIYECHIGMAQQEEKVGTYNEFREKILPRIAKEGYNCIQIMAIQEHPYYGSFGYHVSSFFAASSRFGTPEELKQLIDTAHGLGIAVIMDIVHSHAVKNEVEGLGNFAGDPNQYFYPGGRREHPAWDSLCFDYGKNEVMHFLLSNCKYWLEEYHFDGFRFDGVTSMLYYSHGLGEAFCNYGDYFNGHQDDNAICYLTLANELIHEVNPKAITIAEEVSGMPGLAAKVEDGGYGFDYRMAMNIPDYWIKTIKEKIDEDWKPSSMFWEVTNRRQDEKTISYAESHDQALVGDKTIIFRLIDADMYWHMQKGDENYIVHRGVALHKMIRLLTASTINGGYLNFMGNEFGHPEWIDFPREGNGWSCKYARRQWDLVDNKNLTYHYLGDFDADMLKVIKSVKNIQQTPVQEIWHNDGDQVLAYQRKDLVFVFNFNPSQSFTDYGFLVTPGTYEVVLNTDNIIYGGNGLSDDSVKHFTLPDPLYKKEKKEWLKLYIPARTAMVLRRTK

SEQ ID NO: 800 - protein, 312 aa, Saccharomyces cerevisiae
MPATLKNSSATLKLNTGASIPVLGFGTWRSVDNNGYHSVIAALKAGYRHIDAAAIYLNEEEVGRAIKDSGVPREEIFITTKLWGTEQRDPEAALNKSLKRLGLDYVDLYLMHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 801 - protein, 225 aa, Glycine max
  misc_feature (200)..(200): Xaa can be any naturally occurring amino acid
SGIKQRLLSFIFQGLWNEERDDTLRIQRLRKKFYFHFQDYVDLIIWKVQFLDRHHLLIKFGSVDGGVSRNADHHPAFVAVYNMDTTEIVSFYQNSADELYLLFEQFCDHFHATSRNSMYMNFISSHSNNIHALEQLRSIKDKASSSAQFVKKMLASLPFSCQSQSPSPYFDQSLFRFDDKLISATDRHRQSTDHPIKFIXGGPEAGSMDGRAKKNSSFLFIQFWP

SEQ ID NO: 802 - protein, 512 aa, Schizosaccharomyces pombe
MNSKDSNTVPVYTTNTGCPIFNPMAAARVGKGGPVLLQDSHLIDVFQHFDRERIPERVVHAKGSGAFGEFECTDDITKYTKHTMFSKVGKKTPMVARFSTVGGERGTPDTARDPRGFALKFYTDEGIFDMVGNNTPVFFLRDPAKFPLFIHTQKRNPQNDMKDATMFWDYLSQNAESIHQVMILFSDLGGTPYSYRFMDGFSSHTYKFVNDKGEFYYCKWHFITNQGTKGLTNEEAAALDGSNPDHARQDLFEAIERGDYPSWTLYVQVMTPQEAEKYRYNIFDLTKVWPHKDVPMQRVGRFTLNQNPTNFFADIEQAGFSPSHMVPGIEVSADPVLQVRTFSYPDTHRHRLGANFEQIPVNSPKCPVFNYSRDGPMNVNGNQGNWPNYPSSIRPLAKVQYEPDEGHEKWVGQVTYHMDEITDVDFEQPRAFWQNVLGKKPGQQDNFVKNVAGHLSGAISPVRERQYGVFTRVDSELGRRIREATEAEVKKMEEKAPKPINKGEPHMFQGSS

SEQ ID NO: 803 - protein, 270 aa, Unknown
  Exiguobacterium sp. 255-15
MQYAKLSNGVTIPQIGFGVWQVDEETEAPAAVAEALRVGYRHIDTAAVYKNERGVAKGIKESGVNREDLFLTSKVWNDDIRAGRTKEAFAESLERLETDYLDLYLIHWPVEGYIEAWKAMVELYEAGKIKAIGVSNFKEHHLDTLAEEGLMTPMINQVELHPQLPQHELHEYLQDHSIQVEAWSPLMQGKFLEINDFKEIAEKHGKSPSQVVLRWHLDNGIVALPKSVTPERIAENFDVFDFQLDADDLEKIDRLATDVRLGPDPDEIDF

SEQ ID NO: 804 - protein, 504 aa, Vibrio parahaemolyticus
MQMSKSFLLITVGLASTSLQAQTLTRDNGAPVGDNQNSITAGENGSVLLQDVHLIQKLQRFARERIPERVVHARGTGAHGEFVASGDFSDLTVSAPFTEKGKVTPVFVRFSTVIHSKGSPETLRDPRGFATKFYTEQGNWDLVGNNLPVFFIRDSIKFPDMVHSLKPSPVTNVQDPNRFFDFFSHEPSATHMLTWVYSNLGTPASYRTMDGFGVHAYKWINQQGDVNYVKFQWKSQQGIKSLRPNKVTEMQGKDFNHLTNDLYAAIGRGNYPKWDLYVKVLSPEALSKLDYNGLDATKVWLNVPDRKVGTMTLNRLPENFFLETEQSAFAPSNLIPGIEPSEDRLLQGRLFAYADTQLYRLGANLFQLPVNRPLTSVNNHNQNGLSNNAQLSNGDVNYEPSRKLNLAEDNQFKAVETKLVGTVQQKAISKPRDFYQAGVLYRSMNEQDRSDLIANLAGDLNKVIDKDIKATMVSYFYRADKEYGSRLAEATDTNLSQVKNKAMM

SEQ ID NO: 805 - protein, 392 aa, Barnebya dispar
DLEPVNPADVPVTAAGALKSYKFAAKAISRLQSLPSGNIFLLCDVLVKEVRDLTGYDRVMVYKFHEDEHGEVVSECRRSDLESYLGLHYPATDIPQASRFLFMKNKLRMICDCLAPPVKVIQDENLPQPLSLCGSTLRSPHGCHAQYMTNMGTIASLVMSVTINEDDDMKDCEQPQMPRKLWGLVVCHHTSPRFIPFPLRYACEFLIQVFGVQINKEVELAAQVREKHILRIQTLLCDMLLRDAPVAIITQSPNVMDLVRCDGAALYYKNKFWLLGVTPTEAQIRDIAEWLLECHSGNTGLSTDSLMEAGYPGASVLGDAVCGMAAISITSRDFLFWFRSHTAKEIKWGGAKHDPDDKDDGRKMHPRSSFKAFLEVVKWRSLPWEDVEMDAI

SEQ ID NO: 806 - protein, 206 aa, Symbiobacterium thermophilum
MQLWHRALGAFMANCYIVACGETRQALVIDPGVPDPWIQSCVMENDLTVVGIVLTHGHLDHIGGVDWVKGWSGAPVAIHEADADCLTSPARNGSLYFGMTVQASPADRLLRDGDEVEAGGLRFRVIHTPGHSPGGICLYRPGHLLAGDTLFAGSIGRTDLPGGDYHTLIQSIKERLLTLPPDTAVYPGHGPSTTIGDEKAYNPFLA

SEQ ID NO: 807 - protein, 377 aa, Oryza sativa
MGRDKARRLSGSRHFRQRVVLATLTSTAITIDDIRSGGAAPGLRPHEVSLLHLLHKISDHHSLDLNETGTKLRYKPGVIVGGRDLEHDCGVHRGIGYFLEPLILLGLFARAPISIRLKGITNDTKDPSVDTFRMVTLHMLKQFGVPLEGLELKIESRGAPPLGGGEVFLRVPNIKSTLKAANWADEGMVKRIRGVSFSTRVSPQIENRIIYAARGIFNRFIPDVHIFTDHRSGSAGGRSAGYGVSVVAETTTGCLLSADATVSYPNVDEMNEESENLELTSPEDLGVQVASMLLEEVAQGGVVDSAHQGLLFILCALSPPDVSKVRVGQLTPYAIETLRNIRDFLDVKFIIKPDPNSNTVTLKCVGAGVKNLARKTS

SEQ ID NO: 808 - protein, 392 aa, Blepharandra heteropetala
DLEPVNPADVPVTAAGALKSYKLAARAISRLQSLPSGNISLLCDVLVKEVRDLTGYDRVMVYKFHEDEHGEVISECRRPDLEAYLGLHYPATDIPQASRFLFMKNKVRMICDCLAPAVKVIQDERLPQALSLCGSTLRSPHGCHAQYMANMGTIASLVMSVIINEDNDMMDGDQQHIARKLWGLVVCHHTSPRFVPFPLRYACEFLIQVFGVQINKEVELAAQVREKHILRTQTLLCDMLLRDAPVAIITQSPNVMDLVKCDGAALYYRKKFWLLGVTPTEVQIRDIAEWLLEYHGGNAGLSTDSLMEAGYPGASDLGNAVCGMAAVRITSRDFLFWFRSHTAKEIKWGGAKHHPNDKDDVRKMHPRSSFKAFLEVVKWRSLPWEDIEMDAI

SEQ ID NO: 809 - protein, 459 aa, Clostridium perfringens
MKYTFPENFWWGAATSGPQSEGRFNKKHDNVFDHWFDINPELFHNGIGPNIASNFYNSYKEDLAMLKEIGLNSFRTSIQWTRLIKDFETGEPDEDGVRFYNGVIDECLANGIDIIMNLHHFDLPVELYDKYGGWESKHVVELFAKFAKTAFSLFGDRVKKWATFNEPIVIIEGQFLYKWHYPCIVDGKRGLQAAYNIALASARAIEEYRKLGQDGEIGIIVNLTPAYPRSESKEDLRAAEIANAFFNELFLDPATKGEFPKKLVEVLEKDGVMWNSTKEELEVIKNNTVDFLGVNYYQPRRVKDREEEYGGETWAPEKYFDNYDMPGKRMNPHRGWEIYPKAIYDIAKNVQENYGNIKWFISENGMGVEGEEKFKNAEGIIEDDYRIEFIIEHLEWLHKAIEEGSNCVGYHLWTPIDCWSWLNSYKNRYGFISLDLETQKKTIKKSGRWIKEVSKNNGF

SEQ ID NO: 810 - protein, 711 aa, Debaryomyces hansenii
MSLSTGSTGSERSNQSLIKGALDLDPWLEPFSGQLIHRQLNLRKWYDEFKQNEGSLTNFASAYEKYGLHANWDTKEVFINEYIPNVVEVSLVGDFNNWDTNTHKLKPVNDFGLWSLTIKPTENNEFAVPHDSRYKISMVTASGERIYRLCPWLKRATPSTENNLYEGRFWNPQPTETYKFKHERPRLESKDGIKIYEAHVGISTPEPKVGSYKNFTTKVLPVIHKLGYNTIQLMAVMEHAYYASFGYQVTNFFAISSRFGTPEDLKELIDEAHRLGIRVLLDVVHSHSSKNVEDGLNMFNGTDHYLFHGGTKGSHELWDSRLFNYSNYETLRFLLSNLRFYIDVFKFDGFRFDGVTSMLYKHHGLSFGFSGDYNEYFNSEWVDNDAITYLMLGHKLLDEISVRENNYKFVSIAEDVSGMPTLCLPIGQGGIGFDYRLSMAIPDMWIKIIKHLSDEEWDMGSLVHTLTNRRHGERCISYCESHDQALVGDKTIAFWLMDKEMYTNMSTLTPFTPVIDRGIALHKMIRLITFSLGGEGYLNFEGNEFGHPEWLDFPRKGNGESYAYARRQFNLIEDDLLRYKFLFAFDGAMQHLDTKYGILLSSQAYVSLKNENDKVIVFERNGLLFIFNFHPTNSYADYKIGVETPGVYQIVLNSDSLSFGGHGRIEETNKETGEKLQFFTNNERWNDRSNALFCYIPSRTAIVLQVKEKVV

SEQ ID NO: 811 - protein, 392 aa, Blepharandra heteropetala
DLEPVNPADVPVTAAGALKSYKLAARAISRLQSLPSGNISLLCDVLVKEVRDLTGYDRVMVYKFHEDEHGEVISECCRPDLEAYLGLHYPATDIPQASRFLFMKNKVRMICDCLAPAVKVIQDERLPQALSLCGSTLRSPHGCHAQYMANMGTIASLVMSVIINEDNDMMDGDQQHIARKLWGLVVCHHTSPRFVPFPLRYACEFLIQVFGVQINKEVELAAQVREKHILRTQTLLCDMLLRDAPVAIITQSPNVMDLVKCDGAALYYRKKFWLLGVTPTEVQIRDIAEWLLEYHGGNAGLSTDSLMEAGYPGASDLGNAVCGMAAVRITSRDFLFWFRSHTAKEIKWGGAKHHPNDKDDVRKMHPRSSFKAFLEEVKWRSLPWEDIEMDAI

SEQ ID NO: 812 - protein, 495 aa, Arabidopsis thaliana
MRLIVPLRGVIQGRGGLFVGSLIPCCLFYFLQLYLKRRRPPPSDPTDLPRTFSRTNLFSRGNSIGRVRVSSRAVPVAKPSDSPYYIGLERVKTDPYDRITNTDGIIQLGLAESTLCFDLLQRWMSENLMESMMQSDDGEFDISSIAMYKPFEGLLELRVAFADFMSRIMGGNVSFDPSNMVITAGGTPAIEVLAFCLADHGNAFLIPTPYYPGFDRDIKFRTGVELIPVHCRSSDNFTVTVSALEQALNQARKRGSKVSGILFSNPSNPVGNILSRETLCDILRFAQEKNIHVISDEIFAGSVYGDKEFVSMAEIAGSGEFDKTRVHIIYGLSKDLSIPGFRAGVIYSFHEDVVNAAKKLMRFSSVPVLVQRILISLLSDVRFIEGYMAAHRQRIRDKHIRFVEGLKQLGIPCAESGGGLYCWVDMSSLLTSYSEKGELELFEKLLTVAKINATPGTACYCIEPGWFRCCFTALADEDIPVIMERIRQLAESFRS

SEQ ID NO: 813 - protein, 392 aa, Blepharandra heteropetala
DLEPVNPADVPVTAAGALKSYKLAARAISRLQSLPSGNISLLCDVLVKEVRDLTGYDRVMVYKFHEDEHGEVISECCRPDLEAYLGLHYPATDIPQASRFLFMKNKVRMICDCLAPAVKVIQDERLPQALSLCGPTLRSPHGCHAQYMANMGTIASLVMSVIINEDNDMMDGDQQHIARKLWGLVVCHHTSPRFVPFPLRYACEFLIQVFGVQINKEVELAAQVREKHILRTQTLLCDMLLSDAPVAIITQSPNVMDLVKCDGAALYYRKKFWLLGVTPTEVQIRDIAEWLLEYHGGNAGLSTDSLMEAGYPGASDLGNAVCGMAAVRITSRDFLFWFRSHTAKEIKWGGAKHHPNDKDDVRKMHPRSSFKAFLEVVKWRSLPWKDVEMDAI

SEQ ID NO: 814 - protein, 392 aa, Caucanthus auriculatus
DLEPVNPADVPVTAAGALKSYKLAAKAISRLQSLPSGNISLLCDVLVKEVRDLTGYDRVMVYKFHEDEHGEVVSECHRSDLESYLGLHYPATDIPQASRFLFMKNKVRMICDCVAPPVKVIQEERLPQPLSPCGSTLRSPHGCHAQYMTNMGIIASLVMSVTVNEEDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLPEYHSGNTGLSTDSLMEAGYPGASALGDAVCGMAAVSITSRDFLLWFRSHTAKEIKWGGAKHDPDDKDDGRKMHPRSSFKAFLEVVKWRSMPWEDVEMDAI

SEQ ID NO: 815 - protein, 410 aa, Medicago truncatula
MNHECKATSTITIKGILSLLMESVGENNDDNSKRVISLGMGDPTLSTCFPNAKVAEEAVADALCSGNFHGYAPTAGLLQARNAIAKYLSDDLPYELSSDDVFITCGCTQAIDVSVALLSRPGANILLPRPGFPIYELCAAFRQVEVRHYDLLPEKGWEVDLDAIETLVDQNTVALVIINPGNPCGNVYTYHHLEKIAETAKRLGTIVIADEVYGHLAFGDNPFVPMGVFGSTVPVITLGSLSKRWIVPGWRLGWFVTNDPSGTFRKPKVVERIKKYFDLLGGPATFIQAAVPRIITQTEEVFFRKTIDKLRHTADICCQEMEDIPCISFPCKPQGSMAMMVELNLSLLEDISDDIDFCFKLAKEESVIILPGTAVGLKDWIRITFAADPSALRDGMQRIKSFSQRHARKQ

SEQ ID NO: 816 - protein, 111 aa, Zea mays
MARYFRSSNLASRIFDRQLISPLPGATVNTIRQFYENLVPSYTIYDIDCPDYSFRKFTDDGKYLVAFSRNHQDLIVYRPIWVTYSCNEECETHELPPKAKKFDSFFKQLYS

SEQ ID NO: 817 - protein, 478 aa, Staphylococcus aureus
MTKLPQNFMWGGALAANQFEGGYEKGGKGLSVIDVMTSGAHGKARQITESIDLNHYYPNHEGIDFYHRYKEDIALFKEMGLKCLRTSIAWTRIFPNGDEDVPNEEGLAFYDRIFDELIAQGIEPVVTLSHFEMPLHLAKHYGGFRNREVVDYFVHFARVVFERYKDKVTYWMTFNEINNQMDTSNPIFLWTNSGVALTENDNPEEVLYQVAHHELLASALAVRLGKEINPKFKIGTMISHVPIYPYSCHPKDMMEAQIANRLRFFFPDVQVRGYYPSYAKKMLARKGYDVGWQEGDDSILQQGTVDYIGFSYYMSTAVKHDVDTTVENNIVNGGLNHSVENPHIATSDWGWAIDPDGLRYTLNVLYDRYQLPLFIVENGFGAVDEVVDGHIHDDYRIEYLKAHITAAIEAVDQDGVDLIGYTPWGIIDIVSFTTGEMKKRYGLIYVDRDNDGHGTMERLKKDSFYWYQQVIASNGDKL

SEQ ID NO: 818 - protein, 636 aa, Rhodopseudomonas palustris
MAGKLRIRSRLRLLARRHPRITMAGRAVMAFSAGFGGAYGLLLGSNPETSGYDPHAFAVGASFLFALACLALAVQTMRLRRMRGRLRLLTASQEPPPDLQPNQSKTRALIAARESADAANHAKSRLLAMASHEIRTPLNGIIGMSRLLLDTPLSAEQATYAKAVKTSGEALLALTDELLDYARIEAGKIELDCRPFVLSSLIEDIIELLAPRAQARGLEIAADIDERLPVSLIVDAARLRQVLLNLCGNAIKFTETGGVALIVERGDQSGELRIIVRDTGIGIAPDAQARIFHEFEQADAGIARNFGGTGLGLSISDRIVAAMGGRIALESKPGEGSTFTITLPLSTAENDRATAAFAPPDLHGSSVMIVSAHGVEASLAARRLERWGAETCLCDDLAAAIARLPERSWHAVLIDHALGSDAIETLAREAQARATHRLVMLTPAARHELLPDLPAAFTGYLVKPLRSASLAARLGTAVEVATPSIADGDPPPVQDASSAITHEAFAILVAEDNDINALLIRALLHRLGHHAEIVGDGRRAVEAWGAADNTGTPFDLVLMDVQMPILDGLAAARQIRTLEAERARSRVPILALTANTLAEDREACLESGMDGFLVKPIDPDRLAAILAGVAAAHQAA

SEQ ID NO: 819 - protein, 207 aa, Elaeis guineensis
MGRGRVELKRIENKINRQVTFAKRRNGLLKKAYELSVLCDAEVALIIFSNRGKLYEFCSSSSMMKTLERYQKCNYGAPETNIISRETQSSQQEYLKLKARAEALQRSQRNLLGEDLGPLSSKELEQLEGQLDASLKQIRSTRTQYMLDQLADLQRKEQMLCEANKSLRRRLEESNQAGQQQVWDPTAHAVGYGGSHLNHRAMDSTNR

SEQ ID NO: 820 - protein, 224 aa, Elaeis guineensis
  misc_feature (62)..(62): Xaa can be any naturally occurring amino acid
  misc_feature (126)..(126): Xaa can be any naturally occurring amino acid
  misc_feature (199)..(199): Xaa can be any naturally occurring amino acid
MGRGKIEIKRIENTTNRQVTFCKRRNGLLKKAYELSVLCDAEVALIIFSSRGRLYEYANNSXKATIERYKKHVLDTSNSGSVSEADSQYYQQESLKLRQQITSLQNSNRNLMGDSLGSMSLRDLKXLEGRLEKGINKIRTKKNELLFAEIEYMQKRETELQNANMYLRNKIAENEGAQQQMNMLPATTEYEVMPPYDSXNFLQVNLMQSNQHYSHQQQTALQLG

SEQ ID NO: 821 - protein, 562 aa, Saccharomyces cerevisiae
MNVFGKKEEKQEKVYSLQNGFPYSHHPYASQYSRPDGPILLQDFHLLENIASFDRERVPERVVHAKGGGCRLEFELTDSLSDITYAAPYQNVGYKCPGLVRFSTVGGESGTPDTARDPRGVSFKFYTEWGNHDWVFNNTPVFFLRDAIKFPVFIHSQKRDPQSHLNQFQDTTIYWDYLTLNPESIHQITYMFGDRGTPASWASMNAYSGHSFIMVNKEGKDTYVQFHVLSDTGFETLTGDKAAELSGSHPDYNQAKLFTQLQNGEKPKFNCYVQTMTPEQATKFRYSVNDLTKIWPHKEFPLRKFGTITLTENVDNYFQEIEQVAFSPTNTCIPGIKPSNDSVLQARLFSYPDTQRHRLGANYQQLPVNRPRNLGCPYSKGDSQYTAEQCPFKAVNFQRDGPMSYYNFGPEPNYISSLPNQTLKFKNEVNDEVSDKFKGIVLDEVTEVSVRKQEQDQIRNEHIVDAKINQYYYVYGISPLDFEQPRALYEKVYNDEQKKLFVHNVVCHACKIKDPKVKKRVTQYFGLLNEDLGKVIAEGLGVPWEPVDLEGYAKTWSIASAN

SEQ ID NO: 822 - protein, 427 aa, Unknown
  Synechocystis sp. PCC 6803
MGKRTRRFWALAFSLLMGALIYLGNTPSALAFTEEQKLLLQSWRLVNQSYLDETFNHQNWWLLREKYVKRPLRNREETYTAIEEMLATLDEPFTRLLRPEQYGNLQVTTTGELSGVGLQININPETNQLEIMAPLAGSPAEEAGLQPHDQILAIDGVDTQTLSLDEAAARMRGPKNTKVSLEILSAGTEVPQEFTLTRQLISLSPVAAQLDDSRPGQSVGYIRLSQFSANAYKEVAHALHQLEEQGADGYILDLRNNPGGLLQAGIDIARLWLPESTIVYTVNRQGTQESFTANGEAATDRPLVVLVNQGTASASEILAGALQDNQRATLVGEKTFGKGLIQSLFELSDGAGIAVTVAKYETPQHHDIHKLGIMPDEVVEQPLISFAEITSPADVQYQAALDLLTGGVAIAHKSSSIPAMATAHKPN

SEQ ID NO: 823 - protein, 663 aa, Yarrowia lipolytica
RRQKRVERASAAPKNHCSNTKLCERLHHHYPHLSIRQLATSPKAVVSLFATQPKSHRHKDPCSCFSSTFSKLLPTTLTNIMSNTLVKKGQGQAASNAKKIGYNKKKGGGQTKGRPAFVFKLWNMVNDPAYDEYIRWMPDGKSFQITGREQLEKIVLPRFFKHNNFSSFVRQLNMYGWHKVQDVTSGSMQSNDEVWQFKSPNFIRGREDLLDNIVRNKGTKGSDEEEEMDMTTLMDELQQIKLNQLNLTQEVNKLRTDNQLLWQENLGFKDKHKQHGETLERIMRFLASLYGNQGKVLGEAISGNRNQRLLLGNTDPAQATHMINEAAAAAAAENSGNFPFEMNDMFNNNNNNNNNSNNPNDSPSFARVQPLSSTNSPQTVTGSPREENNKTNNTNNTSNNYDKITAYDTDTGSELPDNLQDLTDLSDFTPSMLDPQTVQQSMEPPMGFGDLNKNSSLILSNNSNNSINMPQTPMRNNSTSSHSSQNMSHHNYNYQPSTPGALFPELEAFQGANDQLIRSAERPRNNLNINGNGKADDLQRQLQDHGRHIDQFTDRLKKQQGYQPQQLQHQQQPQQPQQQPTPMQAPAPTPASTISSAPTPDPTSDLFNVGDPNIVPMQDFNMDDYIDNEADMFDPEVKIEEDMPLVTELDSPAPRPKKRKAGE

SEQ ID NO: 824 - protein, 701 aa, Xanthomonas campestris
MAKSPSKPAQIPSVGSSASAHELRGTGDELHQKAGGSHPQLTTNQGIPVGDNQNSLRATPRGPTLLEDFILREKITHFDHERIPERIVHARGSAAHGYFELTKSLSQYTTAKLLTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMIMWAMSDRTIPRSLRMIEGFGIHSFRLLNENGDSTFVKFHWRPKLGLQSTIWDEAVKLAGADPDFQRRDLFEAIQKGDFPEWELGVQLFTEAEAEAFPFDHLDSTKVIPEELVPLQIVGRMVLDRWPDNFFAETEQVAYCPANIVPGIDFSNDPLLQGRLFSYLDTQLSRLGGPNFHQIPINAPKCPFANNQRDGHMQMGVPKGRVAYEPSSLQADAPREALRGFPSHATPAEDGAKGRVRAESFADHYSQARMFFRSQTAPEQAHLASALVFELSKVETAHVREAIVGHLRHIDEALAKRVADGMGMTSLPPAPPAAVAPTDMQLSPALQLIGKMKDTLQGRTVGILIHDGSDAAAIKAVRKAAEAAGATVKIVAPKLGGAKLSDGKQLAADGQLAGTPSIVFDAVAVLLSSEAAKALTRESAALDFVSNAWAHLKAIAFDDGAQLLLKAGNVGKDPGVVDAADTKAFITAAKTRQWAREPKVRMLA

SEQ ID NO: 825 - protein, 560 aa, Caulobacter crescentus
MLVVTRRSRAARLIATAMVGGLLFFYLGWTALIVWLVANTICELWVVYLERAYRPHWGQGVIRFMRIGPPSAFAMVWSFMSAYCVLNGPMAMRYAALLILFGIVVEGVRYAMNSLAAMLSLTVWPFLMLAALPLLAKRFDLLDRLAAFAILLGLIGYVADAVRTMRASAKAREEAEAQALEASRAKSAFLAMMSHELRTPMNGVLGLAHALRGTKLDAQQSEYLEMIEQSGHGLMTILNDILDLSKIEAGKLNLEVAPFDLRKLALQTRAVWSESARLKGLDLILEVSPSAPPWVSGDATRVRQILMNLVSNALKFTESGRVVIRLGGEAGGVVTLSVTDTGVGMTAEQIGRLFTPFAQGDASIARRFGGTGLGLSICRQLAELMAGEIIVSSEPGVGSTFTVRLGLPAAAPLVAAPARAAVTQLDGARVLVVDDNLVNQTVARTILEAVGAAVAVAGDGHAALARLRIEDFDVVLMDVHMPGMDGVEAVRRIRAGEAGRTDLPVVALTADAMVGDAERLLAQGFDDAHPKPVQPAGLLATVASLRKAPTELQRLRAVGM

SEQ ID NO: 826 - protein, 392 aa, Caucanthus auriculatus
DLEPVNPADVPVTAAGALKSYKLAAKAISRLQSLPSGNISLLCDVLVKEVRDLTGYDRVMVYKFHEDEHGEVVSECHRSDLESYLGLHYPATDIPQASRFLFMKNKVRMICDCVAPPVKVIQEERLPQPLSLCGSTLRSPHGCHAQYMTNMGIIASLVMSVTVNEEDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDITEWLLEYHSGNTGLSTDSLMEAGYPGASALGDAVCGMAAVSITSRDFLLWFRSHTAKEIKWGGAKHDPDDKDDGRKMHPRSSFKAFLEVVKWRSMPWEDMEMDAI

SEQ ID NO: 827 - protein, 634 aa, Citrus sinensis
MESCDCIDTQWPPDELLVRYQYISDILIALAYFSIPVELIYFVQKSAFFPYRWVLMQFGSFIILCGLTHFISLWTFTVHSKAVAVVMTIAKMACAFVSCITALMLVHIIPDLLSVKTRELFLKNRADELDREMGLILTQEETGRHVRMLTHEIRSTLDRHTILKTTLVELGRTLGLEECALWMPSRTGLNLELSYTLNNQIQIGSSVPINLPIVTDVFNSAQAMRLPYNCPLARIRLLVGRYVPPDIVAVRVPLLHLSNFQINDWPELPAKSYAVMVLMLPTDGGRKWRDHELELIDVVADQVAGALSHAAILEDSMRARNQLMGQNVALDSARREAEKAIHARNDFRAVMNHEMRTLMHAIIALSSLLLETDLTPEQRVMIETVLKSSNLLTTLVDDVLDLSRLEDGSLELDNGPFNLQIVLREVIKLIKPVASCKKLSMTLIMAPELPTYAVGDEKRLMQTILNIVGNAVKFTKEGYVSIIAFVAKPESLSDWRPPKFYPVSTDGHFYLRVQVNDSGCGVPPQDIPLIFTKFAQSRGSSCQTPRAGLGLAICRRFVNLMGGHIWLESEGLDKGSTVTFLVKLGICNNPGSPIHPVALKGRASHGSADLTGPKPLFRDNDQIASTKSRYQRSV

SEQ ID NO: 828 - protein, 392 aa, Caucanthus auriculatus
DLEPVNPADVPVTAAGALKSYKLAAKAISRLQSLPSGNISLLCDVLVKEVRDLTGYDRVMVYKFHEDEHGEVVSECHRSDLESYLGLHYPATDIPQASRFLFMKNKVRMICDCVAPPVKVIQEERLPQPLSLCGSTLRSPHGCHAQYMTNMGIIASLVMSVTVNEEDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSRDFLLWFRSHTAKEIKWGGAKHDPDDKDDGRKMHPRSSFKAFLEVVKWRSMPWEDVEMDAI

SEQ ID NO: 829 - protein, 392 aa, Diacidia ferruginea
DLEPVNPADVPVTAAGALKSYKLAARAISRLQSLPSGNISLLCDVLVKEVRDLTDYDRVMVYKFHEDEHGEVISECCRPDMEAYLGLHYPATDIPQASRFLFMKNKVRMICDCLATPVKVIQDERLPQPLSLCGSTLRSPHGCHAQYMANMGAIASLVMSVTINEDDDMMDGDRQHRARKLWGLVVCHHTSPRFLPFPLRYACEFLIQVFGVQINKEVELAAQVREKHILRTQTLLCDMLLRDAPVAIITQSPNVMDLVKCNGAALYYKKKFWLVGLTPTEAQIRDIAEWLLEYHNGNTGLSTDSLMEAGYPGASELGDTVCGMAVVKITSRDFLFWFRSHTAKEIKWGGAKHDPDDKDDGRKMHPRSSFKAFLEVVKWRSLPWEDIEMDAI

SEQ ID NO: 830 - protein, 337 aa, Sulfolobus solfataricus
MIEIDGSFGEGGGQILRTSLTLSVITGKPFRIFNIRANRPNPGLQRQHLWAVRAMKMISNAETKGDEVGSKELTFIPHEIKGNSIIDIDIGTAGSVTLIMQTMIPAIINKNMRIKIKGGTDVPKSPTIDYIRLVYLEILRKIGIESKVNLIKRGHYPEGGGEVIIENVNGNPSDFSLLELGKLIMIKGISHVSSLPSHIAERQKDSAKAILSKLGVQIEIETDVRQGEVSKGSGIALAAIGEKSIIGADSLGERGKRAEIVGEEAARKLIDNLNTKAAVDVHMSDMLMIFTSLFGGEYIGAELTSHAYTNMEIIRKFLDVKIEISGKRPFRFKAKIF

SEQ ID NO: 831 - protein, 691 aa, Sorghum bicolor
MSAVSSSSLCGGDPAMRSVVWFRRDLRVEDNPALAAAARAGGEVVPAYVWSPEEEGPYYPGRVSRWWISQSLKHLDASLRRLGAGKLVTRRSADAVVALLQLVRDTGATHVYFNHLYDPISLVRDHRLKEMLAAEGIVVQSFNADLLYEPWEVVDDERQPFTMFTAFWNRCLSMQYDPPAPLLPPKKINSGDLSMCPSEDLIFEDDSERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVNESYFKIWRQGRTGYPLVDAGMRELWATGWLHDRIRVVVSSFFVKVLQLPWRWGMKYFWDTLLDADLESDALGWQYITGSLPDSRELDRIDNPQFEGYKFDPHGEYVRRWIPELVRLPTEWIHHPWDAPVSVLQAAGIELGSNYPLPIVELDAAKARLQEALSEMWQLEAASRATMNNGMEEGLGDSSEVPFPEELQMEVDRATANVVMTVRRREDQMVPTMTSSLNRAETEVSADLGNSEDTRAQVPFHAHFHPRVEREDMIQNTEGPALRINGTHQHNIFQQPQNHRREALAPSVSEASSSWTGREGAVVPVWSPPAASGHSETFAADEADVSSRSYLDRHPQSHRLMNWSQLSQSL

SEQ ID NO: 832 - protein, 392 aa, Dinemandra ericoides
DLEPVNPADVPVTAAGALKSYKLAAKAISRLQSLPSGNIPLLCDVLVKEVRDLTGYDRVMVYKFHEDEHGEVVSECRRSDMESYLGLHYPATDIPQASRFLFMKNKVRMICDCLSPPVEVIQDERLPQPLSLCGSTLRSPHGCHAQYMANMGTIASLVMSVTVNEDDDMMDGDQQRMARKLWGLVVCHHTSPRFVPFPLRYACEFLIQVFGVQINKEVDLAAQVREKHILRIQTMLCDMLLRDAPVAIITQSPNVMDLVKCDGAALYYKNKFWLLGVTPTEAQIRDIAEWLLEYHRGNTGLSTDSLMEAGYPGASVLGDAVCGMAAVSITSRDFLFWFRSHTAKEIKWGGAKHDPGDKDDGRKMHPRSSFKAFLEVVKWRSLPWKDVEMDAI

SEQ ID NO: 833 - protein, 210 aa, Geobacillus kaustophilus
MEWTRIPVGPIQANAYLLSSADRQCLIVDPGAEGAALVRRIEEKGLTPLAILLTHAHFDHIGGIPDVLARWDIPVYVHEKEKQWLQDPALNGSLYFGGPVAVRCEPTCLKGPTVLNIGPFALDVRETPGHSPGSVSYYCKQANIVFSGDALFAGSIGRTDLPGGNHQQLLKSIHDELLTLPEETIVLSGHGPETTIAAEMDANPFLHGFS

SEQ ID NO: 834 - protein, 473 aa, Salmonella typhimurium
MPTHLVWFRRDLRLQDNLALAAACRDASARVLALYISTPAQWQAHDMAPRQAAFISAQLNALQTALAEKGIPLLFHEVADFNASIETVKNVCRQHDVSHLFYNYQYEFNERQRDAAVEKTLPSVICEGFDDSVILAPGAVMTGNHEMYKVFTPFKNAWLKRLKEDIPPCVPAPKIRVSGALSTPLTPVSLNYPQQAFDAALFPVEENAVIAQLRQFCAQGADEYALRRDFPAVDGTSRLSASLATGGLSPRQCLHRLLAEQPQALDGGPGSVWLNELIWREFYRHLMTWYPALCKHQPFIRWTKRVAWQENPHYFQAWQKGETGYPIVDAAMRQLNATGWMHNRLRMITASFLVKDLLIDWRLGERYFMSQLIDGDLAANNGGWQWAASTGTDAAPYFRIFNPTTQGERFDRDGEFIRQWLPALRDIPGKAIHEPWRWAEKAGVVLDYPRPIVEHKQARIATLSAYEAARKGA

SEQ ID NO: 835 - protein, 392 aa, Dinemandra ericoides
DLEPVNPADVPVTAAGALKSYKLAAKAISRLQSLPSGNIPLPCDVLVKEVRDLTGYDRVMVYKFHEDEHGEVVSECRRSDMESYLGLHYPATDIPQASRFLFMKNKVRMICDCLSPPVEVIQDERLPQPLSLCGSTLRSPHGLHAQYMANMGTIASLVMSVTVNEDDDMMDGDQQRMARKLWGLVVCHHTSPRFVPFPLRYACEFLIQVFGVQIHKEVDLAAQVREKHILRIQTMLCDMLLRDAPVAIITQSPNVMDLVKCDGAALYYKNKFWLLGVTPTEAQIRDIAEWLLEYHRGNTGLSTDSLMEAGYPGASVLGDAVCGMAAVSITSRDFLFWFRSHTAKEIKWGGAKHDPGDKDDGRKMHPRSSFKAFLEVVKWRSLPWEDVEMDAI

SEQ ID NO: 836 - protein, 397 aa, Arabidopsis thaliana
MENGEAKQSVPLLTPYKMGRFNLSHRVVLAPLTRQRSYGNVPQPHAAIYYSQRTTPGGFLITEATGVSDTAQGYQDTPGIWTKEHVEAWKPIVDAVHAKGGIFFCQIWHVGRVSNSGFQPNGKAPISCSDKPLMPQIRSNGIDEALFTPPRRLGIEEIPGIVNDFRLAARNAMEAGKHILDLEFKKLKPFKILICVLVVAGFDGVEIHGANGYLIDQFMKDTVNDRTDEYGGSLQNRCKFPLEIVDAVAKEIGPDRVGIRLSPFADYMESGDTNPGALGLYMAESLNKYGILYCHVIEARMKTMGEVHACPHTLMPMRKAFKGTFISAGGFTREDGNEAVSKGRTDLVAYGRWFLANPDLPKRFQVDAPLNKYDRPTFYTSDPVVGYTDYPFLESTA

SEQ ID NO: 837 - protein, 261 aa, Zea mays
IKPPDFAVLLPTTRACALPPRPEPPPPLTLRAPSCSSCYSSVARPSRSEEQPWAGHVLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKQGGHEPGWREVPVEDPVVKDAAHHAVKSIQERSNSLFPYELLEILRAHAQVVEDFAKFDILMKLKRGSKEEKIKAEVHKSLEGAFVLNQHQPAEHDESSSQ

SEQ ID NO: 838 - protein, 254 aa, Legionella pneumophila
MTILPISAFSDNYIWTFIDKIAGVLDCVDPGESAPIIRFAQSNQLTLRTILLTHHHYDHIGGVDSLIKQWPSCKVYGPIDERISNLTHPIKQGQSVQVGSLHFHILFNPGHTSTHISYYEPQQGWLFCGDTLFSAGCGRVFDGTIEELHESLLLFKKLPRNTKIFCAHEYTLQNLKFAHTVEPCNSSVINYMQQILKQPSPCTLPSNIDLELSINPFLRTDKEQVKQYALSHGANSSDSLDVFEVLRNQKNSFK

SEQ ID NO: 839 - protein, 181 aa, Arabidopsis thaliana
FHVDPRVRTYYPGLCEPVSQGGLGFDYYVNLSASEMWVSLLDNVPDNEWSMSKIVSTLVANKEYADKMLSYAENHNQSISGGRSFAEILFGGVDNGSPGGKELLDRGISLHKMIRLITFTSGGRAYLNFMGNEFGHPERVEFPTQSNNFSFSLANRRWDLLESGVHHHLFSFDKELMDLDK

SEQ ID NO: 840 - protein, 467 aa, Alkaliphilus metalliredigenes
MKNIIKLMKMKKPTIVLVFLIALLTTSAVYAQPASDYEMELIRHYIRGSYVEPIDLDEITGQTPEEMFSGLDDYSTYFPKEDLEMFLEDVRGEFAGIGVYITEQMGKVIIAEPIENSPAQRAGIQPGDEILSVDGEDVKGRPLDVVAAMVKGPEGTQVKIEVKRQGQEDTIIFSMDRAFITVNPVAHQVIEDIGYIEIKSFNEHMTENIEKVLMGFKEQNVDKLIIDLRNNPGGSLDEAVKLSRLLLPKGPIVHIQYRDHQTTVVSYLEEPPFENMVVLINEASASASEIFAVAAKESGIATLIGKTTFGKGSVQRVYTLPTGTGFKLTEARYLSPEENEIDNVGVAPHIEVERFVPDVLTVDFLPLKMTRKPQIGDEGSDVEGAQQRLKAMGYTIKDPQGVMGESTYQAIYQFQEDAGLYPYGILDFSTQGALDRLFNQWIQGPDQDEQLKHAVRHFSGYSMFVVK

SEQ ID NO: 841 - protein, 374 aa, Arabidopsis thaliana
MEMVNAEAKQSVPLLTPYKMGRFNLSHRVVLAPLTRQKSYGSVPQPHAILYYSQRTSPGGFLIAEATGVSDTAQGYPDTPGIWTKEHVEAWKPIVDAVHAKGGIFFCQIWHVGRVSNRGFQPRRQAPISCTGKPIMPQMRANGIDEARFTPPRRLSIEEIPGIVNDFRLAARNAMEAGFDGVEIHGANGYLIDQFMKDTVNDRTDEYGGSLQNRCKFPLEIVDAVAKEIGPDRVGIRLSPFADYMESGDTNPGALGLYMAESLNKYGILYCHVIEARMKTMGEVHACPHTLMPMRKAFKGTFISAGGFTREDGNEAVSKGRTDLVAYGRWFLANPDLPKRFQVDAPLNKYDRPTFYTSDPVVGYTDYPFLESTA

SEQ ID NO: 842 - protein, 473 aa, Unknown
  Malus x domestica
MRMLSRNATFNSHGQDSSYFLGWQEYEKNPYHEVHNTNGIIQMGLAENQLCFDLLESWLAKNPEAAAFKKNGESIFAELALFQDYHGLPAFKKAMVDFMAEIRGNKVTFDPNHLVLTAGATSANETFIFCLADPGEAVLIPTPYYPGFDRDLKWRTGVEIVPIHCTSSNGFQITETALEEAYQEAEKRNLRVKGVLVTNPSNPLGTTMTRNELYLLLSFVEDKGIHLISDEIYSGTAFSSPSFISVMEVLKDRNCDENSEVWQRVHVVYSLSKDLGLPGFRVGAIYSNDDMVVAAATKMSSFGLVSSQTQHLLSAMLSDKKLTKNYIAENHKRLKQRQKKLVSGLQKSGISCLNGNAGLFCWVDMRHLLRSNTFEAEMELWKKIVYEVHLNISPGSSCHCTEPGWFRVCFANLPERTLDLAMQRLKAFVGEYYNVPEVNGGSQSSHLSHSRRQSLTKWVSRLSFDDRSPIPGR

SEQ ID NO: 843 - protein, 477 aa, Oryza sativa
MVKGGREALLGGYEMGRTLGEGNFGKVKYARHLATGGHFAVKILDRGRVVSLRAGDQIRREIATLKLLRHPHVVRLHEVAASKTKIYMVLEFVNGGELFERIVSPCFNDLLRYFLAAKIFMPATMAVKGKLSEKEGRRLFQQLIDGVSYCHDRGVYHRDLKPENVLVDQKGNIKISDFGLSALPQHLGNDGLLHTTCGSPNYIAPEVLQNKGYDGSLSDIWSCGVILYVMLIGYLPFDDRNIVVLYQKIFKGDTQIPKWLSHSAQNLLRRILEPNPMKRIDMAGIKSHEWFQKDYIPVLPYDDDDEDVQFGARLPAKEQINDEPGDKNSHQINAFQLIGMASSLDLSGFFEDEEVSQRRIRFTSTHPPKDAFDKIESSATELGFQVQRGHSKLKLMRNCKGSKNPESFMVSAEVFELGPSVNVVELRKSNGDPALYRQLCERISSDMGARNTEQIFATASLEDDLQNSNAGTPLFAL

SEQ ID NO: 844 - protein, 484 aa, Saccharomyces cerevisiae
MADKIERHTFKVFNQDFSVDKRFQLIKEIGHGAYGIVCSARFAEAAEDTTVAIKKVTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGTLLDLEKELEFGLDRKYF

SEQ ID NO: 845 - protein, 371 aa, Zea mays
  misc_feature (282)..(282): Xaa can be any naturally occurring amino acid
MIKANPDSMLPPGFRFHPTDEELIVNYLRNRAANTPCPVAIIADVDIYKLDPWDLPSRAAYGDKEWYFFSPRDRKYPNGVRPNRAAGSGYWKATGTDKPIHGSATGGSVVGVKKALVFYKGRPPKGAKTNWIMHEYRLAAADAHAAHSYYRSMKSRNASMRLDDWVLCRIYKKASHVPPMAVPPLSDHEQDEPCGFDENPYAATTSAAVLLQGASCPALQAAAGAQRMPRIPSLTELFSDPSLAHLFEEGGMQDMARLGNHHQQHQQQHGALLGRPVTTHEXLLVNNANSLSGEKIPRMDPPASTSAAGHGAAGKRKRSSEASTTSASQCAVEPGVCSHETTDRTAGATFQIGNGLQQQGSLGHRQMLLHS

SEQ ID NO: 846 - protein, 508 aa, Vibrio vulnificus
MHMSKSFLLISMGLASISVHAQTLTRDNGAPVGDNQNSITAGENGSVLLQDVHLIQKLQRFARERIPERVVHARGTGAHGEFVVSGDFSDLTLSSPFAQSGKVTPVFVRFSTVIHSKGSPETLRDPRGFATKFYTDQGNWDLVGNNLPVFFIRDSIKFPDMVHSLKPSPVTNLQDPNRFFDFFSSQPSATNMLTWVYTNLGTPASYRTMDGFGVHAYKWINRKGEVNYVKFHWKSQQGVKSLRPAEVTKVQGEDFNHLTNDLYTQINAGNFPKWDLYVKVLSPKALSKLDYNGLDATKVWLDVPEKKVGTMTLNRVPDNFFLETEQSAFAPSNIIPGIEPSEDRLLQGRLFAYADTQLYRLGANLFQLPVNSPKSPVANHNQDGPSNNSTGLGNVDSLDVNYEPSRLVNLTVDKQARAVETPLSGHVQQQAIRNPRDFFQAGVLYRSLSEQDKADLIHNLSGDLNKVNDAEVKAIMVSYFYRADKEYGTRLAKATDVNLKQVTKLASM

SEQ ID NO: 847 - protein, 370 aa, Triticum aestivum
MSNAASTTPLLAHYKMGKFDLSHRVVLAPLTRERSFGNVPQPHAILYYQQRATKGGLLIAEATGVSDTAQGYKDTPGIWTKKQVEAWKPIVDGVHAKGGIFFCQVWHVGRVSNHTFQPNGQAPISSTDKPIKPATRADGIGLAKVSTPRRLTTDEIPLVIDDFRVAARNAIEAGFDGVEIHGAHGYLIDQFLKDQVNDRTDKYGGSLENRCRFALEVVQAVADEIGADKVGIRLSPFASYSDASDSNPEALGLYMAQALNKLGILYCHMVEPRMVNIGEKLETPHSLRAMRDAFKGTFIVAGGYGRDDGDKAIADGYADLVAYGRLFLSNPDLPRRFEIDGPLNKYNRDTFYLSDPVIGYTDYPFLPSDI

SEQ ID NO: 848 - protein, 222 aa, Glycine max
MGSEGPTTPTTTIHVTGFKKFHGVSENPTETIANNLTEYMNKKGLPKRLVIGSSSILETAGQGALVPLYQRLQSAVNAKDSESSNSNKIIWLHFGVNSGATRFAIEKQAVNEANFRCPDEMGWKPQKVPIVPSDGGISRTRETTLPVVEITKALTEKGYEVMVSDDAGRFVCNYVYYHSLRFAEQNGIKSLFVHVPLFVTINEETQMQFAASLLEVLASIPQ

SEQ ID NO: 849 - protein, 312 aa, Bradyrhizobium japonicum
MTTSDSLRDTRIPTHESVTIPAVGFGTLIPDPLVTRQAIRAALEAGFRHLDCAERYRNEAAVGDAMQDAFKAGKLRREELFVTTKLWNTNHRPERVKPAFDASRRRLQLDEIDCYIIHTPFAFQPGDEQDPRDASGRVIYDSGVTLVETWHALERLVDEGHCKSIGLSDITLEKLREIVAVARIRPAMVQVESHPYLPEWDLLDFCREHGIVLQAFAALGHAMEPRVLEDPVITAIARRVQKTPAQVCLAWAVQRGTAFLTTSTNPARIRENFDISALPEDAMREIRDGITTNVRFNAVVETGVPGFIPRAR

SEQ ID NO: 850 - protein, 471 aa, Clostridium acetobutylicum
MGVKFPEGFLWGGATAANQFEGAYNQDGKGLSIQDIMPKGIRGPITDKPTEDNMKLIGIDFYNRYKEDIKLFAEMGFKTFRLSIAWSRIFPNGDDKQPNEKGLQFYDNVFDELAKYNIEPLVTISHYETPLALAKNYDGWTNRKLIGFFENYVRTIFNRYKNKVKYWLTFNEINSALHAPYMSAGIWTPKEKLSKQDLYQAMHHELLASALAVKIGHEINPEFKIGCMILGVPNYPLTSKPSDVLKAMNQDRENLFFADVHARGRYPKYMNRLFKENNVHIKMEPGDEEILKNTVDFISFSYYMSSCATSDTKKSKGGAGNIISGVPNPYLKASEWGWQIDPEGLRYILNLLYDRYQKPLFIVENGLGAVDELITDERGNKTVNDDYRINYLNDHLVQVGEAIEDGVELMGYTTWGCIDLVSASTAELKKRYGFIYVDRHDDGSGTLERYKKKSFYWYKEVIATNGASLKK

SEQ ID NO: 851 - protein, 392 aa, Dinemandra ericoides
DLEPVNPADVPVTAAGALKSYKLAAKAISRLQSLPSGNIPLLCDVLVKEVRDLTGYDRVMVYKFHEDEHGEVVSECRRSDMESYLGLHYPATDIPQASRFLFMKNKVRMICDCLSPPVEVIQDERLPQPLSLCGSTLRSPHGCHAQYMANMGTIASLVMSVTVNEDDDMMDGDQQRMARKLWGLVVCHHTSPRFVPFPLRYACEFLIQVFGVQINKEVDLAAQVREKHILRIQTMLCDMLLRDAPVAIITQSPNVMDLVKCDGAALYYKNKFWLLGVTPTEAQIRDIAEWLLEYHRGNTGLSTDSLMEAGYPGASVLGDAVCGMAAVSITSRDFLFWFRSHTAKEIKWGGAKHDPGDKDDGRKMHPRSSFKAFLEVVKWRSLPWKDMEMDAI

SEQ ID NO: 852 - protein, 237 aa, Nocardia farcinica
MSSDRLYFRQLLSGRDFAVGDPIATQMRNFAYLIGDRETGDCVVVDPAYAAGDLVDIAEADGLRLTGVLATHHHPDHVGGTMLGFTLRGVAELLEKTSVPVHVNARELSWVADVTGIAPSELTGHEHGDTVAVGAMTIELLHTPGHTPGSQCFLFEDRLIAGDTLFVDGCGRTDFPGGDSDEMFRSLRYLAGLSGDPVVYPGHWYSEEPSAALSTVRNNNYVMRPQTLEQWHMLMPG

SEQ ID NO: 853 - protein, 392 aa, Dinemandra ericoides
DLEPVNPADVPVTAAGALKSYKLAAKAISRLQSLPSGNIPLLCDVLVKEVRDLTGYDRVMVYKFHEDEHGEVVSECRRSDMESYLGLHYPATDIPQASRFLFMKNKVRMICDCLSPPVEVIQDERLPQPLSLCGSTLRSPHGCHAQYMANMGTIASLVMSVTVNEDDDMMDGDQQRMARKLWGLVVCHHTSPRFVPFPLRNACEFLIQVFGVQINKEVDLAAQVREKHILRIQTMLCDMLLRDAPVAIITQSPNVMDLVKCDGAALYYKNKFWLLGVTPTEAQIRDIAEWLPEYHRGNTGLSTDSLMEAGYPGASVLGDAVCGMAAVSITSRDFLFWFRSHTAKEIKWGGAKHDPGDKDDGRKMHPRSSFKAFLEVVKWRSLPWEDIEMDAI

SEQ ID NO: 854 - protein, 235 aa, Musa acuminata
MGRGKIEIKRIENTTNRQVTFCKRRNGLLKKAYELSVLCDAEVALIVFSSRGRLYEYANNNIKSTIERYKKACADSSSSDAIVDVNSQHYYQQESAKLRHQIQVLQNANRHLMGDALSSLNVKELKQLENRLERSITRIRSKKHELLFAEIEYMQKREVELQSDNMYPRAKIAENERVQQLSIVEAGAEYDAIPGAFDSRNYYHANILEAAAHYSHHQDQTALQLGYETKADSAA

SEQ ID NO: 855 - protein, 392 aa, Hiraea fagifolia
DLEPVNPADVPVTAAGALKSYKLAAKAISRLQSLPSGNISLLCDVLVKEVRDLTGYDRVMVYKFHEDEHGEVVSECRRPDLESYLGLHYPATDIPQASRFLFMKNKVRMICDCLAPPVKVIQDKRLPQPLSLCGSTLRSPHGCHAQYMTNMRTIASLVMSVTINEDDDTMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKIWLLGVTPKEEQIRDIAEWLLEYHSGNTGLSTDSLMEAGYPGASVLGDAICGMAAASITSRDFLFWFRSHTAKEIKWGGAKHEPGDKDDGRKMHPRSSFKAFLEVVKWGSMPWEDIEMDAI

SEQ ID NO: 856 - protein, 419 aa, Corynebacterium glutamicum
MGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 857 - protein, 392 aa, Hiraea fagifolia
DLEPVNPADVPVTAAGALKSYKLAAKAISRLQSLPSGNISLLCDVLVKEVRDLTGYDRVMVYKFHEDEHGEVVSECRRPDLEPYLGLHYPATDIPQASRFLFMKNKVRMICDCLAPPVKVIQDKRLPQPLSLCGSTLRSPHGCHAQYMTNMRTIASLVMSVTINEDDDTMDGDQQQMTRKLWGLGCCHHTSPRFVPFPLRYACEFLIQVFGVQINKEVELAAQVREKHILQIQTMLCDMLLRDAPVAIITQSPNVMDLVKCDGAALYFKNKIWLLGVTPKEEQIRDIAEWLLEYHSGNTGLSTDSLMEAGYPGASVLGDAVCGMAAASITSGDFLFWFRSHTAKEIKWGGAKHEPGDKDDGRKMHPRSSFKAFLEVVKWRSMPWEDVEMDAI

SEQ ID NO: 858 - protein, 412 aa, Burkholderia vietnamiensis
MKPIQKSNKLLNVCYDIRGPVLEHAKRLEEEGHRIIKLNIGNLAPFGFDAPDEIIQDMIRNLPASSGYSDSKGVFSARKAVMHYTQQKGVVGVGLDDIYIGNGASELIVMATQALLNDGDEVLLPAPDYPLWTAAVSLSGGTPVHYVCDEQNAWMPDPDDIRRKITPNTKALVVINPNNPTGALYSDELLLELLEIARQHGLIVFADEVYDKIVYDGLEHTALGSLSEDVITVTFNSLSKSYRSCGYRAGWMSVSGLGGDNRRRANDYLEGLGILSSMRLCANVPGQFAIQTALGGYQSINELIVPSGRLYKQRELAYDMLTSIPGVTCVKPQAALYMFPRLDPKLYPIQNDQQFILDLLLEERVLLVQGTGFNWAQPDHFRVVFLPNLDDLADSISRIARFLDGYRKRHSV

SEQ ID NO: 859 - protein, 255 aa, Debaryomyces hansenii
MHVESIPMRWGTGDNYSYLLIDTPTKNAWLIDPAEPEDVIAYFNKHNPSFELKAIVNTHHHYDHSGGNSDFHLKYPDLPIIAGKDSPQVTYTPSHQEVIDLGDNLSITALHTPCHTQDSICYYVKDSSTKEKAVFTGDTLFISGCGRFFEGSGEEMDKALNSILGKLPKETKVYPGHEYTKSNVKFSKTILNNDAIKKLDKFVNENEFTAGKFTIGDELEFNPFMRLNDPDVQKITGASDSAEVMGKLREMKNNM

SEQ ID NO: 860 - protein, 392 aa, Hiraea fagifolia
DLEPVNPADVPVTAVGALKSYKLAAKAISRLQSLPSGNISLLCDVLVKEVRDLTGYDRVMVYKFHEDEHGEVVSECRRPDLESYLGLHYPATDIPQASRFLFMKNKVRMICDCLAPPVKVIQDKRLPQPLSLCGSTLRSPHGCHAQYMTNMRTIASLVMSVTINEDDDTMDGDRQQMTRKLWGLVVCHHASPRFVPFPLRYACEFLIQVFGVQINKEVELAAQVREKHILQIQTMLCDMLLRDAPVAIITQSPNVMDLVKCDGAALYFKNKIWLLGVTPKEEQIRDIAEWLLEYHSGNTGLSTDSLMEAGYPGASVLGDAVCGMAAVSITSRDFLFWFRSHTAKEIKWGGAKHDPGDKDDGRKMHPRSSFKAFLEVVKWRSMPWEDIEMDAI

SEQ ID NO: 861 - protein, 277 aa, Yersinia pestis
MTMQPLIKLYDGRLMPQLGLGVWQASIQETELAVSKALEVGYRSIDTAAIYKNEEGVGKALKAAAVARDELFITTKLWNDDQHNPQQALETSLQKLQLDYVDLYLIHWPDPKQDHYVSAWRELVTLKEQGLIRSIGVCNFHIPHLQRLIDETGIAPTVNQIELHPLLQQRQLHAWNATHHIATESWSPLAQGGKGVFDQEIIRKLAQQYNKTPAQIVIRWHLDSGLIVIPKSVTPARIRENFEVFDFKLQKEELLAITKLDCGKRLGPDPEVFGSDR

SEQ ID NO: 862 - protein, 395 aa, Legionella pneumophila
MVFGFLNLSFWGYVLATFILTQITIASVTIYLHRNQTHRALTLHPVVSHFFRFWLWLTTGMVTADWVAIHRKHHATTDVEGDPHSPVVEGIRKVFWQGAELYREARKDRDMVAKYSHGTPTDWIERNVYSRHSSKGILLMLLLDLFFFGIPGMTVWAIQMMWIPLFAAGVINGIGHYWGYRNFECPDAATNIIPWGFWIGGEELHNNHHTFASSAKFSVKWWEFDIGWMYIRILSFFGLAKVKKLPPKLAMDEGKFHVDLDTVRAVISNRFQVMSDYYKNVIRPILKYEKNTGIETKEDKKLFQRAGRLLRREDKLLSTKAKTRLQKLLDAREQLRVVYSYKQSLQNVWLKTATTQKELVEALQQWCRQAEESGLDVLKQFAQQLKGYVPVYTRE

SEQ ID NO: 863 - protein, 365 aa, Yersinia pseudotuberculosis
MKTAKLFSPLKVGALTLPNRVFMAPLTRLRSIEPGDIPTPLMAEYYRQRASAGLTITEATQISFQAKGYAGAPGLHTQEQLNAWKKVTQGVHNEGGHIAVQLWHVGRISHNSLQPGQQAPVAPSAIAADTRTTVRDETGAWVRVPCSTPRALETEEIPGIINDFRQATANAREAGFDYIELHAAHGYLLHQFMSPASNQRTDQYGGSIENRTRLTLEVVDATAAEWGADRIGIRISPLGPFNGLDNGEDQEEAALYLIDQLNKRNIAYLHISEPDWAGGKPYSDTFRAAVRAHFNGVIVGAGAYSAEKAECLIQKGFIDAVAFGRSYISNPDLVTRLQQHAPLNEPDSNTFYGGGAKGYTDYPTL

SEQ ID NO: 864 - protein, 486 aa, Oryza sativa
MSYNHSPSITAETINQKVRIFTYEPCGEIVRHARRLEKEIYENPGSLPFQEIIYCNLGNPQALGQRPINFFREVLSLCDNPSLIDRDEARALFSPCALKRARKIIESLPGRDSGSYTSSQGVRGLREAVADGIAARDGFPSKPDNIFLTDGASSAINMMMQILIRSHEDGILCPLPEYPLYSASIILHGGTMVPYNLTEDSIWGLEIFEVKRCLEDARASGLTIRAMVVINPGNPTGQVLSITNQEEIVEFCRKEGLVILADEVYQENVYTENKRFNSFKKVARSLGYDHHDLSIVSFHSVSMGYYGECGRRGGYMEICGFGDDVIDEMYKLASLTICPNIAGQILISLVMDPPKLGDEAFEIFMVEKEETYSSLLKRAKALQKAFNGLEGVSCNKFEGAMYLFPRLRLPQAAIKAAQLEGVSPDVFYAHRLLDATGIAVVPGSGFHPVSGTSHIRCTILPGEETITAMVPSLQAFHEAFMDEFRG

SEQ ID NO: 865 - protein, 535 aa, Arabidopsis thaliana
MFKRVDEFNLVSSTIDHRIFKSRMDGSGTGSRSGVESILPNYKLGRTLGIGSFGRVKIAEHALTGHKVAIKILNRRKIKNMEMEEKVRREIKILRLFMHPHIIRLYEVIETPTDIYLVMEYVNSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPGARDLIPRMLVVDPMKRVTIPEIRQHPWFQAHLPRYLAVPPPDTVQQAKKIDEEILQEVINMGFDRNHLIESLRNRTQNDGTVTYYLILDNRFRASSGYLGAEFQETMEGTPRMHPAESVASPVSHRLPGLMEYQGVGLRSQYPVERKWALGLQSRAHPREIMTEVLKALQDLNVCWKKIGHYNMKCRWVPNSSADGMLSNSMHDNNYFGDESSIIENEAAVKSPNVVKFEIQLYKTRDDKYLLDLQRVQGPQFLFLDLCAAFLAQLRVL

SEQ ID NO: 866 - protein, 312 aa, Arabidopsis thaliana
MSVTSTVEENHQKNPSTPAAVEEEKKKRRWVFWDRRWRRLDYVKFSASFTVHSLALLAPFYFTWSALWVTFLFYTIGGLGITVSYHRNLAHRSFKVPKWLEYLLAYCALLAIQGDPIDWVSTHRYHHQFTDSERDPHSPKEGFWFSHLLWIYDSAYLVSKVILFCGRRANVEDLKRQWFYRFLQKTVLFHILGLGFFLFYLGGMSFVTWGMGVGAALEVHVTCLINSLCHIWGTRTWKTNDTSRNVWWLSVFSFGESWHNNHHAFESSARQGLEWWQIDISWYIVRFFEIIGLATDVKVPTEAQRRRMAIVR

SEQ ID NO: 867 - protein, 727 aa, Xanthomonas oryzae
MTYNVPVSMKAGLLALVLTTPMALLARADTALPAAATPDQATATKLVYGLLSDSRYAYRPRVLDEAMSKDVFKRYLETLDGGKQFFTQADIDSFAPLQAGVGDALRGGNLEPAFQVFSLYKKRVDQRVKYALDLLKQDFDFSGNDKFEYDRKDVPWAADDKQLDVLWRQSVMNDWLRLKLAGKKPDDIRKTLDKRYVALADSVKQLKGEDVFQFFVNAYTNAVDPHTDYFTPRTAETFNQQMSLSLEGIGAQLQKQDDMVVIREVIPGGPAAVDGTLKPGDRIVGVGQTKTGAIEDVIGWRIDDVVAKIRGSKDTQVRLEYIPAESGIDGKHRTVTLTRQKVRLAEQAAKGETITLPATGTEPQRRIGIIKLPGFYQDFEGRRRNATDYASATRDVAKLLAGFKTDKVDGVVLDLRNNGGGSLDEAIELTGLFIEQGPVVQVRESGGRVTVNGDSDPKVAWDGPLGVLINRGSASASEIFAGAIQDYGRGLVIGETSFGKGTVQNIVDLDRWPAAEGQRYGQVKLTIAQFFRVSGSSTQHKGVVPDIVFPASVDATEFGESTYDNALPWTRIAAAPHTQYGNFAPLLPKLQALHTARIATDKEFQWWEEDVKQFRDEKAKKYISLNEAERVAERQKQDQQRKDRQQIRKQLGLPLDPLAEDSDDGLTGNERDIVKDTAREKAAEKRPDPLLHESAAILADALGLLSQDKPLSAQVLPKSTAPGRWAD

SEQ ID NO: 868 - protein, 548 aa, Escherichia coli
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATAVVNTIRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 869 - protein, 351 aa, Medicago truncatula
MEKYEVVKDIGSGNFGVARLMRHKDTKQLVAMKYIERGHKIDENVAREIINHRSLRHPNIIRFKEVVLTPTHLGIVMEYAAGGELFDRICSAGRFSEDEARYFFQQLISGVSYCHSMQICHRDLKLENTLLDGSPAPRLKICDFGYSKSSLLHSRPKSTVGTPAYIAPEVLSRREYDGKLADVWSCGVTLYVMLVGAYPFEDQDDPKNFRKTINRIMAVQYKIPDYVHISQECRHLLSRIFVASPARRITIKEIKSHPWFLKNLPRELTEMAQAVYYRKENPTYSLQSIEDIMKIVEEAKNPPQASRSVGGFGWGGEEDDDEINEAEAELEEDEYEKRVKEAQESGEIHVN

SEQ ID NO: 870 - protein, 500 aa, Arabidopsis thaliana
GSSLSPISFTKPNKINPNFSIQISKASKFSYARSRSNISRSNAANPGVVFVCNRFLCVIERNDQRKLSGKVMMKSSVNFRQNLSVALVRIVSVLLVSSISVVTTDSPPSWGLTEENLLFLEAWRTIDRAYIDKTFNGQSWFRYRETALRNEPMNTREETYMAIKKMVATLDDPFTRFLEPGKFKSLRSGTQGAVTGVGLSIGYPTASDGPPAGLVVISAAPGGPANRAGILPGDVIQGIDNTTTETLTIYDAAQMLQGPEGSAVELAIRSGPETRLLTLTRERVSVNPVKSRLCELPGSGSNSPKIGYIKLTTFNQNASSAVREAIETLRGNNVNAFVLDLRDNSGGSFPEGIEIAKFWLDKGVIVYICDSRGVRDIYDTDGSNAIATSEPLAVLVNKGTASASEILAGALKDNKRALVYGEPTYGKGKIQSVFELSDGSGLAVTVARYETPAHTDIDKVGVTPDHPLPKSFPKDEEAFCGCLKDPTAACYLNQGLLFSR

SEQ ID NO: 871 - protein, 392 aa, Hiraea fagifolia
DLEPVNPADVPVTAAGALKSYKLAVKAISRLQSLPSGNISLLCDVLVKEVRDLTGYDRVMVYKFHEDEHGEVVSECRRPDLESYLGLHYPATDIPQASRFLFMKNKVRMICDCLAPPVKVIQDKRLPQPLSLCGSTLRSPHGCHAQYMTNMRTIASLVMSVAINEDDDTMDGDQQQMTRKLWGLVVCHHASPRFVPFPLRYACEFLIQVFGVQINKEVELAAQVREKHILQIQTMLCDMLLRDAPVAIITQSPNVMDLVKCDGAALYFKNKIWLLGVTPKEEQIRDIAEWLLEYHSGNTGLSTDSLMEAGYPGASVLGDAVCGMAAVSITSRDFLFWFRSHTAKEIKWGGAKHDPGDKDDGRKMHPRSSFKAFLEVVKWRSMPWEDVEMDAI

SEQ ID NO: 872 - protein, 647 aa, Nocardia farcinica
MCGLLGFLTADAATSEVVDQVYNALHCMRHRGPDERGTWHDDHLVFGFNRLSIIDIEHSHQPLRWGPPENPERYALTFNGEIYNYLELREELAAAHAAEFGDAPMFRTEGDSEAIVAAYHYWGAEAVAKLRGMFGFAIWDTQTRELFLARDPFGIKPLFLATGPGGTAFGSEKKSLLDLLPALRLSDDLDPRALEHYTVLQYVPEPETLHKGIRRLESGTYAVVRPGAAPQVTRYFTPRFPVRPFAPGSAQTRYNEIAAALEDSVAKHMRADVTVGSFLSGGIDSTAVAALAMRHNPNLITFTTGFEREGYSEVDVAAESAAAIGARHIVKVVSPAEFAAAIPEIVWYLDDPVADPALVPLYFVAKEARKHVKVVLSGEGADELFGGYTIYREPLSLKPFEYLPRGLRRLAGRLSERIPDGTRGKSLLHRGSLTLEERYYGNARSFNDAQLRAVLREFRPEWTHQDVTAPIYAQSRGWDPVARMQHLDLFTWLRGDILVKADKMTMANSLELRVPFLDTEVRRVAEQLPFDQKITKDTTKYALRQALEGIVPAHVLHRAKLGFPVPLRHWLRGTELYDWAHTQIAESQTDHLLDKAAITAMLVEHRAGRADHSRRLWTLLVFMVWHGIFVEDRIKPDIQEPVYPVTL

SEQ ID NO: 873 - protein, 541 aa, Enterococcus faecalis
MAKEIKFAEDARAAMLRGVDVLADTVKVTLGPKGRNVVLEKSFGSPLITNDGVTIAKEIELEDHFENMGAKLVSEVASKTNDIAGDGTTTATVLTQAIVREGLKNVTAGANPLGIRRGIELATKTAVEELHNISSVVDSKEAIAQVAAVSSGSEKVGQLIADAMEKVGNDGVITIAESKGIETELDVVEGMQFDRGYLSQYMVTDNDKMEAVLENPYILITDKKISNIQDILPLLEQILQQSRPLLIIADDVDGEALPTLVLNKIRGTFNVVAVKAPGFGDRRKAMLEDIAILTGGTVITDDLGLELKDTTIENLGNASKVVVDKDNTTIVEGAGSKEAIDARVHLIKNQIGETTSDFDREKLQERLAKLAGGVAVVKVGAATETELKELKLRIEDALNATRAAVEEGMVSGGGTALVNVIGKVAALEAEGDVATGIKIVVRALEEPIRQIAENAGYEGSVIVDKLKNVDLGIGFNAANGEWVNMVEAGIVDPTKVTRSALQNAASVSALLLTTEAVVADKPEPAAPAPMMDPSMGMGGMM

SEQ ID NO: 874 - protein, 392 aa, Janusia californica
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNEGDDTMDGDQQRMTRKLWGLVVCHHTSPQFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDVEMDAI

SEQ ID NO: 875 - protein, 392 aa, Janusia californica
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNEDDDTMDGDQQQMTRKLWGLVVCHHTSPQFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDVEMDAI

SEQ ID NO: 876 - protein, 392 aa, Janusia californica
DLEPVNLADVPVTAAGALKSYKLASKAISRLQSLPSGNISLLCDVLVKEVRDLTGYDRVMVYKFHEDEHGEVVFECRRSDLESYLGLHYPATDIPQASRFLFMKNKVRMICDCLAPPVKVIQDERLPQPLSLCGSTLRSPHGCHAQYMTNMGTIASLVMSVTVNEDDDTMDGDQQQMTRKLWGLVVCHHTSPQFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRKMPWEDIEMDAI

SEQ ID NO: 877 - protein, 1012 aa, Neurospora crassa
MVQAPMISVPLKATSEIDWVAPLKNYIRNTYGDDPERYAEECATLNRLRQDMRGAGKDSTSGRDLLYRYYGQLELLDLRFPVDEKNIKISFTWFDAFTHKPTAQYSLAFEKASIIFNISAVLSCHAAHQLRTEEAGLKTAYHSFQASAGMFTYINENFLHAPSSDLSRETVKTLISIMLAQAQEVFLEKQIADQKKNGLLAKLSSQAAALYAQAVEGVQENVTKAIFEKVWLSVVQIKLNFMNSLAQYYQALADEDANSYGVAIARLEIAQGLAKEANKMAHSFPTSVPPNSNLTSDCGHILADATKRHLATVKEKLEELNKENDMIYHQPVPAEASVAPVPKLPAAKPIPVSELYAGQDIQRITGPDLFAKIVPLAVTESASLYDEEKAKLVRAETERVETANSEMAASLDYLRLPGALQVLKGGFDQDILPDEDFRTWCVDVADHESPHRIFEYLHTEKQAISTILDKSSRQLDMEESVCEKMRSKYDAEWTQQPSSRLTTTLRTDIRRYREALEVAAKSDGQLATKLRANETELDEMRQAAQHGEIDELFQRAVRKSRKSNPNSPATVEPNLLEADFDDGGPSVVEQIQKVEDILKKLSLVKKERLQVLQDLKQKAHSDDISQILILNKKSIANYEQQLFQQELEKFRPHQNRLVQASHKQAALMRELTVTFNNLLQDKRVRADQSRYESVQRSRTSVINKYKRAYQEFLDLEAGLQSAKNWYKDMRQEAESLEKNVEAFVNNRRAEGAQLLNQIEQDRAANKSSHAALEQERLKNLMERMSMDPSPTSPKPSSGSGGRPTPAPLSFAPAAVSNTPLSAYQKSNFSTQYPASPPATQVPHNPGGQQQTPYQQYNPSSLGRIPGPASPPPNQTSFNIGPGRHPASPPPTQTSFAQSRPYSLTTYGNPSALNPQGGQPQQSQPGGYVPPGFVPPPPPPGPPPLGPQQTVHYGGNEYYAGAMGNPNIGRPGSGQQGPQGQQGGWGQPPPQQQLYQQQGGGGGDPWAGLSAWK

SEQ ID NO: 878 - protein, 174 aa, Triticum aestivum
  misc_feature (151)..(151): Xaa can be any naturally occurring amino acid
MSTSSGAKEAPANNPGLQAEADPATKGYIMQQTMFRVKDPKVSLDFYSRVMGMSLLKRLDFPEMKFSLYFLGYEDLSAAPADPVQRTGWTFGQKATIELTHNWGTESDPEFKGYHNGNSDPRGFGHIGVTVDDVYKACERFESLGVEFVKXPDDGKMKGIAFIKDPDGYWIENI

SEQ ID NO: 879 - protein, 392 aa, Mascagnia chasei
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVEVIQDERLAQPLSLCGSTLRSPHGCHAQYMTNMGTIASLVMAVTINEDDDMMDGDQQQMTRKLWGLVVCHHTSPRFVPFPLRYACEFLIQVFGVQINKEVELAAQVREKHILQIQTMLCDMLLRDAPVAIIMQSPNVMDLVKCDGAALYFKNKTWLLGVTPTEEQIRDIAEWLLEYHSGNTGLSTDSLMEAGYPGASALGDAVCGMAAVSITSRDFLFWFRSHTAKEIKWGGAKHDPDVKDDGRKMHPRSSFKAFLEVVKWRKMPWENIEMDAI

SEQ ID NO: 880 - protein, 373 aa, Brassica napus
MSAENCFGGGGGDQSTKGLATHGGQYVQYNVYGNIFEVTRKYVPPLRPIGRGAYGIVCAATNSETGEEVAIKKIGNAFDNIIDAKRTLREIKLLKHMDHENVIAVKDIIRPPLRENFNDVYIVYELMDTDLHQIIRSNQPLTDDHCQFFLYQLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVKQLPQYPRQNFAARFPNMSAGAADLLEKMLVFDPSRRITVDEALCHPYLAPLHDINEEPVCVRPFNFDFEQPSLTEENIKELIYRETVNFNPQ

SEQ ID NO: 881 - protein, 251 aa, Yersinia pseudotuberculosis
MNLISIPAFQDNYIWLLANRQKHCVIVDPGESAPVLATLAQGQYVPQAILLTHHHNDHVGGVADLRHHFPDIPVYGPQETAKKGATVIVNDGDSLTIAGQNYTIIAVPGHTLGHIAYYSSPYLFCGDTLFSAGCGRLLEGTPEQMYASIQRLAQLPDETLICCAHEYTLSNLKFAHAILPADQDIATYQQQIEQLRSKNLPSLPVKLQFERKINVFLRCNDIDLQRKIGITSPPDSLVSVFCELRSRKDSF

SEQ ID NO: 882 - protein, 464 aa, Hordeum vulgare
MAAAFSSTVGAPASTPTNFLGKKLKKQVTSAVNYHGKSSKANRFTVMAAENIDEKRNTDKWKGLAYDISDDQQDITRGKGIVDSLFQAPTGHGTHEAVLSSYEYVSQGLRKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGKMCCLFINDLDAGAGRMGGTTQYTVNNQMVNATLMNIADAPTNVQLPGMYNKRENPRVPIVVTGNDFSTLYAPLIRDGRMEKFYWAPTRDDRIGVCKGIFQTDNVSDESVVKIVDTFPGQSIDFFGALRARVYDDEVRKWVGSTGIENIGKRLVNSRDGPVTFEQPKMTVEKLLEYGHMLVQEQDNVKRVQLADTYMSQAALGDANQDAMKTGSFYGKGAQQGTLPVPEGCTDQNAKNYDPTARSDDGSCLYTF

SEQ ID NO: 883 - protein, 456 aa, Oryza sativa
  misc_feature (240)..(240): Xaa can be any naturally occurring amino acid
  misc_feature (261)..(261): Xaa can be any naturally occurring amino acid
MSTTKVKRRVGKYELGRTIGEGTFAKVKFARDTETGDPVAIKILDKEKVLKHKMVEQIKREISTMKLIKHPNVVRIYEVMGSKTNIYIVLEYVTGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPCDVFXPAQRLLTRILDPNPMTRVTIXPEILEDEWFKKGYKRPEFDEKYDTTLDDVDAVFNDSEEHHVTEKKEEPEALNAFELISMSAGLNLGNLFDSEQEFKRETRFTSKCPPKEIVRKIEEAAKPLGFDVQKKNYKICSPCLTTICMNIPFKLRLEKVKAGRKGNLNVATEILQVAPSLHMVEVRKAKGDTLEFHKFYKNLSRTLKDVVWKSDDLQNQLS

SEQ ID NO: 884 - protein, 468 aa, Streptomyces coelicolor
MTGTPQRSHPQPERTFVTIDFAALPDDFLWGTATSAYQIEGAVAEDGRSPSIWDTFSHTPGKIDNGDHGDVACDHYHRTHEDIELMRRLGTNAYRLSVAWPRVVPGGDGPVNAKGLAFYDRLVDDLLAAGITPSVTLYHWDLPQVLQDRGGWPERDTAEHFAAYAAVVAERLGDRVAHWATLNEPLCSAWIGHLEGKMAPGQTDLTAAVRASYHLLLGHGLAMQAIRAAAPDAQVGIVNNLSTIHAATDREEDLAAARRMDGHTNRWWLDPVHGRGFPQDMREVYGVELPERPGDMRLIGAELDWLGLNYYFPQTVAADPTGPAPQVRTVRRAGVPRTGMDWEIDAGGIEELLLRLTEEYGPRKLYVTENGSSFPDLVRPDGSVDDPERQEYLTAHLAACASAARKGAPLAGYFAWSLLDNFEWAYGYDKRFGLVHVDYATQVRTIKGSGHHYADIIGRARGRERKAA

SEQ ID NO: 885 - protein, 414 aa, Unknown
  Acinetobacter sp. ADP1
MSQIAEPITIRNVTFKNRIIKGAMSEALANRAGQPNDLHFGLYQAWAQGGLGCAITGNVMVDLRAKNEPGVVAIESERDLERLKKWADIGKKYGMVQLIQLSHPGRQCPKGLNQETVAPSAVPFSPMLATMFATPRELHHEEILDIIQRFADAARVCEKAGFEGVQLHGAHGYLISQFLSPLTNKRQDQWGGSIENRMRFLLEIYHAVRAATSENFIISVKLNSADFQRGGITEEDVIAVFKAIDQAGIDLIEVSGGTYEAPAMAGVKAEKRKASTIAREAYFLEFAEKIRDSVQCKLMVTGGFRSVEGMNAALQSGACDFIGIARPFAVETDLTHRLIAGQDVKYAVKPIKTGVPFVDKMAVMEIIWYAAQFKAIGKGKKPNPKLSPLLVFLNYAKGNVKALIQGRINSRKSA

SEQ ID NO: 886 - protein, 232 aa, Triticum aestivum
RVPASRAAWAAERIPVGGAQTRQVDRRGRVSGSVARTQPRGALGGLADPRGGSQRTRVPAPGSPAQPPPSRAVLRAGTYKRRGARAHAAGAGAVGRRLPAPKRWDVPRAPAGGVHSGPACVRKSGACRSTRARGCTIAPHRFGKYGAIRQIRLGNAKDTRGTAYVVYEDIYDAKNAVDHLSGFNVANRYLIVLYSQLNRMSKKTDIKKKEDEITRLQEKYGVGSKTPSANDA

SEQ ID NO: 887 - protein, 480 aa, Glycine max
  misc_feature (66)..(66): Xaa can be any naturally occurring amino acid
MIIHKTPNMGKDDEGFDVPKTMSNLTSASGEARASSGNRTEIGTDYSQQYFTPPPTQTQPPLKKKXNLPGNLDPEAEVVALSPKTLLATNRFICEICNKGFQRDQNLQLHRRGHNLPWKLKQRSSKDIIRKKVYVCPEPSCVHHEPSRALGDLTGIKKHFCRKHGEKKWKCDKCSKKYAVQSDWKAHSKTCGTREYRCDCGTLFSRRDSFITHRAFCDALAEESARSVTGIVANSTTQPTEAAGVVISSSSLHQDMIHASNNNFPLKKEQQGCIPHWLGQPSPSSASSSFLFSHQDHHLHENPNPRGGPTLLPPPYHQTAPHMSATALLQKAAQMGATMSKTGSMIRTHQQQAHVSANAALNLSSRDHQMNPTPHDLLPFGNNKAVDNGVGVSPSLLHHVINSFSSSPFEGTFEDTFGGGDAMTADEGGGGGAGGNNNEGLTRDFLGLRHLSHTDILNIAGVGNCMNSSQHNQTRNPWQG

SEQ ID NO: 888 - protein, 660 aa, Bacillus cereus
MVKYKKFCHLSEVSILSVINCEEVKRDEFHTEKYYDSYNIFGAHIVTEDEMRGVRFTVWAPHAKAMSVVGDFNEWDYEQHKMLQVTEEGIWSLFIPHIEEREIYKYAIETMAGDVILKADPYAVYAEVRPNTASVVFDIKGYEWNDKNWSRKKKKKSVYKEAMTVYELHFGSWKKKEDGTLYSYREMAEELIPYVVEHQFTHIEIMPLVEHPYDRSWGYQGTGYYAATSRFGTPHDLMHFVDECHKYGIGVILDWVPGHFCKDAHGLYLFDGTPTYEYKDKDVQENPVWGTVNFDLGKREVRNFLISNALFWMRYFHIDGFRVDAVANMLYWNKEGQEQSNEHAVSFLRELNEAVFAEDEDFLMTAEDSTAWPLVTAPTYEGGLGFNYKWNMGWMNDVLKYMECAPEYRKYIHEKMTFSLLYAYSENFILPLSHDEVVHGKKSLLNKMPGDYWDKFAQLRLLYGYFFTHPGKKLLFMGGEFGQFDEWKDLEDLDWNLHDFEMHRYMHDYFKELIALYKRSKPLWQLDHSPEGFQWIDANNNEQSIFSFIRQGDKQEDALVVVCNFTKATYENYKVGVPDFEYYNEILNSDAEQYGGSGQVNKKRLKAIQEPYHNQAAHVEITIPPFGVSILRPVKTRKGSKKQDGSKTKVRSNVTSRGKR

SEQ ID NO: 889 - protein, 392 aa, Peixotoa glabra
DLEPVNPSDVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVQVIQDERLPQPLSLCGSTLRSPHGCHAQYMTNMGTIASLVKSVTVNEDDDTMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLKYHSGNTGLSTDSLMEAGYPGASTLGDAVCGMAAVSITSRDFLFWFRSHTAKEIKWGGAKHDPDDKDDLRKMHPRSSFKAFLEVVKWRSMPWEDVEMDAI

SEQ ID NO: 890 - protein, 392 aa, Tetrapterys discolor
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNDDDDMMDGDQQQMTRKLWGLVVCHHTSPRFVPFPLRYACEFLIQVFGVQINKEVELTAQVREKHILQIQTMLCDMLLRDAPVAIITQSPNVMDLVKCDGAALYFKKKTWLLGVTPMEEQVRDIAEWLLEYHSGSTGLSTDSLMEAGYPGASDLGDAVCGMAAVSITSRDFLFWFRSHTAKEIKWGGAKHDPDDKDDGRKMHPRSSFKAFLEVVKWRSVPWEDIEMDAI

SEQ ID NO: 891 - protein, 433 aa, Saccharomyces cerevisiae
MATDTERCIFRAFGQDFILNKHFHLTGKIGRGSHSLICSSTYTESNEETHVAIRKIPNAFGNKLSCKRTLRELKLLRHLRGHPNIVWLFDTDIVFYPNGALNGVYLYEELMECDLSQIIRSEQRLEDAHFQSFIYQILCALKYIHSANVLHCDLKPKNLLVNSDCQLKICNFGLSCSYSENHKVNDGFIKGYITSIWYKAPEILLNYQECTKAVDIWSTGCILAELLGRKPMFEGKDYVDHLNHILQILGTPPEETLQEIASQKVYNYIFQFGNIPGRSFESILPGANPEALELLKKMLEFDPKKRITVEDALEHPYLSMWHDIDEEFSCQKTFRFEFEHIESMAELGNEVIKEVFDFRKVVRKHPISGDSPSSSLSLEDAIPQEVVQVHPSRKVLPSYSPEFSYVSQLPSLTTTQPYQNLMGISSNSFQGVN

SEQ ID NO: 892 - protein, 392 aa, Tristellateia madagascariensis
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDTMDGDQQQMARKLWGLVVCHHTSPRFVPFPLRYACEFLIQVFGVQINKELELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKHDPDDKDDGRKMHPRSSFKAFLEVVKWRSLPWKDMEMDAI

SEQ ID NO: 893 - protein, 370 aa, Agrobacterium tumefaciens
MTSLFEPAQAGDIALANRIVMAPLTRNRSPGAIPNNLNATYYEQRATAGLIVTEGTPISQQGQGYADVPGLYKQEAIEGWKKITDGVHSAGGKIVAQIWHVGRISHTSLQPHGGQPVAPSAIPAKSKTYIINDDGTGAFAETSEPRALTIDDIGLILEDYRSGARAALEAGFDGVEIHAANGYLIEQFLKSSTNQRTDDYGGSIENRARFLLEVVDAVAEEIGAGRTGIRLSPVTPANDIFEADPQPLYNYVVEELGKRNLAFIHVVEGATGGPRDFKQGDKPFDYATFKGAYRNAGGKGLWIANNGYDRESAIEAVESGKVDAVAFGKAFIANPDLVRRLKDNAPLNEPNQPTFYGGGAEGYTDYPALG

SEQ ID NO: 894 - protein, 392 aa, Tristellateia madagascariensis
DLEPVNPADVPLTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDTMDGDQQQMARKLWGLIVCHHTSPRFVPFPLRYACEFLIQVFGVQINKELELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKHDPDDKDDGRKMHPRSSFKAFLEVVKWRSLPWEDVEMDAI

SEQ ID NO: 895 - protein, 541 aa, Unknown
  Nocardioides sp. JS614
MPKLIAFNEEARRGLERGMNTLADAVKVTLGPKGRNVVLEKKWGAPTITNDGVSIAKEIELEDPYEKIGAELVKEVAKKTDDVAGDGTTTATVLAQAMVREGLRNVAAGANPMGLKRGIEAAVEAVSGQLLSMAKDVETKEQIASTASISAADTTVGEIIAEAMDKVGKEGVITVEESNTFGLDLELTEGMRFDKGYISAYFVTDPERMETVLEDPYVLIANQKISSVKDLLPLLEKVMQSGKPLLILAEDVDGEALSTLVVNKIRGTFKSVAVKAPGFGDRRKAMLQDIAILTGGQVISEEVGLKLESTGIELLGQARKVVITKDETTIVEGAGDADQIAGRVNQIRAEIEKSDSDYDREKLQERLAKLAGGVAVIKVGAATEVELKERKHRIEDAVRNAKAAVEEGIVAGGGVALVQAANAAFDKLDLTGDEAVGAQIVRFATDAPLKQIAINAGLEGGVVAEKVRGLTAGHGLNAATGEYVDMIASGIIDPAKVTRSALQNAASIAALFLTTEAVVADKPEKAAPMGDPSGGMGGMDF

SEQ ID NO: 896 - protein, 358 aa, Legionella pneumophila
MTCRRFIMVNSDLILSPYQLNDKITLKNRVIMAPMTRNMANDDFSPTRQMADYYARRADAGLIITEGTIISPDGQGYSNAPGIFTQTHIDGWKMVTDAVHERGGKIFLQIWHVGRVSHPIFLHGNLPISASETMMTGKVRRADDLYYGKSRAATLEEINELIQNYALAARRAMIAGFDGIEIHGANGYLIDQFLHYHTNQRHDQYGQYPENMGRFALEVVKACINEIGGQSVGLRLSPGAYLNEIVGDERDAMVFRYVLEELNHYGIAYVHTGNFDDGIQFKELGFKTMTEFMRAHFKGTLIASGSYTLHQARKDIQNKKYDLIALGRPFIANPDLMNRIKWNADFLPYENRMLDTLF

SEQ ID NO: 897 - protein, 392 aa, Tristellateia madagascariensis
DLEPVNPADVPLTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDTMDGDQQQMARKLWGLVVCHHTSPRFVPFPLRYACEFLIQVFGVQITKELELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKRDPDDKDDGRKMHPRSSFKAFLEVVKWRSLPWEDVEMDAI

SEQ ID NO: 898 - protein, 634 aa, Desulfotalea psychrophila
MCGLAGFFNYQFIADNTILHLQSMGKSISHRGPDASGTWYDADTGIGLVHTRLAIVDLSSAGHQPMHSQCDRYVIAFNGEIYNHLMLRQKLEQANQAPAWRGHSDTETLLACFVAWGIEQTLKVTVGMFALALWDKQEQNLTLARDRAGEKPLYWGWQGDTLLFGSELKALKAHPDFKAKVSRDALAVYMRHNYISAPQSIYEGIYKLLPGHYVTLNSVSNIDTATPKAYWTMNQAIESGIAQPFSGTDIEAVDLLEHRLSQSIGGQMLADVPLGAFLSGGVDSSVVVALMQKQAQQSVKTYAIGFDDPRYNEAQYAAAVARHLGTEHTELYVSAQDALELVPQLPSIYCEPFADSSQLPTFLVTKMARQHVTVALSGDGGDELFGGYTPYLFTPRYWNLLKCYPQPLRAALAASMSRLPLPDKFLKLAEVMGASNKESFYRSIMSHWGQPEDVVIGAKEPASVLNSSDLWPETDSFEHWMMAMEAQMYMPDDILVKVDRAAMANSLETRVPLLDHRVIELAWQLPLSMKIRDGKGKWVLREVLYRHVPRELIERPKKGFSIPLANWLRGPLRDWAEALLDEKRLRGEGYFYPAPIREAWQQHVQGKRDNASKLWSVLMFQAWLDEQDANSITL

SEQ ID NO: 899 - protein, 484 aa, Oryza sativa
MALSTAQTGESMHSSTFASRYVRTALPRFRMPEKSIPKDAAYQIINDELMLDGNPRLNLASFVTTWMEPECDKLMMAAINKNYVDMDEYPVTTELQNRCVNMIAHLFNAPIGDDETAVGVGTVGSSEAIMLAGLAFKRKWQNRMKAEGKPHDKPNIVTGANVQVCWEKFARYFEVELKEVKLTQGYYVMNPEKAVEMVDENTICVAAILGSTLNGEFEDVKMLNDLLTAKNAETGWNTPIHVDAASGGFIAPFIYPELEWDFRLPLVKSINVSGHKYGLVYAGVGWVIWRNKEDLPDELIFHINYLGADQPTFTLNFSKGSNQIIAQYYQLIRLGFEGYKDIMQNCRDNATVLREGIEKTGHFDVVSKDSGVPLVAFSLKDSSRYTVFEVAESLRRFGWIVPAYTMPADAEHVAVMRVVIREDFSRGLAERLITDLTKTVADMDAHAVKKAAAEPAKKTVREIEKEVTTYWRSFVARKKSSLVC

SEQ ID NO: 900 - protein, 205 aa, Dehalococcoides ethenogenes
MLNRKLRLGLLGTNCYILGDEESREGLIIDPAAISNSIPETVTEHHLNVKYILLTHGHLDHLAGLEYVRKLYPGAKLCFNPSDSHLSENIELVSYLGMPALPNLVPDIPLDEGSTLELGKTRFSVISIPGHTPGGICLYTPGYLFSGDTLFNSGIGRSDFEESDTEALRQNIINRLLSLPPETLVFPGHGRETTIGREKAGNPFI

SEQ ID NO: 901 - protein, 432 aa, Candida albicans
MTVTIPLTETNLFKPISIGDVKLNHRIVHAPTSRKRSTKDNYPTDFMIDYYKSRSQYPGSFIIFESCLVSERSGLVPHKIGLWDEKHCLALKQIVDQVHNNNCVISCQIMANGRTSNAKLMQSKNLPILAPSITYPNEAAEKLATELNFPIKPLTVDEIHNIQDDFVNAAVNSLKIADFDFVELHATSGFLIEQFLSPLSNKRTDEYGGDLVNRCRFLIEIIDKFINHPDIGPKKFGVRISPWYSHNGMVYPEEVNLEDGIPYQFCQYILKQLEVRKSQGNEIAYVSIVEPRVSGNSDVDSFGDKSNDEIIKSWSGKLIRAGGYATNFNVENPTLIKTNKQVTNEGGEIVHYANLINDVNNDDRTLIGFSRPFTSNPDLVYRLENNLKLEYYDRPTFYTQTGEGYLTFKNYDGSAVTKLPEKELMREGISLQ

SEQ ID NO: 902 - protein, 676 aa, Unknown
  Acinetobacter sp. ADP1
MTSYAHILKPLHLGFTTIKNRVVMGSMHTGLEDRFYNYPKLAAYFGERAKGGVGLIITGGISPNRQGWLLPAGGTMNSLADIPHHRLVTHAVHKHGGKILMQILHAGRYGYQPFIVSASPIKSPISPFKPRQMSEKNILDTIEDYARCSELAKKAGYDGIEIMGSEGYLLNQFLSRHVNQREDRWGGAIENRMRFAIEIVKAIREKVGEKFIISFRLSMLDLVHDGNTMQEVIIVAKALEKVGVTLLNTGIGWHEARVPTIVTSVPRAAFVDYTAYVKQHVTIPVIASNRINMPDVAENILATGKADMIQMARPLLADAFWVTKVATNRVDEINTCIACNQACLDHTFKNQRATCLVNPRAAYETELTYIKTKKPKKIAVVGGGVAGMSAATVAASRGHQVTLFEASHDVGGQFNLAKVVPGKEEFHETIRYFKVQIEKTGVDLRLNTRVNREQLEREGFDEVIVATGVIPRQLKIQGSDAPQVLSYAEVLKGASVGHKVAVIGAGGIGFDVSEFLLRPEHQPQPQPLAQWQREWGIDPMPDYITEGGLVPTELEPPVRQIYLLQRKTSPLGVGLGKTSGWVHRAQLKKHAVRMMRGVQYKAVTNEGLWIELDGHDQLLRVDTIVVCAGQESVKDIMPKEDENTLAHYHIIGGAKLAAELDAKRAIREGAELAAKL

SEQ ID NO: 903 - protein, 208 aa, Pyrococcus furiosus
MKVLVTGFEPFGGEKINPTERIAKDLDGIKIGDAQVFGRVLPVVFGKAKEVLEKTLEEIKPDIAIHVGLAPGRSAISIERIAVNAIDARIPDNEGKKIEDEPIVPGAPTAYFSTLPIKKIMKKLHERGIPAYISNSAGLYLSNYVMYLSLHHSATKGYPKMSGFIHVPYIPEQIIDKIGKGQVPPSMSYEMELEAVKVAIEVALEELL

SEQ ID NO: 904 - protein, 309 aa, Prochlorococcus marinus
MVSSLIEASAPLKKPVAADKAMAASKKLQGHVPRRIQNKRARKRWGTVIFMLTIHALTIFTLQAQFWSWLAFSGFIFLYWVTACLGVTTGYHRLLSHRSFQVPKWLERFFATCGALSCQHGPIDWVGLHRHHHTFSDTEADHHDSNKGFWWSHMGWMFEDVPAMKAVPRLSGDLIKDPYYRFLNKNFLLLQLPLGATLYLIGQSAGVGGWAMVLWGIPLRLVFVYHITWLVNSATHCWGTIAYESGDNSKNNKWVAALTFGEGWHNNHHAFPNSAKHGLQRKQIDLTWQHIRFLKAIGLAKKIRLPVAS

SEQ ID NO: 905 - protein, 863 aa, Arabidopsis thaliana
MVSLSNQTRFSFHPNNLVVSEKRRLGISGVNFPRKIKLKITCFAAERPRQEKQKKKSQSQSTSDAEAGVDPVGFLTRLGIADRIFAQFLRERHKALKDLKDEIFKRHFDFRDFASGFELLGMHRHMEHRVDFMDWGPGSRYGAIIGDFNGWSPTENAAREGLFGHDDYGYWFIILEDKLREAEEIFQKANDEYWEPGEDRFIKNRFEVPAKLYEQMFGPNSPQTLEELGDIPDAETRYKQWKEEHKDDPPSNLPPCDIIDKGQGKPYDIFNVVTSPEWTKKFYEKEPPIPYWLETRKGRKAWLQKYIPAVPHGSKYRLYFNTPDGPLERVPAWATYVQPEDEGKQAYAIHWEPSPEAAYKWKYSKPKVPESLRIYECHVGISGSEPKVSTFEEFTKKVLPHVKRAGYNAIQLIGVPEHKDYFTVGYRVTNFFAASSRYGTPDDFKRLVDEAHAADQMVGLSLFDGSNDCYFHYGKRGHHKHWGTRMFKYGDLDVLHFLISNLNWWITEYQVDGYQFHSLASMIYTHNGFASFNNDLDDYCNQYVDRDALMYLILANEILHVQHPNIITIAEDATYYPGLCEPVSQGGLGFDYYVNLSASEMWVSLLDNNKTFVLLSDVQPVLQIVSTLVANKEYADKMLSYAENHNQSISGGRSFAEILFGGVDNGSPGGKELLDRGISLHKMIRLITFTSGGRAYLNFMGNEFGHPERVEFPTQSNNFSFSLANRRWDLLESGVHHHLFSFDKELMDLDKSKGILSRGLPSIHHVNDANMVISFSRGPFLFIFNFHPSNSYEKYDVGVEEAGEYTMILNSDEVKYGGQGIVTEDHYLQRSISKRIDGQRNCLEVFLPSRTAQVYKLTRILRI

SEQ ID NO: 906 - protein, 546 aa, Bradyrhizobium japonicum
MAAKEVKFSVDARDKMLRGVDILANAVKVTLGPKGRNVVLDKSFGAPRITKDGVTVAKEIELEDKFENMGAQMVREVASKSADAAGDGTTTATVLAQAIVREGAKSVAAGMNPMDLKRGIDLAVEAVVADLVKNSKKVTSNDEIAQVGTISANGDAEIGKFLADAMKKVGNEGVITVEEAKSLETELDVVEGMQFDRGYISPYFVTNADKMRVEMDDAYILINEKKLSSLNELLPLLEAVVQTGKPLVIVAEDVEGEALATLVVNRLRGGLKVAAVKAPGFGDRRKAMLQDIAILTGGQAISEDLGIKLENVTLNMLGRAKKVMIDKENTTIVNGAGKKADIEARVSQIKAQIEETTSDYDREKLQERLAKLAGGVAVIRVGGATEVEVKERKDRVDDAMHATRAAVEEGIVPGGGVALLRASEQLKGLRTKNDDQKTGVEIVRKALSAPARQIAINAGEDGSVIVGKILENKTYAYGFDSQTGEYVNLVTKGIIDPTKVVRTAIQNAASVAALLITTEAMVAELPKKGGAGPAMPPGGGMGGMDF

SEQ ID NO: 907 - protein, 391 aa, Androstachys johnsonii
DLEPVNPADVPVTAAGALKSYKLAAKAISRLQSLPSGNISLLCDVLVKEVSDLTGYDRVMVYKFHEDEHGEVVAECRRPDLEPYLGLHYPATDIPQASRFLFMKNKVRMICDCLAPPVEVVQDGKLSQPLGLCGSTLRSPHGCHSQYMRNMGTIASLVMSVTINENDDEMEGDQQKGRKLWGLVVCHHTSPRFVPFPLRYACEFLIQVFGVQINKEVELAAQMREKHILRTQTLLCDMLLRNAPVAIITQSPNVMDLVKCDGAALYYRKKFWLLGITPTEAQIRDIAEWLLEYHSGTTGLSTDSLMEAGYPGASILGDAVCGMAAVRITSKDFLFWFRSHTAKEIKWGGAKHDPNDKEDGRKMHPRSSFKAFLEVVKRRSLPWEDMEMDAI

SEQ ID NO: 908 - protein, 392 aa, Blepharandra heteropetala
DLEPVNPADVPVTAAGALKSYKLAARAISRLQSLPSGNISLLCDVLVKEVRDLTGYDRVMVYKFHEDEHGEVISECCRPDLEAYLGLHYPATDIPQASRFLFMKNKVRMICDCLAPAVKVIQDERLPQALSLCGSTLRSPHGCHAQYMANMGTIASLVMSVIINEDNDMMDGDQQHIARKLWGLVVCHHTSPRFVPFPLRYACEFLIQVFGVQINKEVELAAQVREKHILRTQTLLCDMLLRDAPVAIITQSPNVMDLVKCDGAALYYRKKFWLLGVTPTEVQIRDTAEWLLEYHGGNAGLSTDSLMEAGYPGASDLGNAVCGMAAVRITSRDFLFWFRSHTAKEIKWGGAKHHPNDKDDVRKMHPRSSFKAFLEVVKWRSLPWEDIEMDAI

SEQ ID NO: 909 - protein, 392 aa, Lophanthera lactescens
DLEPVNPADVPVTAAGALKSYKLAARAISRLQSLPSGNISLPSDVLVKEVRDLTGYDRVMVYKFHEDEHGEVVSECCRPDLEAYLGLHYPATDIPQASRFLFMKNKVRMICDCLAPPVKVIQDERLPQPLSLCGSTLRSPHGCHAQYMANMGSIASLVMSVTVNEDDDMVDGDQQQMARKLWGLVVCHHTSPRFVPFPLRYACEFLIQVFGVQINKKVELAAQVREKHILRTQTLLCDMLLRDAPVAIVIQSPNVMDLVKCDGAALYYRKKFWLLGVTPTEAQIRDIAEWLLEYHSGNTGLSTDSLMEAGYPGTSVLGNAVCGMAAVKITSRDFLFWFRSHTAKEIKWGGAKHDPGDKDDIRKMHPRSSFKAFLEVVKWRSLPWEDIEMDAI

SEQ ID NO: 910 - protein, 380 aa, Diacidia ferruginea
ETPAGALKSYKLAARAISRLQSLPSGIISLLCDVLVKEVRDLTDYDRVMVYKFHEDEHGEVISECCRPDMEAYLGLHYPATDIPQASRFLFMKNKVRMICDCLATPVKVIQDERLPQPLSLCGSTLRSPHGCHAQYMANMGAIASLVMSVTINEDDDVMDGDRQHRARKLWGLVVCHHTSPRFLPFPLRYACEFLIQVFGVQINKEVELAAQVREKHILRTQTLLCDMLLRDAPVAIITQSPNVMDLVKCNGAALYYKKKFWLVGLTPTEAQIRDIAEWLLEYHNGNTGLSTDSLMEAGYPGASELGDTVCGMAVVKITSRDFLFWFRSHTAKEIKWGGAKHDPDDKDDGRKMHPRSSFKAFLEVVKWRSLPWEDVEMDA

SEQ ID NO: 911 - protein, 214 aa, Agrobacterium tumefaciens
MGKLQAGIIPVTPFEQNCTILFDQDTKEGVVVDPGGDVDVILQVVAENGITLKAIWLTHGHLDHAGGADELREKLSLSVIGPHEHDRPLLERIEVQAQKYGISGLKNVEPDSWLKDGDKVSFGDHVFEVYHCPGHAPGHVIYYNRDQNFAHVGDVLFSGSVGRTDLPGGNHEQLMASIRDKLLPLGDDVGFICGHGPGGRLGEERLNNPYLKGL

SEQ ID NO: 912 - protein, 392 aa, Byrsonima crassifolia
DLEPVNPADVPVTAAGALKSYKLAARAISRLQSLPSGNISLLCDVLVKEVRDLTGYDRVMVYKFHEDEHGEVISECRRPDLEAYLGLHYPATDIPQASRFLFMKNKVRMICDCLAPPVKVIQDERLLQPLSLCGSTLRSPHGCHAQYMANMGTIASLVMSVTINEDDDMMDMDQQHMAGKLWGLVVCHHTSPRFVPFPLRYACEFLIQVFGVQINKEVELAAQVREKHILRTQTLLCDMLLRDAPVAIITQSPNVMDLVKCNGAALYYRKKFWLLGVTPTEAQIRDIAEWLLEYHSGNTGLSTDSLMEAGYPGASDLGHAVCGMAAVKITSRDFLFWFRSHTAKEIKWGGAKHDPDDKDDGRKMHPRSSFKAFLEVVKWRSLPWEDMEMDAI

SEQ ID NO: 913 - protein, 475 aa, Cucurbita maxima
MKMLSTKATCNSHGQDSSYFLGWEAYENNPFHHTSNPNGIIQMGLAENQLSFDLLESWLSKNPDAASFKRDGKSIFRELALFQDYHGLPAFKKALVEFMAEIRGNKVSFEANNIVLTAGATSANETLMFCLAEAGDAFLLPTPYYPGFDRDLKWRTGVEIVPIHCTSSNGFQITQSALEQAYKDAQTRNLRVKGVLVTNPSNPLGTTMNRDELNLVFDFITSKGIHLISDEIYSGTVFGSPGFVSAMEVLKERSSEDEEVWKRVHIVYSLSKDLGLPGFRVGAIYSNDDMVVAAATKMSSFGLVSSQTQYLLSAMLSDKKFTISYISENQKRLKQRQKMLVSGLQKAGINCLDSNAGLFCWVDMRHLLESDKFESELELWKKIVYEVGLNISPGSSCHCTEPGWFRVCFANMSESTLKLAVRRLKSFVTELRSTTTSNHRNHDNKICKNIKKNIFTKWVFRQSAQEANRKMQAER

SEQ ID NO: 914 - protein, 154 aa, Lycopersicon peruvianum
MSLIPRIFGDRRSTSVFDPFSIDVFDPFKELGFTVSNSGETSAFANTRIDWKETPEAHVFKADLPGLKKEEVKVEVEEDRVLQISGERNVEKEDKNDTWHRVERSSGKFMRRFRLPENAKMDQVKASMENGVLTVTVPKEEVNNPDVKSIEISG

SEQ ID NO: 915 - protein, 155 aa, Lycopersicon peruvianum
MDLRLLGIDNTPLFHTLHHMMEAAGEDSVNAPSKIYVRDAKAMAATPADVKEYPNSYVFVVDMPGLKSGDIKVQVEEDNVLLISGERKREEEKEGAKFIRMERRVGKFMRKFSLPENANTDAISAVCQDGVLTVTVQKLPPPEPKKPKTIEVKVA

SEQ ID NO: 916 - protein, 400 aa, Saccharomyces cerevisiae
MPFVKDFKPQALGDTNLFKPIKIGNNELLHRAVIPPLTRMRAQHPGNIPNRDWAVEYYAQRAQRPGTLIITEGTFPSPQSGGYDNAPGIWSEEQIKEWTKIFKAIHENKSFAWVQLWVLGWAAFPDTLARDGLRYDSASDNVYMNAEQEEKAKKANNPQHSITKDEIKQYVKEYVQAAKNSIAAGADGVEIHSANGYLLNQFLDPHSNNRTDEYGGSIENRARFTLEVVDAVVDAIGPEKVGLRLSPYGVFNSMSGGAETGIVAQYAYVLGELERRAKAGKRLAFVHLVEPRVTNPFLTEGEGEYNGGSNKFAYSIWKGPIIRAGNFALHPEVVREEVKDPRTLIGYGRFFISNPDLVDRLEKGLPLNKYDRDTFYKMSAEGYIDYPTYEEALKLGWDKN

SEQ ID NO: 917 - protein, 477 aa, Bacillus clausii
MSNYKFPDGFLWGGAIAANQAEGAYLEGGKGLTIVDLLPTGEQRRAIMEGYVQSLIPEEGVYYPSHEAIDFYHRYKEDIKLFAEMGFKALRVSIAWARIFPTGEDEEPNEDGLLFYDRLFNELLAHNIEPVVTLAHFDVPVHLIEKYGSWRSRKLVGLFEMYAKTVFTRYKNKVKYWMTFNEINMLLHLPFLGAGLVFKEGDNKQQIQYQAAHHQLVASALAVKACHEIIPDAKIGCMLAAGSFYPYTCNPKDIFKGMEKDRESYFFIDVQSRGEYPPYAMRFFKDNQLDIAMEPGDTELLKAHTVDYIGFSYYSSRTTSTDPEVNKNQTTGNVFGSIVNPYLEKSEWGWTIDPLGFRITANQLYDRYQKPLFVVENGLGAVDEWNEEGQIDDSYRIDYLGSHLAALGEAIKDGVEIIGYTSWGPIDIVSASSGEMKKRYGYIYVDRDNEGNGTLNRAKKASFDWYKQVIATNGESL

SEQ ID NO: 918 - protein, 443 aa, Brassica napus
  misc_feature (18)..(18): Xaa can be any naturally occurring amino acid
SIFPGLKGLLPLNQKMGXVNCGETGKVEPLLQFGKSRERNPDKDPLMIWLTGGPGCSSICGFLFANGPLAFKGDEYNGTLPPLELTSFSWTKVANILYLESPAGSGYSYAKTRRAAETSDTKQIHQIDQFLRSWFVDHPEFISNSFYVGGDSYSGKIVPGVVQQISLGNEKGLTPLINIKGYVLGNPAVRTNLEPNHRVSFAHRMGLISDELHESLERNCGGKFFNVDPSNAKCSNGLLAYHQCISEIYIEQILLPNCKVDYVLADISQTLPNIRTSRRRELKEFSRNDSSSLPPPSCFTYRYFLSAFWANDENVRRALGVKKGFGKWSRCNTQNIPHTYDIHNAIPYHVNNSRKGFRALIYSGDHDMMIPFSSTEAWIKSLNYSIVDDWRPWMMTSNQVAGYTRTYANKITFAPIKGGAHTAEYNPDQCSLMFKRWIDGESL

SEQ ID NO: 919 - protein, 233 aa, Haemophilus somnus
MLIPIPALNDNYIWVYKRENLSVIVIDIPEIAALSQFIQAQNLVIGALLITHNHRDHIGALAEFKQFYPHVHIYGPAECADQGVTQVIDAGRLIIDEYHIDVLPTGGHTAQHLSFLVDGHLFCGDTLFSAGCGRVFTGDYSQMFTSLQLLKSLPDETIVCPAHEYTLGNLAFALTTGKNKSAVQKQLEKVKKLRAENNPSLPTTLALEKQINPFLQVEGLEEFIELRKAKDMF

SEQ ID NO: 920 - protein, 189 aa, Oryza sativa
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQSNFHILVVLQSFAFPYMYQVAQIYCKYPSIE

SEQ ID NO: 921 - protein, 431 aa, Thermus thermophilus
MTENAEKFLWGVATSAYQIEGATQEDGRGPSIWDAFAQRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRFFLDPILGKGYPESPFRDPPPVPILSRDLELVARPLDFLGVNYYAPVRVAPGTGTLPVRYLPPEGPATAMGWEVYPEGLYHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 922 - protein, 163 aa, Helianthus annuus
MSIIPNFFGRRRTNCFDPFSLDVWDPFEGFPFNNNNFGSLSDQVRSSSETSSFVNANVDWRETNDAHVFKADVPGLKKEEVKVEVEDDRVLQISGERNKESEEKGDTWHRVERSSGKFVRRFRLPENAKVDQVKAAMENGVLTVTVPKVEVKKPDVKSIQISG

SEQ ID NO: 923 - protein, 732 aa, Corynebacterium diphtheriae
MVSPTQITPVHPDVLHALKICQYHDPHGVYGWHEVDAERAVIRTRHIGAERVETLLSDSTVVELAAVGDDIFEAIVDHDASCDYRLRIHWQGGQVTEQADAYHFLPTLGDLDLHLINEGRHERLWEVLGANPTTITTAMGDVEGTAFAVWAPNASGVAVIGDFCGWNPSQYPMRSLGSTGIWELFIPNIGVGTVYKFAIHTHEGHRLDKADPMAKRAEVAPATGSIIASSSYTWNDDTWMTNRAHTDHDNTAMSVYEVHLGSWSQGQNYEELATNLVDYVKEMGYTHVEFLPVAEHPFGGSWGYQVSGYYAPTSRWGTPDQLRLLIDAFHQAGIGVIVDWVPAHFPKDAFALGRFDGQALYEHPDWRRGEQKDWGTYVFDFGRNEVRNFLVANALYWLEEFHVDGLRVDAVASMLYLDYSREPGEWLPNIYGGRENLEAVQFLQEMNATVHKSHPGVMTIAEESTSWPGVTSPTWEGGLGFSMKWNMGWMNDTLEYFSHEPIHRMYHHNDITFSMVYAYSEKFVLPFSHDEVVHGKGSLWTRMPGDAWNKAAGLRTLYAYMYAHPGKNLLFQGQEFGQVKEWSEERSLDWGDMDGWEGEYHRGIRTLVQDLNALYKDSPALYSQDNNPAGFSWTKSDDAANNILSFVRYGADGSKILAVFNFGGADHPSYKLGVPEGGNWKCILNTDAGIYEGEDNYLDSDVMAWDTDWDGYQHSLTVHIPAMSGQLYRWEA

SEQ ID NO: 924 - protein, 485 aa, Betula pendula
MGFMNSNAKHLLSKIATGNGHGENSPYFDGWKAFESNPFHPTKNPQGVIQMGLAENQLCFDLVQEWILKNPQASICTPEGVYDFSEIAVFQDYHGLPEFRNAVAKFMAKVRGNRVRFDPDRIVMSGGATGAHETIAFCLADPGEAFLVPTPYYPGFDRDLRWRTGVQLLPVTCESPNNFKVTRKALEAAYESAQEKNIRVKGLLITNPSNPLGTILDKQTLRELVSFINEKSIHLICDEIYAATVFSQPDFVSISEVIEEEKEIACNRDLIHIVYSLSKDMGFPGFRVGIIYSYNDAVVQCCRKMSSFGLVSSQTQHLLASMLSDDVFVDRFIAESSKRLEKRYQDFTFPLAQVGINCLKSNAGLFLWMDLRHLLKNQTPEAEMELWKVIIDEVKLNVSPGDSFHCSEPGWFRVCLAQKGQSRRRVALTRIRTFVHQNKEVKNRLKRKCWNSNLRLSFSSLRVDHDNMMSPHSPMAQSPLVRAMN

SEQ ID NO: 925 - protein, 85 aa, Verbascum nigrum
GSVSEANTQYYQQEASKLRAQISNLQNQNRNMLGESLGGLTLRDLKNLETRVEKGISRIRSKKNELLFTEIEYMQKRQEIDLHHN

SEQ ID NO: 926 - protein, 740 aa, Pleurotus ostreatus
MSSVTAAAKQAVSSITDNAKMASLTQFRVECGPSQRMTTDQGLHVADTDNCNSNVGPALLEDHIAREKIMRFDHERIPERVVHARGAGAHGYFKAYDSSAEQWTKAKVLMDPSRTTPVFVRFSTVQGSRGSADTVRDVRGFAVKFYTEEGNWDIVGNNIPVFFIQDAIKFPDIIHAVKPEPHNEVPTGQSAHNNFWDFVGLQPESAHMIMWVMSDRAIPRSYRMMQGFGVNTYTLLNATGEKHFVKFHWIPELGVHSLVWDEALKIAGQDPDFHRKDLNEAIESGAYPKWRLALQVISEKDEHNFDFDILDATKIWPEELVPLHFVGEMVLNKVVDEYFAEVEQVAFCTSNIVPGIGFSDDPLLQGRNFSYLDTQLSRLGINWQQIPINRPVCPVMNFQRDGQMQMKIHKGTVNYWPNRQEAVQPVAVSEGGYDDHVRKISGIAQRMRGPKFNEHYSQAQLFYNSLSPTEQTHLQSALAFELSHCEDPAVYRNYINILNNIDYQLAKYVAVAVGGDVPDASAKPNEGNKSARLSQVYYAPKEPTIKGRRIAILLADGFDKAEVVAIKALITSASANAFVIGPRRGKVYAAGEKIGVEGGGIDADHHFEGQRSTMFDALVIPSGEHVALLMKSGRAVHWLREAFGHCKAIGAVGEAILFVQQAINLPEVQYADPTDSSMEVVASYSVVTTAHYGVSTAIGDATKMTLNIGEKGFMERFAYEVSKHRCFKREEDGLTARIAY

SEQ ID NO: 927 - protein, 367 aa, Betula pendula
QMGLAENQLCFDLIEEWIKKNPKASICTAQGVNELKNIAIFQDYHGLPEFRQAVANFMGRVRGGRVRFDPDRIVMSGGATGANELITFCLADPGDVFLVPSPYYPAFDRDMGWRTGVQILPVHCDSSNGFLITKAALEAAYEKAQEENIKIKGLLIANPSNPLGTVLDRETLTSVVSFVNEKNIHLVCDEIYSATVFGSATFTSISEIIEEVEYCNRDLIHIVYSLSKDMGLPGFRVGIVYSYNDAVVSCGRKVSSFGLVSSQTQHLLASLLSDEEFVGKYLSESSKRLAKRHDMFTKGLEKAGISCLKSNAGLFVWMDLRWLLEKQTFEEELVLWRVIINQVKLNVSPGTSFHCSEPGWFRVCFAA

SEQ ID NO: 928 - protein, 134 aa, Zea mays
MRKHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVDEGASA

SEQ ID NO: 929 - protein, 368 aa, Betula pendula
QMGLAENQVSFDLLEEYLEKHSEASTWGKGASGFRENALFQDYHGLLSFRKAMASFMEQIRGDRVKFDPERVVLTAGATAANELLTFILADPGDALLVPTPYYPGFDRDLRWRTGVKIVPIHCESSNNFQITPKALEDAYNNAEAMNIKVRGVLITNPSNPLGATIQRSVLEEILDFVTRKNIHLVSDEIYSGSVFSSSEFISVAEILEAREYRKEYSERVHIVYSLSKDLGLPGFRVGTIYSYNDDVVKTARRMSSFTLISSQTQHLLASMLSNKKFTENYIQINRERLRKRYEMIIEGLRSAGIECLKGNAGLFCWMNLSPLLDEPTREGELVVWDSMLHEVKLNISPGSSCHCSEPGWFRVCFAA

SEQ ID NO: 930 - protein, 220 aa, Oryza sativa
MVMNPDAVRNVVGIIGNLISFGLFLSPLPTFVTIVKKKDVEEFVPDPYLATFLNCALWVFYGLPFIHPNSILVVTINGTGLLIEIAYLAIYFAYAPKPKRCRMLGVLTVELVFLAAVAAGVLLGAHTYDKRSLIVGTKQVIATKSVEYMPFTLSLVSFINGICWTIYAFIRFDILITIPNGMGTLLGAAQLILYFCYYDGSTAKNKGALELPKDGDSSAV

SEQ ID NO: 931 - protein, 392 aa, Coleostachys genipifolia
DLEPVNPADVPVTAAGALKSYKLAARAISRLQSLPSGNISLLCDVLVKEVRDLTGYDRVMVYKFHEDEHGEVVSECRRPDLEAYLGLHYPATDIPQASRFLFMKNKVRMICDCLAPPVKVIQDKRLVQPLSLCGSTLRSPHGCHAQYMANMGAIASLVMSVTINEGDDTMDGDQQQMARKLWGLVVCHHTSPRFVPFPLRYACEFLIQVFGVQINKEVELAAQVREKHILRTQTLLCDMLLRDAPVAIITQSPNVMDLVKCDGAALYYRKKFWLLGVTPTEAQIKEIAQWLIEYHSGDTGLSTDSLMEAGYPSASVLGDAVCGMAAVKITSRDFLFWFRSHTAKEIKWGGAKHDPDDKDDGRKMHPRSSFKAFLEVVKWRSLPWEDVEMDAI

SEQ ID NO: 932 - protein, 553 aa, Alkalilimnicola ehrlichei
MAAKEIRFSDDARQRMMKGVNTLANAVKATLGPRGRNAVLDKSFGAPTVTKDGVSVAKEIELEDKFENMGAQMLKEVSSQTSDIAGDGTTTATVLAQAILREGMKAVAAGMNPMDLKRGIDKGVSAATKYLADELSKPCETDTSIAQVGSISANSDESVGRIIADAMQKVGKEGVITVEEGSGLENELDVVEGMQFDRGYLSPYFINNQQSMKAELEDAFILLHDKKISNIRDLLPLLENVAKANKPLLIISEDIEGEALATLVVNSIRGIVKVAAVKAPGFGDRRKAMLQDIAVLTGGTVISEEVGLSLEKATLDDLGQAKKVDVSKEETTIVGGAGRHDDIMARVEQIRAQIEESTSEYDKEKLQERVAKLAGGVAVIKVGATSEIEMKEKKARVEDALHATRAAVEEGIVPGGGTALLRAQASLDGLEYANHDQEVGINIVRRAMEEPLRQIVYNAGGDGAVVVNEVRNGEGNYGYNAQSGEYGDLVEMGILDPTKVTRTALQNAASVAALMITTEVMVADLPKDDDAGAGGGMGDMGGMGGMGGMGGMM

SEQ ID NO: 933 - protein, 392 aa, Acmanthera latifolia
DLEPVNPADVPVTAAGALKSYKLAARAISRLQSLPSGNISLLCDVLVKEVRDLTGYDRVMVYKFHEDEHGEVVSECRRPDLEAYLGLHYPATDIPQASRFLFMKNKVRMICDCLAPPVKVFQDKRLAQPLGLCGSTLRSPHGCHAQYMANMGAIASLVMSVTINEGDDMIDGDQQQMARKLWGLVVCHHTSPRFVPFPLRYACEFLIQVFGVQINKEVELAAQVREKHILRTQTLLCDMLLRDAPVAIVTQSPNVMDLVKCDGAALYYRKKFWLLGVTPTEVQIKEIAEWLIEYHSGNTGLSTDSLMEAGYPGASVLGDAVCGMAAVKITSKDFLFWFRSHTAKEIKWGGAKHDPDDKDDGRKMHPRSSFKAFLEVVKWRSLPWEDMEMDAI

SEQ ID NO: 934 - protein, 744 aa, Calothrix viguieri
MTETSPKPIVTTAAFPANEVERLEALRRYNILDTPPEVAFDRITSLAARLFNVPITLVSLVDESRGWFKSSYGFEMREVRRDTTICSFALLSDEVLVIPDTREDSRLVCNPFVQNEPGLRFYAGAPLLTQDGFNLGTLCLLDTKPRDGLSDEQKSVLSDLAAMVMDELELRLAARKVAQMDTALLEVTQGVSTATGEAFFSALVQHMLKVLGVDYVYIGLVDPDNQEIIRTIAACAKGQIIGNFEYLLHDTPCEQVLQKRKLCCYPHRVQALFPKAPLLEPLGVESYVAVPFFDTTGIPLGLLGVMDGNALTNIQLAESLLTIFALRIATELERQQTEAARQQAQYELERLVEQRTTELSKANELLKVLLDNVQAGIVACDAEGILTLFNQAARQFHGLPEQALPPEEWAKHYDLYLPDGKTRMSKNEIPLFRALQEQTVKNVEMVIAPKHGKVKTLLASGQAIVDNEGKKQGAVVVMHDITERKIAEAERIQLIRQQVQEQSARLKAEEANRLKDEFLAVLSHELRTPLNPILGWTKLLRAGKLDSAKTDYALETIERNAKLQTQLIGDLLDVSRILQGKLSLNMAAVNLAPTISAAIETVQLAAQAKSIQIETVFDPNVGQVLGDSTRLQQVVWNLLSNAVKFTKNGGRVEIRLECVDSQAEIKVSDTGKGISPDFLPHVFESFRQADATITRKFGGLGLGLAIVRHLVELHGGTIYAESPGEDLGATFTVRLPLIAVVKTC

SEQ ID NO: 935 - protein, 392 aa, Pterandra arborea
DLEPVNPADVPVTAAGALKSYKLAARAISRLQSLPSGDISLLCDVLVKEVRDLTGYDRVMVYKFHEDEHGEVVSECRRPDLEAYFGLHYPATDIPQASRFLFMKNKVRMICDCLAPPVQVIQDKRLAQPLSLCGSTLRSPHGCHAQYMANMGAIASLVISVTINEGDDMMDGDQQQMARKLWGLVVCHHTSPRFVPFPLRYACEFLIQVFGVQITKEVELAAQVREKHILRTQTLLCDMLLRDAPVAIITQSPNVMDLVKCDGAALYYRKKFWLLGVTPTEAQIKEIAEWLLEYHSGNMGLSTDSLMEAGYPGASVLGNAVCGMAAVKITSRDLLFWFRSHTAKEIKWGGAKHDPDDKDDGRKMHPRSSFKAFLEVVKWRSLPWEDVEMDAI

SEQ ID NO: 936 - protein, 467 aa, Zea mays
MMLKDLAAIQHQQQQLAADENMSNLTSASGDLQASVSSHPAPPPAKKKRSLPGNPDPDAEVIALSPRTLMATNRYVCEVCGKGFQRDQNLQLHRRGHNLPWKLKQRNPKEAVRKKAYVCPEPGCVHHDPARALGDLTGIKKHFSRKHGEKKWKCDRCAKRYAVHSDWKAHSKVCGTREYRCDCGTHFSRRDSFITHRAFCDALAEESARAVTAAAAVVVGQQQAAGGGDGSAGLHLPPDVLDPSQTLGGGHGMSLQELCLKREQQQQFAPSSWLTAHHQQELPGSARLLEQHEYIGSSTPESTAGLSGFVGLSPSAAGEAAASAHMSATALLQKAAQMGATLSRPSNQEQMASTHSHSSTTNAGTGSASAAAAAAINVPGTGAGAFGFGAPHHFGAEERTTTSADRDACGNAAAVSVVGANDGFTRDFLGLRAFSHGDILTMAGFDPCMSSAAYEQGHHQSSKQWHV

SEQ ID NO: 937 - protein, 392 aa, Galphimia gracilis
DLEPVNPADVPVTAAGALKSYKLAARAISRLQSLPSGNISLLCDVLVKEVRDLTGYDRVMVYRFHDDEHGEVVSECCGPDLEAYLGLHYPATDIPQASRFLFMKNKVRMICDCLAPPVKVLQDERLPQPLSLCGSTLRSPHGCHAQYMANMGTMASLVMSVTINEDDNMLDGDQQHMARKLWGLVVCHHTSPRFVPFPLRYACEFLIQVFGVQINKEVELAAQMTEEHILRTQTLLCDMLLRDAPVAIITQSPNVMDLVKCDGAALYYRKKFWLLGVTPTEAQIRGIAEWLLEYHGGNTGLSTDSLMEAGYPGASVLGDAVCGMAAVKITSRDFLFWFRSNTAKEIKWSGAKHDPGDKDDIKKMHPRSSFKAFLEVVKWRSLPWEDVEMDAI

SEQ ID NO: 938 - protein, 474 aa, Pyrus communis
MHMLSRNATFNPHGQDSSYFLGWQEYEKNPYHEVHNTNGIIQMGLAENQLCFDLLESWLAKNPEAAAFKKNGESIFAELALFQDYHGLPAFKKAMVDFMAEIRGNKVTLDPNHLVLTAGATSANETFIFCLADPGEAVLIPTPYYPGFDRDLKWRTGVEIVPIHCTSSNGFQITETTLEEAYQEAEKRNLRVKGVLVTNPSNPLGTTMTRNELYLLLSFVEDKGIHLISDEIYSGTAFSSPSFISVMEVLKDRNCDKNSEVWQRVHVVYSLSKDLGLPGFRVGAIYSNDDMVVAAATKMSSFGLVSSQTQHLLSAMLSDKKLTKNYIAENHKRLKQRQKNLVSGLQKAGISCLNGNAGLFCWVDMRHLLRSNTFEAEMELWKKIVYEVHLNISPGSSCHCTEPGWFRVCFANLPERTLDLAMQRLKAFVGEYYNVPEVNGRSQSSHLSHSRGQSLTRKWVSRLSFDDRCSIHGR

SEQ ID NO: 939 - protein, 392 aa, Acridocarpus natalitius
DLEPVNPADVPVTAAGALKSYKLAAKAISRLQSLPSGNISLLCDVLVKEVRDLTGYDRVMVYKFHEDEHGEVVSECRRSDLEAYLGLHYPATDIPQASRFLFMKNKVRMICDCLAPPIKVIQDERLPQPLSLGGSTLRSPHGCHAQYMANMGTIASLVMSVTINEDDDMMDGDQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGITPTEAQIRDIVEWLLEFHSGNTGLSTDSLMEAGYPGASVLGDAVCGMAAVSITSKDFLFWFRSHTAKEIKWGGAKHDPDVKDDGRKMHPRSSFKAFLEVVKWRSLPWEDVEMDAI

SEQ ID NO: 940 - protein, 446 aa, Pyrus communis
MAIDIEQQQQPSPGLSKIAISDTHGEDSPYFAGWKAYDENPYHESSNPSGVIQMGLAENQVSFDLLEKHLEENSEASNWGSKGSKGASGFRENALFQDYHGLLSYKKAMANFMEQIRGGRAKFDPVRVVLTAGATAADELLTFIIADPGDALLVPTPYYPGFDRDLRWRTGVNIVPIHCESSNNFQITPQALEAAYKEAEARNMRVRGVLFTNPSNPLGATIQRTVLEEILDFVTQKNIHLVSDEVYSGSAFSSSEFISVAEIMEDRQYKDAERVHIVYSLSKDLGLPGFRVGTVYSYNDKVVTTARRMSSFTLISSQTQHLLASMLSDKEFTENYIKTNRERLRRRYDMIVEGLKKSGIECLKGNAGLFCWMNLSPFLDEPTRESELTLWDSMLHEVKLNISPGSSCHCSEPGWFRVCFANMSEQTLGIALTRIHNFMEKRERAC

SEQ ID NO: 941 - protein, 670 aa, Bacteroides fragilis
MEKTLNLIKNDPWLEPYKDAIVGRFEHAMDKKAELTNGGKSTLSDFASGYLYFGLHRTDKGWIFREWAPNASHIYMVGTFSNWEEKPAYKLKRLKNGSWEIKLPIDAIQHGDLYKLHVYWEGGQGERIPAWANRVVQDDNTKIFSAQVWAPEKPFKFKKKTFKPSTDPLLIYECHIGMAQQEEKVGTYNEFREKILPRIAKEGYNCIQIMAIQEHPYYGSFGYHVSSFFAASSRFGTPEELKQLIDTAHGLGIAVIMDIVHSHAVKNEVEGLGNFAGDPNQYFYPGGRREHPAWDSLCFDYGKNEVMHFLLSNCKYWLEEYHFDGFRFDGVTSMLYYSHGLGEAFCNYGDYFNGHQDDNAICYLTLANELIHEVNPKAITIAEEVSGMPGLAAKVEDGGYGFDYRMAMNIPDYWIKTIKEKIDEDWKPSSMFWEVTNRRQDEKTISYAESHDQALVGDKTIIFRLIDADMYWHMQKGDENYIVHRGVALHKMIRLLTASTINGGYLNFMGNEFGHPEWIDFPREGNGWSCKYARRQWDLVDNKNLTYHYLGDFDADMLKVIKSVKNIQQTPVQEIWHNDGDQVLAYQRKDLVFVFNFNPSQSFTDYGFLVTPGTYEVVLNTDNIIYGGNGLSDDSVKHFTLPDPLYKKEKKEWLKLYIPARTAMVLRRTK

SEQ ID NO: 942 - protein, 446 aa, Pyrus communis
MAIDIEQRKQPSPRLSKIAVSDTHGEDSPYFAGWKTYDENPYHESSNPSGVIQMGLAENQVSFDLLENHLEENSEASTWGSKGSKGVSGFRENALFQDYHGLLSFRKAMASFMEQIRGGRAKFDPARVVLTAGATAANELLTFVIADPGDALLVPTPYYPGFDRDLRWRTGVNIVPIHCESSNNFQITPQALEAAYKEAEAKNMRVRGVLFTNPSNPLGATIQRTVLEEILDFVTQKNIHLVSDEIYSGSAFSSSEFISVAEILENRQYKDAERVHIVYSLSKDLGLPGFRVGTVYSYNDKVVTTARRMSSFTLISSQTQHLLASMLSDKEFTENYIKTNRERLRRRYDMILEGLKKSGIECLKGNAGLFCWMNLSPFLDEPTRESELTLWDSMLHEVKLNISPGSSCHCSEPGWFRVCFANMSEQTLGIALTRIKNFMEKRERAC

SEQ ID NO: 943 - protein, 506 aa, Unknown
  Acinetobacter sp. ADP1
MSDDKLKCPVTHLTTDAGAPVVDNQNSMTAGARGPLLTQDLWLNEKMANFAREVIPERRMHAKGSGAFGTFTVTHDITQYSRAKIFSEIGKKTEMFARFSTVAGERGAADAERDIRGFALKFYTEEGNWDMVGNNTPVFFMRDPRKFPDLNKAVKRDPKTNLRSATYNWDFWTLLPEALHQVTIVMSDRGIPDGYRHMHGFGSHTYSFINASNERFWVKFHFRTQQGIKNLTDAEAEAIVAKDRESSQSDLFNAIEQGNYPKWTMFVQIMPETDAEKVPYHPFDLTKVWPHGDYPLIEVGEFELNRNAENYFQDVEQATFAPSNLVPGISYSPDRMLQARLVNYADAHRYRVGVNHTQIPVNAPRCPVHSNRRDGQGRMDGNYGGLPHYEPNSFHQWQEQPEFREPPLKITGDADFWDFRQDDSDYFSQPRALFNLMNDEQKQALFGNTARAMGDALDFIKYRHIRNCYACDPAYGEGVAQALGMTVADAQAARDSDPAKGHPGFL

SEQ ID NO: 944 - protein, 147 aa, Geobacter sulfurreducens
MAIVKYSPFRDMMNMQEQMNRLLDLAWSKQGGEELREGAWQPPVDIFEDENAVIIKAELPGIDQKDIEVRIEDNTLTIRGERKHEEEVRKENYHRVERYYGSFQRSFSIPATIDQEKVRASSDKGVLTITLPKREEVKPKQITVEVT

SEQ ID NO: 945 - protein, 632 aa, Coxiella burnetii
MCGIAGIFNLNGKPVAFDQIKAMTDSIAHRGPDGEGQFTDKYIGLGHRRLAIIDLSPAGHQPMQTKDGRYLITYNGEVYNFKILRKELETLGYSFFSNTDTEVVLNAYVQWGEKCLEKFNGMFAFAVWDRKEKTLFLARDRYGIKPLYYYQTNDCFVFASEIKAIIASGLYGAEINKEALVEYLTFQNFFTDRTLFKDVRIMPAGHFMMVKRENSSLHQYWDFNFTNDSALSEKMLLEKINDLFQQAVNRQLVSDVPVNSYLSGGVDSGSITMIAAKQLPHIRTFTVGFDLSSASGLELAFDERQAAEHLSYLAGTEHYEMVLKAGDMERCMQDLVWHLEEPRIGQSYPNFYAAKLASKFGKVVLAGTGGDELYAGYPWRYLCGQSSENFEDYIDKYYQYWQRLMSNKNLFKVLAPIAEEVKSIWTRDIFANVFRIKDTPIKTEDYINYSLYFEAKTFLHGLLVVEDKLSMAHGLETRVPCLDNDFVDFALQVPVKYKLSDFAFERVNENDTFSKREKRMNGKKILRKMMSRYVPDNVAHAPKQGFSAPDASWFKGESIEFVRSLLGDRNAKIFELLDYSVVNHLVNDHIQNHHNHRLLIWSLIYLEIFMQVHLSKGHKSNYHLFTPETVEL

SEQ ID NO: 946 - protein, 484 aa, Enterococcus faecalis
MKNQHLTTSQGSPVGDNQNSLTAGEFGPVLIQDVHLLEKLAHFNRERVPERVVHAKGAGAHGIFKVSQSMAQYTKADFLSEVGKETPLFARFSTVAGELGSSDTLRDPRGFALKFYTDEGNYDLVGNNTPIFFIRDAIKFPDFIHSQKRNPRTHLKSPEAVWDFWSHSPESLHQVTILMSDRGIPLSFRHMHGFGSHTFKWVNAAGEVFFVKYHFKTNQGIKNLESQLAEEIAGKNPDFHIEDLHNAIENQEFPSWTLSVQIIPYADALTMKETLFDVTKTVSQKEYPLIEVGTMTLNRNPENYFAEVEQVTFSPGNFVPGIEASPDKLLQGRLFAYGDAHRHRVGANSHQLPINQAKAPVNNYQKDGNMRFNNGNSEINYEPNSYTETPKEDPTAKISSFEVEGNVGNYSYNQDHFTQANALYNLLPSEEKENLINNIAASLGQVKNQEIIARQIDLFTRVNPEYGARVAQAIKQQAHHHHHH

SEQ ID NO: 947 - protein, 1122 aa, Stellaria longipes
MASRAQSQSSTNSGRSKHSARIIAQTIQDAKFHAEFEESSNEFDYSSSVRGSTSGVNQLPKSDKVTSSYLLQIQKGKFIQPFGCLLALDDKTFRVIAFSENAPEMLTMVSHAVPSVGDLPVIGIGTDIRTIFTGPSASALQKALGFTDVSLLNPILVHCKNSGKPFYAIVHRVTRSLVIDFEPVKPYEVPMTAAGALQSYKLAAKAITRLQSLPSGNMVRLVDTMVQEVFELTGYDRVMAYKFHDDDHGEVVSEVTKPNLDSYLGLHYPATDIPQAARFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELENQFLEKKILRTQTLLCDMLIRDAPLGIVTHSPNIMDLVKCDGAALLYNNKVWRLGSTPTDYQLQEIGGWLSRDHMDSTGLSTDSLYDAGYPAALELGDSVCGMAAVSITVNDMLFWFTSHTAAEIKWGGAKHEAGEKDDGSKMHPRSSFKAFLEVVKRRSVPWKDYEMDAIHSLQLILRNAFKDGEAADLNTSVIHSKISDLQISGLKELEAVTSEMVRLIETATVPIFAVDSDGLVNGWNTKIYELTGIPVEEAVGKHIAALVEDSSIDNVKQMLQSALQGEEKKNVQFEVKRHHSIPDSGPISLIVNACASKDVNGNVVGVCLIAQDITGQKTVMDKFLRIEGDYKAIIQSPNPLIPPIFGTDEFGWCSEWNPAMAKLTGWTREEVIDKMLLGEVFGMHKSCCRLKNQEAFVNLGVLLNGAMSGQNIEKLSIGFFTRSGKYIECLLCVNKKLNGEGDVTGVFCFLQLASHDLQHALHIQRLAEQAATKRANVLAYMKRQIKNPLAGIIFSGKILDGTNVDEKQRLVLQTSARCQGQLNKILDDSDLDSIIDGYCELEMVEFAVQDILVASISQVMAKSSEKGIQMSNNCTEHGFKETLYGDSLRLQQILADFLSISVNFTSPGGHIGVTVRLTKDKIGESVQLANLEFRIMHTGGGISEELLSEMFESRGNASEDGISLLISRKLVKLMNGDIQYLRSAGTSTFIISVELAVAGNSS

SEQ ID NO: 948 - protein, 226 aa, Pinus halepensis
DDQQDIRRGKGKVDSLFQAPMGSGTHNAIMSSYDYISTAQRTYSLDNMMDGYYIAPAFMDKLVVHISKNFMNLPNIKVPLILGIWGGKGQGKSFQCELVFAKLGINPIMMSAGELESGDAGEPAKLIRKRYREAADIVKKGKMCVLFINDLDAGAGRMGSTTQYTVNNQMVNATLMNIADNPTNVQLPGMYNKEENPRVPIVVTGNDFSTLYAPLIRDGRMEKFYW

SEQ ID NO: 949 - protein, 162 aa, Zea mays
MSLIRRGSAFDPFSLDLWDPFQGFPFGSGSSSSSSLFPSFGGTTTSSETAAFAGARVDWKETPEAHVFKTDVPGLKKEEVKVELEDGNVLQISGERSKEQEEKTDTWHRVERSSGKFLRRFRLPENARTEQISASMENGVLTVTVPKEEAKKADVKSIQISG

SEQ ID NO: 950 - protein, 483 aa, Thermococcus kodakarensis
MCLIAGGMGGNLREKLIKMAIAGKHRGPESFGVWTDGGVLKSDDFSKLTEIPDGRIGLLQCRLAITGSKSFTQPFINDLALVHNGEIYNHAALREYLERRGVSFESDVDSEVVLRLIEFLREEHLSYPEIVKKLFWMLEGDYAVAFSDGERIYLFRDPLGIRPLYFSRNGLFASEKKVLWAVGEREVEPVQPGELVVLEKNGVRRARLFSLENLKSKAKCERKDPVGGVGKLLRYAVKNRVSKKTGVLFSGGLDSTLVAYLASQYSDVILYTAGTEDSPDIEWARKVADHFGWALRERTFEVEDVRDAVKRVMYAIEEPNPMNLAIGLPLYFASGLASSDGTRVLLSGQGADELFGGYAKYLERPELMEEDIALISERNLARDDKITMLNGVEGRYPFLALPVVSFALKLPLEAKIVDGTRKVILRKLALRLGIPEWIAEREKRAAQYGSRAQKLLEKIAREEGLTLREFAEKLFRETFPNAF

SEQ ID NO: 951 - protein, 256 aa, Zea mays
  misc_feature (175)..(175): Xaa can be any naturally occurring amino acid
  misc_feature (193)..(193): Xaa can be any naturally occurring amino acid
  misc_feature (209)..(209): Xaa can be any naturally occurring amino acid
RTLSLRLKVKIIRYAPCGEIVKHASRLEQEIEENPASIPFQEIIYCNLGNPQVLGQPPLTFFREVLSLCDNPALMDRDEARALFSPCSIRRARRILNSIPSKDTGGYTDCRGIKCLRQVVADGITARDGFPSTADDIFLTDGATSAINLMMQILIRSHEDGILSPLPEYPLYSAXIILHGGTMVPYNLTEDNXWGLEIFEVKRCLEEAXSAGLTGRAMVVINPGNPTGQVYQENIYAENKKFHSFKKGARSLAYDE

SEQ ID NO: 952 - protein, 1268 aa, Vibrio cholerae
MKSLISVPKFSLRSWLMSLWLPLGLLVIGYFVATSKVDQQQQTQAKRISDAVTVRLNLIAAGVQEKVTLYQYGLRGIRTAVMLLSPEHFDYNDMQAYTQARDYKREFPGARGFGLIIKVEPNQTAAFLDRMAAERPSYNFQIRQLTPHQDSLFVITYIEPEQNNREAVGVDIGSEAMRRKAALDAAFNNDVRLTAPITLVQANERAQQGFLILMPVYKTTTVPQDSRQRLEHLFGWSYATILINDVLNSVAGLENDVFLQISDITEQTPIEFFSQEVKDTYDAALQQKLNLSVFGRQWQLSLTPTNRFINELQLRSGTSLFFEVMAVSTILAFGVYLLQLMLMRRSQLIRHKQELASIAEQTLLKANAELEQQVALRTAEISRVNILQRSILSSAGYAIIATDEEGIITAFNPAAEKLLGYRAEEVLFQQTPSIFHLPAEVEHHAAKLTTELGSNIAVGFETLVAKARLGQTDNARWTYLTKTGEQVQVKLNVSALKDEQGQLAGFLSIAFDLTKQLKYEAELAQAKEQAESANKAKSEFLANMSHEIRTPMNGVLGLLQLVANSTLDQRQADYIEKAYSAAKSLLTLLNDILDFSKIEAGKLELDPHPFSLTDLMQDIGLVFSSSAEQKGLEVLYDVTADVPEHLLGDSFRIKQVLINLVGNAIKFTDKGEILISIRSQSLPEGEINLSFSIKDTGIGITLEQQNALFSGFQQADSSISRRYGGTGLGLAISKRLVNLMGGEIGVESEFGCGSTFSFNVVVRNAEKRAIQNSQTFTRSNEKLSVLIVDDNDSSRIILQGIAVSLGWQAKIASDAQEASLLVKQAHRDSTRYDVVFVDWRMPGKDGLTFARELRELHSSVVSLIVMITAHGKELLDEQNNDYERYLDGFLIKPVTKNMMLQAVKSVVFGDLDLSLPTSPLPHELPLQGISLLLVEDNLTNQLVASELLQQLGATIKIASSGEEALEMLESTAEHFDMVLMDIQMPGMDGYQTTREIRKLPRHQLLPIIAITAHAMSDDIAACLAAGMQDHIAKPFDLNELTTKILSHHKAEKAPHVKQVNKSNLNFDQAALAFCQQHHIELEAAVQRLGYSLTIYVNVLKQFEQDLRQALQQLEDKTLTRRNARLLFHSLKGAAGTLGFSNLAKLTARLEDELREHSDDGYQVDNNVLDILKLTLNTATDLVKLLQVEQQIATAQAPVSRTEQAAQLMTLKQHLNLANMAALPLYQQLAPSLQAQTPELNKELEEALVNLTFEQAVVIVDKMLSQFKE

SEQ ID NO: 953 - protein, 420 aa, Thermus thermophilus
MGPLLVWHRGDLRLHDHPALLEALARGPVVGLVVLDPNNLKTTPRRRAWFLENVRALREAYRARGGALWVLEGLPWEKVPEAARRLKAKAVYALTSHTPYGRYRDGRVREALPVPLHLLPAPHLLPPDLPRAYRVYTPFSRLYRGAAPPLPPPEALPKGPEEGEIPREDPGLPLPEPGEEAALAGLRAFLEAKLPRYAEERDRLDGEGGSRLSPYFALGVLSPRLAAWEAERRGGEGARKWVAELLWRDFSYHLLYHFPWMAERPLDPRFQAFPWQEDEALFQAWYEGKTGVPLVDAAMRELHATGFLSNRARMNAAQFAVKHLLLPWKRCEEAFRHLLLDGDRAVNLQGWQWAGGLGVDAAPYFRVFNPVLQGERHDPEGRWLKRWAPEYPSYAPKDPVVDLEEARRRYLRLARDLARG

SEQ ID NO: 954 - protein, 582 aa, Kluyveromyces lactis
MGKMSFIEGLQKRFFLGYSYKYNTFELDPIILATSIKVAVLDYFRNTPWYWIIRDAVFYHLLFNVLSRIILYIRGYGLLTSISKLFHYASRRLFEVLLSLPMVRGSVDKEVSKVLATIEKDMIKNDANLKDFPELPRTGLSEADVLKELDKLNSVLKHSDWENGKVSGAVYHGGDDLIDLQSKAFKKFCVANQLHPDVFPGVRKMEAEVVSMVLNLFNAPPTGCGTTTSGGTESLLLACVSAKMLGLRYKGITEPEIIIPKTAHAGFDKAGYYFGIKIHHVDLDPVTFQADVKQMRKLINRNTVMLAGSAPNFPHGIIDDIVSIGKLGETYKIPVHVDCCLGSFIVAFMSKAGFNDVPLFDFRVPGVTSISCDTHKYGFAPKGSSVIMYRNPELRKQQYYVSTEWTGGLYGSPTLAGSRPGALVVGCWATMVHVGADGYINSCKDIVGKARELKEFIQKEIPELQILGDPLCSVISFTSNKIDIYELSDTLSKSGWHLSALQNPSSIHLALTKLSLKSVDELKHLLKSTVDKMKQSPDAKPSSDGTSALYGVAGSVKTVGVADRLIEGFLDSLYKLEPEHAT

SEQ ID NO: 955 - protein, 612 aa, Arabidopsis thaliana
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGENLEGIQDSSDQITTSLGKNGCQ

SEQ ID NO: 956 - protein, 569 aa, Zea mays
MAAVTPPPQSDLSPQTGRPASSAATAAKPGRGAAGATGRLVGKYKLGRLLGHGTFAKVYQARHVDTGESVAIKVLDKEKAVERGLVSHIKREIAVLRRVRHPNIVHLFEMMATKTKIYFVMELVRGGALFSRVSKGRLREDTARRYFQQLVSAVGFCHVRGVFHRDLKPENLLVDEHGNLKVSDFGLSAVADQFHPDGLLHTLCGTPAYLAPEVLGRRGYDGAKADVWSCGVILFVLMAGYLPFHDKNIMDMYRKIYKGEFRCARWFSQDLTSLLTRILDTDPNTRITLPEIMESRWFMKGFKPVKFYIEDDQLHNIIDDEDVPLDMGSPGSVPPPLPPSPPPLPPPKVDGDESGSDSDSSISSCPASLLSDESQRPRCSLPRPASLNAFDIISFSRGFNLSRLFEDKGDEVRFISVEPMSDITTTLEDIAKLKSFKMRRKDWRICLEITREGVKGPLTIAAEIFELTPPLVMVEVKKKAGDTQEYEDFCNKDLKPGMQHLVHRMVRSQRILLLIFERTDFTNYMLETSEGFELNMHGTIDNRNDIPTGLTFGLSEPHEARDSIDQKRS

SEQ ID NO: 957 - protein, 242 aa, Populus tremuloides
MGRGRVQLKRIENKINRQVTFAKRRNGLLKKAYELSVLCEAEVALIIFSNRGKLYEFCSGSSMLKTLERYQKCNYGAPEPNVSAREALELSSQQEYLKLKARYEGLQRTQRNLLGEELGPLSSKDLESLERQLDMSLKQIRSTRTQYMLDQLNDLQHKEHMLTAANKSLKERLMEGYQLNSLQLNPSAEDVEYARQQAQPQGDGFFHALECEPTLQIGYQPENITMVTAGPSMTTYMPGWLA

SEQ ID NO: 958 - protein, 392 aa, Acridocarpus macrocalyx
DLEPVNPADVPVTAAGALKSYKLAAKAISRLQSLPSGNISLLCDVLVKEVRDLTGYDRVMVYKFHEDEHGEVVSECRRSDLEAYLGLHYPATDIPQASRFLFMKNKVRMICDCLAPPVKVIQDERLPQPLSLCGSTLRSPHGCHAQYMANMGTIASLVMSVTVNEDDDMMDGDQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGITPTEAQIRDIVEWLLEYHSGNTGLSTDSLMEAGYPGVSVLGDAVCGMAAVSITSKDFLFWFRSHTAKEIKWGGAKHDPDDKDDGRKMHPRSSFKAFLEVVKWRSLPWEDMEMDAI

SEQ ID NO: 959 - protein, 392 aa, Triaspis hypericoides
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCVAPPVKVIQDKRLPQPLSLCGSTLRSPHGCHAQYMTNMGIIASLVMSVTVNEEDDMVDGDQLQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSTDFLLWFRSHTAKEIKWGGAKHDPDDKDDGRKMHPRSSFKAFLEVVKWRSMPWEDVEMDAI

SEQ ID NO: 960 - protein, 392 aa, Triopterys rigida
DLEPVNPADVPVTAAGALKSYKLAAKAISRLQSLPSGNISLLCDVLVKEVRDLTGYDRVMVYKFHEDEHGEVVSESRRSDLESYLGLHYPATDIPQASRFLFMKNKVRMICDCLAPPVKVIQDERLSQPLSLCGSTLRSPHGCHAQHMTNMGTIASLVMSVTVNEDDDMVDGDQPQMTRKLWGLVVCHHTSPRFVPFPLRYACEFLIQVFGLQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASAVGDAVCGMAAVSITSRDFLFWFRSHTAKEIKWGGAKHDPDDKDDGRKMHPRSSFKAFLEVVKWRSMPWEDVEMDAI

SEQ ID NO: 961 - protein, 542 aa, Rhodobacter sphaeroides
MSAKEVRFGTDARGRMLKGINTLADTVKITLGPKGRNVILDTSYGAPRITKDGVTVAREIELSDRFENVGAQMVKEVASRTNEEAGDGTTTATVLAQAIAKEGMKAVAAGMNPMDLKRGIDRAVAIVIAEIRSMSRPVGDSAEIAKVGALSANGEAAIGRQIADAMAKVGTAGVIKVEENKGLETETEVVEGMQFDRGYLSPYFITHAQKMVVELDDCAILLHEGKLTSLASMVPLLEAVVQAEKQLLVVAEDVEGEALTTLVVNKLRGGLKVAAAKAPGFGDGRAAMLEDLAVLTGAHLISAELGTKLETVTLDMLGFAKKVVLTKDSTILIDSAGDKAAIASRIGQIRNQIEDTTSAYNKEKLQERLARLAGGVAVIRVGGATEIEVKERRDRVEDTLNATRAAVQEGVVPGGGAALIHAGKALAGLKGDNPDQDAGIKIIRRAIQAPLRQIADNAGIDGSVVAGKVIENDSATFGFDAQLETYGDMLQAGIIDPTKVVRIALEDAASIAGLLITTEVIIAHKPERGERMSQMDEMGGMM

SEQ ID NO: 962 - protein, 392 aa, Peregrina linearifolia
DLEPVNPADVPVTAAGALKSYKLAAKAISRLQSLPSGNISLLCDVLVREVRDLTGYDRVMVYKFHEDEHGEVVSECRRSDLESYLGLHYPATDIPQASRFLFMKNKVRMICDCLAPPVKVIQHERLPQPLSLCGSTLRSPHGCHAQYMTNMATIASLVMSVTVNEDDETMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLEYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDMEMDAI

SEQ ID NO: 963 - protein, 543 aa, Streptococcus pyogenes
MAKDIKFSADARAAMVRGVDMLADTVKVTLGPKGRNVVLEKAFGSPLITNDGVTIAKEIELEDHFENMGAKLVSEVASKTNDIAGDGTTTATVLTQAIVHEGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMTALGQAAKITVDKDSTVIVEGSGSSEAIANRIALIKSQLETTTSDFDREKLQERLAKLAGGVAVIKVGAPTETALKEMKLRIEDALNATRAAVEEGIVAGGGTALITVIEKVAALELEGDDATGRNIVLRALEEPVRQIALNAGYEGSVVIDKLKNSPAGTGFNAATGEWVDMIKTGIIDPVKVTRSALQNAASVASLILTTEAVVANKPEPAAPAPAMPAGMDPGMMGGF

SEQ ID NO: 964 - protein, 392 aa, Janusia anisandra
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNEDDDTMDGDQQQMARKLWGLVVCHHSSPQFVPFPLRYACEFLIQVFGVQINKEVELAAQVREKHILQIQTMLCDMLLRDAPVAIITQSPNVMDLVKCDGAALYFKNKTWFLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSVPWEDVEMDAI

SEQ ID NO: 965 - protein, 542 aa, Nocardia asteroides
MAKTIAYDEEARRGLERGLNSLADAVKVTLGPKGRNVVLEKKWGAPTITNDGVSIAKEIELEDPYEKIGAELVKEVAKKTDDVAGDGTTTATVLAQALVREGLRNVAAGANPLGRKRGIEKAVEAVTAKLLDTAKEVETKEQIAATAGISAGDAAIGELIAEAMDKVGKEGVITVEESNTFGLQLELTEGMRFDKGYISGYFATDPERQEAVLEDPYILLVGSKVSTVKDLLPLLEKVIQAGKPLLIIAEDVEGEALSTLVVKKILGTFKSVAVKAPGGGDRRKAQLADIAILTGGQVISEEVGLSLETAGIELLGQARKVVVTKDETTIVEGAGDAEAIAGRVSQIRAEIENSDSDYDREKLQERLAKLAGGVAVIKAGAATEVELKERKHRIEDAVRNAKAAVEEGIVAGGGVAFLQSVPALDDFKLEGDEATGANIVRVALSAPLKQIAFNAGLEPGVLAEKVSNLPAGQGLNAQTNEDEDLLAAGVADPVKVTRSALQNAASIAALFLTTEAVVADKPEKASAAPATGHRFKMGGMDF

SEQ ID NO: 966 - protein, 255 aa, Pseudomonas fluorescens
MIQISALPAFTDNYIWLLQDHRSQRCAVVDPGDAAPVLAWLEQHPGWVLSDILITHHHHDHVGGVERLKQHSAATVHGPAREKIPARDIGLEDNQRVSILGWEFEVFAVPGHTLGHIAYYHHGLLFCGDTLFAAGCGRLFEGTPEQMHHSLGRLAALPDDTLIYCTHEYTLSNLRFAQAVEPANPDIAERLAKVTQMREQGRMTLPSTLALEKLTNPFLRTGETSVKQKADERNGQDNQSQSAVFAALRAWKDKF

SEQ ID NO: 967 - protein, 548 aa, Neorickettsia sennetsu
MANEVISGEQLQRVIRDAADLVVSSAGVTLGPEGRPVIMSKSYGGPEVTKDGYKVMNQLKPEDEKVAKIVELLNQATSQANEKAGDGTTTATILVGNMIKNAHKHIAAQRSRMKLKSGMKRARDEVVKYIQSVAKKINSEEEIAQVGSISANGNSEIGGKIAEAMNKVGKEGVITVEEGKGLDEFSVSVVQGMVFDRGYVSPYFITNPEKMIVEFDNPYVLLANKKLSSIQPMVPLLETIVRSNRAVVIIAEDVEGEALTSLVLSKMRGSLKACAVKAPGFGDRRSEMLEDIRILTGAKTLVSDDLGVTVESLTVEDLGTAKSIIISKDSTTIVDGGGEKTAIEARVKQIKTQIDKTTSDYDKEKLQERLAKLAGGVAVLKVGGATEVEVKERKDRVEDALHATRAAVEEGIVPGGGATLLSAIAVLEKLSSDDDDEQAGINIVKTALKAPISQIVENAGEDASVITYNLLESKDPNRIFDARELKYVDAFKAGIIDPAKVVRVALESAVSVASVLVTTEALIVDLPTKDNGSSSMMPGGGMGGMGGF

SEQ ID NO: 968 - protein, 637 aa, Coxiella burnetii
MCGIVGFWDFRRSWKKEQYQKVAAKMADQITSRGPDSSGVWCDEKTGLAFGHRRLAVIDLSTAGHQPMLSHSGNTAIIYNGEIYNAPFIRRELENAGIYCCGHSDTEVLLEACELWGVKSAVKKMNGMFAFAYWNKLEKKLYLGRDRLGIKPLFWSLKNNIFYFSSQLKALAAHPVWNVEIDRTALTSYFRFNYIPAPLSIYKGVYKLKPGTILTIDPNQKIIEETFWSLETVCQKNINKKKIDDNEVLEKTETLLRDAVKCRMYSDVPLGAFLSGGIDSSAVVALMQAQSTNRIKTFSIGFYEKEYNEASYAKEVAQHLKTDHHELYLHVDEAARLIPQIPEWYDEPFADSSQIPTYLVSQLARQHVTVSLSGDGGDELFAGYNRYLLAENLWSKLVRFPLWMRQSGSKTINFFSPSAWDKFANVIPRKLRPSSVGDKAHKLAALLTQSSEDLYKGLVSLWERPAELVIDGSDISLWPEPLPDLNFTERMQYIDTLTYLPDDILTKVDRASMAVSLEARIPLLDYRLVEYIWSLPMRFKLERGETKWLLRRVLGKYVPEKLFTRPKMGFGVPIDHWLRCQLREWAEDLLSVPKLEKDGLLHSSLIRQRWQEHLSGKRNWQYSLWSVLMFQLWRERW

SEQ ID NO: 969 - protein, 540 aa, Enterobacter aerogenes
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIVNEGLKAVAAGMNPMDLKRGIDKAVVAAVEELKALSVPCSDSKAIAQVGTISANSDETVGKLIAEAMDKVGKEGVITVEDGTGLEDELDVVEGMQFDRGYLSPYFINKPDTGAVELESPFILLADKKISNIREMLPVLEAVAKAGKPLVIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRKQIEEATSDYDREKLQERVAKLAGGVAVIKVGAATEVEMKEKKARVDDALHATRAAVEEGVVAGGGVALVRVAAKIAGLTGQNEDQNVGIKVALRAMEAPLRQIVSNAGEEPSVVANNVKAGDGNYGYNAATEEYGNMIDFGILDPTKVTRSALQYAASVAGLMITTECMVTDLPKGDAPDLGAAGGMGG

SEQ ID NO: 970 - protein, 480 aa, Unknown
  Rosa hybrid cultivar 'Kardinal'
MKRHRSNSNPPTPPPSPDSDSDHHPAGQLVEVPVLPRSMSRSHLSPRNPGPVHVSGRANSVLKGGEPPYYVGLRKVAEDPYDELGNPDGVIQLGLDENKLALDLVRDWLLENAKDAILGGEELGISGIACYQPSDGLMELKLAVAGFMSKAIGNSVTYNPSQIVLTAGATPAIEILSFCLADSGNAFLVPAPYYPGLDRDVKWRTGVEIIPVPCRSADKFNLSITALDRAFNQAKKRGVKVRGIIISNPSNPGGSLLTRESLYNLLDFAREKNIHIISNELFAGSTYGSEEFVSMAEIVDLEDLDQNRVHIVYGISKDLSLPGFRVGAIYSFNKNVLTAAKKLTRFSSISAPSQRLLISMLSDTKFMHKFIEINRERLRGMYLRFVTGLKQLGIECTKSNGGFYCWADLSGLIRSYSEKGELELWDRLLNVGKLNVTPGSSCHCIEPGWFRFCFTTLTEKDIPVVIERIRNIAETCKSHS

SEQ ID NO: 971 - protein, 477 aa, Unknown
  Acinetobacter sp. ADP1
MNQLIWFRNDLRLNDHAALWHATQAGSTIAFVALSPLQWQQHDDAIIKIDFYMRQLTQLKQELNTINIPLIVQIIPLWKDIATEIISISDRYHIQDVYANIETGINEIERDHAVQEALSKIGKNLILFHDKTLFPLGSIRNKSQAPYQVFTPFKKTCYERLNIDIPKCFPYPHKQKQQPEIAKKEAAIPSLKQLGYSQIDQHIQNEWPIGETFALNLLEDFTQDKINRYHESRDYPAQDGTSHISAYLTIGILSIRQCIQAIFQKQHGQFFLNNKGQEIWLNELLWREFYQQLLFDFPKLSRHQPFQDHTKNIPWNENDEHFEAWIQGKTGIPIVDAGMRQLKATGWMHNRVRMICAMFLSKNLLIDWRKGEKWFMQHLIDGDLAANDGGWQWSASTGTDASPYFRIFNPVTQSQKFDPEGVFLKKWIPELKHLDSKHIHDPYAYQHKTELNYPKPIIDLKATRKNAIEVFKKSSSL

SEQ ID NO: 972 - protein, 569 aa, Rhodospirillum rubrum
MTAKLAPRGPDDGGILVHGPVALGHRRLSIIDLSPKAAQPMVDSDLGLSIVFNGCIYNYPALRSELEALGYRFFSGGDTEVILKAYHAWGTACVKRFNGMFAFAIHERDSGKVVLARDRFGIKPLYLAEVDGGLLFASSLPALLATGRVDKAIDPLALRFYISFHAVVPAPRTILKGVRKLPPATLRVVSADGSSFDEVYWRLDFRALPGEDGRSAKDWEDGLFEAVRAAVARRIIADVPVGVLLSGGLDSSLIVGLLAEAGQRDVETFSIGFEEANGEKGDEFFYSDLIAERYATRHHKIFIPEADMIAALPGAIAAMSEPMVSYDNVAFYLLAREVSKRVKVVLSGQGADEIFGGYHWYRPLVGSTDPVADYAAHFFDRTPERLARHLSPAWLGTTDEARAFVAAHFAEDGAPDPVDKALRLDSTVMLVEDPVKRVDNMTMAFGLEARVPFLDHQLAEFAGRIPSSLKLAQNGKGILKEVARRVVPAAVIDREKGYFPVPGLKYIEGSRLDYVRDGLSSRAARQRGLFREDYLASLYENPRDAITPLRGSELWQVGLLELWLQEHGI

SEQ ID NO: 973 - protein, 277 aa, Bacillus cereus
MNLTSLKDYTTLHNGVKMPWFGLGVFKVEDGSEVIESVKAAIKNGYRSIDTAAIYQNEEGVGQAIRESGISREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQDIATKYNKSTAQIILRWDLQNEVVTIPKSIKEHRIIENANIFDFELSADDMKAIQALNEDRRVGPDPDNFNF

SEQ ID NO: 974 - protein, 503 aa, Vibrio cholerae
  misc_feature (456)..(456): Xaa can be any naturally occurring amino acid
MHMSKSFLIISMGFVAVSVQAQTLTRDNGAPVGDNQNSITAGEHGSVLLQDVHLIQKLQRFARERIPERVVHARGTGAHGEFVASGDFSDLTLSAPFTSKGKITPVFVRFSTVIHSKGSPETLRDPRGFATKFYTEQGNWDLVGNNLPVFFIRDSIKFPDMVHSLKPSPVTNLQDPNRFFDFFSHEPGSTHMLTWVYTNLGTPASYRTMDGFGVHAYKWINQKGDVNYVKFHWKSLQGIESLRPDEVVKVQGQDFNHLTNDLYTQINAGNHPKWDLYVQVLTPEQLSKLDYNGLDATKVWLDVPEKKVGTMTLNKVPDNFFLETEQSAFAPSNLIPGIEPSEDRLLQGRLFAYADTQLYRLGANLFQLPINRPLVEVNSHNQEGASNSAQTASDINYQPSRKLELKEDPQFKAVQTQLVGSVQQKAISNPRNFYQAGVLYRSLNEQDKQDLITNLXGBLNKVTDKEIKATMVSHFYRADKDYGTRLARATNTDLKQVAKLAAM

SEQ ID NO: 975 - protein, 661 aa, Bacillus anthracis
MEQLKHHVTDNQRKHALTTNQGVKIAEDEFSLKMGLRGPTLMEDFHFREKMTHFDHERIPERIVHARGVGAHGYFQLYESLEAYTKADFLTNPSKKTPVFVRFSTVQGSKGSNDAVRDVRGFATKFYTDEGNYDLVGNNMPVFFIQDAIKFPDFVHAVKPEPHNDIPQGASAHDTFWDFVAHNPESTHMVMWQMSDRAIPRSLRMMEGFGVHTFRLINKEGKAHFVKFHWKPALGVHSLVWDEAQKIAGKNPDFHRQDLYEAIEKGDYPEWELGLQLIPEEDEHTFDFDILDPTKLWPEEEVPVKLVGKMTLNKNVDNFFAETEQVAFHPGHVVPGIDFSNDPLLQGRLFSYTDTQLSRLGGPNFHQTPINQPVCPFHNNQRDGMHQMQIHRGQTSYHPNGLNDNQPATVQAEQGGYEHYQEKIDGHKIRGRSKSFLNFYSQAKLFYNSMSPIEKQHIKEAFCFEVGKCKSDMVKANVIALLNHVDRQLAQEVANIIGAPLPKENHEVNSDAKSPALSMSNTIFKADSKNVAIVLNGDPSVSLLSEWIQAFAQHRINYSIVDNKIYQFNNSIKVTDTYTTTDSSLFDAVLVFSSESAIHPPVLEFAETTFKHFKPIAHVLSNPHALDNSKIKLDGAGIYNLANTSIESFIEGIAQGRFWNR

SEQ ID NO: 976 - protein, 765 aa, Anabaena variabilis
MRIDLESPNINVTSLKEAPIHLSGQIQPHGVLLVLEEPDLKILQVSNNTWSILGIKTEDILQKKLEDLLDSFQIERIQAGLSSGNLEFINPTKIWIRKKGDDYAVFDAVFHRNTEGFLILELEPAITQENIPFLSFYHLAKASINQLQKTANLRDFCQIIVQEVRKVTDFDRVMLYKFDDDGHGSVIAEEKLDSLEPYLGLHYPESDIPKPARKLFISNSIRVIPNAQAQAIQMIPSVNPVSDRPVDLTNSILRSAANCHLEYLHNMGVGASLTISLIKDNKLWGLIACHHLSAKYVSYELRKACEFLGRVIFAEISAREETEDYDYRMNLTHIQSLLVEYMSQEDNFVDGLVKHQPNLLDLTSAQGAAVCFGDHCTLIGETPKAEDLVFLVQWLKNNVEEEVFYTDSLPQVYPDAERYKNVASGLLAIPISQRNYVLWFRPEVIQTVNWGGDPNQPFEVNKLDGNVRLCPRKSFELWKETVRLTSLPWRYVEIKAALELRKAIVNIVLRQADELAQLAQDLERSNAELKKFAYVASHDLQEPLNQVANYVQLLEMRYQDELDADANEFITFAVEGVSLMQTLIDDVLAYSKVDTQAIAFQLTEVEKALDKALGNLRQRIAETGATITHDPLPTVMAGSTQLMQLFQNLIANAIKFHSQEAPQIHIGAERLEDEWLFSVRDNGIGIDPQFSDRIFVIFQRLHTRDEYHGTGMGLAICKKIIECHRGRIWVESQLGEGATFYFTIPVGGRERERRNGRKTQNNLFS

SEQ ID NO: 977 - protein, 255 aa, Pseudomonas fluorescens
MIQISALPAFTDNYIWLLQDHATQRCAVVDPGDAAPVQAWLDAHPGWVLGDILITHHHHDHVGGVETLKKATGATVYGPASENIPGRDVALKDNDTVRVLGWDFDVYAVPGHTLGHIAYYHHGLLFCGDTLFAAGCGRLFEGTPQQMHQSLSRLAALPEDTLVYCTHEYTLSNLKFAAAVEPDNRDIAARLEKVTRQRENGVMTLPSTLALEKLTNPFLRTGEILVTQKVDERNGPQNRAPSEVFAALRAWKDTF

SEQ ID NO: 978 - protein, 1131 aa, Zea mays
MSSLRPAQSSSSSSRTRQSSQARILAQTTLDAELNAEYEESGDSFDYSKLVEAQRSTPPEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMQALCNTVVKEVFDLTGYDRVMAYKFHEDEHGEVFAEITKPGIEPYLGLHYPATDIPQAARFLFMKNKVRMICDCRARSVKIIEDEALSIDISLCGSTLRAPHSCHLQYMENMNSIASLVMAVVVNENEDDDEPESEQPPQQQKRKKLWGLIVCHHESPRYVPFPLRYACEFLAQVFAVHVNKEFELEKQIREKSILRMQTMLSDMLFKESSPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDEDDSRRMHPRLSFKAFLEVVKMKSLPWSDYEMDAIHSLQLILRGTLNDALKPAQSSGLDNQIGDLKLDGLAELQAVTSEMVRLMETATVPILAVDGNGLVNGWNQKVADLSGLRVDEAIGRHILTLVEDSSVPIVQRMLYLALQGREEKEVRFELKTHGSKRDDGPVILVVNACASRDMHDHVVGVCFVAQDMTVHKLVMDKFTRVEGDYRAIIHNPNPLIPPIFGADQFGWCSEWNAAMTKLTGWHRDEVIDRMLLGEVFDSSNASCLLKSKDAFVRLCIIINSALAGEEAEKAPIGFFDRDGKYIECLLSVNRKVNADGVVTGVFCFIHVPSDDLQHALHVQQASEQTALRRLKAFSYMRHAIDKPLSGMLYSRETLKGTDLDEEQMRQVRVADNCHRQLNKILADLDQDNITDKSSCLDLDMAEFVLQDVVVSAVSQVLIGCQGKGIRVACNLPERSMKQKVYGDGIRLQQILSDFLFVSVKFSPAGGSVDISSKLTKNSIGENLHLIDFELRIKHQGAGVPAEILSQMYGEDNREQSEEGLSLLVSRNLLRLMNGDIRHLREAGMSTFILTAELAAAPSAAGH

SEQ ID NO: 979 - protein, 140 aa, Arabidopsis thaliana; identical to SEQ ID NO: 98

SEQ ID NO: 980 - protein, 756 aa, Candida glabrata
MTASKRHTYYGGGSISYERTNNSEHDKTQRPQDHQGPKHRKHVTFGPYVIGATLGEGEFGKVKLAWSKSAYQQCDNTEGNAGNKPMTFKVPKQVAIKLIKRDFITKDPSKETKIYREINALKHLSHPNIVKLEEVLQNSKYIGIVLEYAAGGEFYKFIQRKRRLKENHACRLFSQLISAVHYIHSKGLVHRDLKLENLLLDNEENLIITDFGFVNEFLRQNGMMKTSCGSPCYAAPELVVSNRPYDARKADTWSCGIILFAMLAGYLPWDDDPKNPDGHDISRLYNYILNTPLKFPEYINPVPRDLLRKILVIDPKKRINIRSIEKHPWLESHSTFLSITPDEWDRLSNTKNIYRKSKPQFYPNKRPGSTYSNYSSGSKDNKRDSLIIDSALVSLPVPPKEFQSHILARPSSLVVESRYSPLGKRNGHNRSNSAASAALQAVFDASERESLKSVDSKPRSRSNDHKDIIEGIQPQKHAFVKPSRKVRPTSMQAPGSSYIHHGNFEGLHELMKRDNSTASSHQTSISSEARIFDASPTLIPDLTKSPSSSTGNSPKLLPRKSFTVSKPLLDLKFASADIIKANESTDSLSKRIHDQIYEVEHPRQRRHSYRYSGIISDLIFGTLSEEGEINTFENKDHKSDAEESEMTISESKLDSVSICSQQSNIHRNISKQASSVSLLRTTSNHSTNNLNVGSRTYGRAELYDKRHLRQIPSNTLNQINAPGNTHRNSAIYSEDDKRKSTAKRVFEFFKRRSMRV

SEQ ID NO: 981 - protein, 635 aa, Oryza sativa
  misc_feature (160)..(160): Xaa can be any naturally occurring amino acid
MDGSCDCIEPLWQADDLLVKYQYISDFFIALAYFSIPLELIYFVKKSAFFPYRWVLIQFGAFIVLCGATHLINLWTFAIYTKTIAVVLTVAKAATAVVSCITALMLVHIIPDLLNVKLRERFLKDKADELDREMGIIRTQEETGRHVHMLTHEVRSTLDXHTILRTTLVELGRTLALAECALWMPTRSGSALQLSHTIYNSAAIGSVVPINLPIVSKVFNSNRVVKIPHTSPLASITADKSRYVPPEVVAIRVPLLHLTNFQINDWPELSAKSFAVMVLMLPPDSAREWRPHERELVEVVADQVAVALSHAAILEESMRARDLLMEQNIALDAARREAEMAICARNDFLAVMNHEMRTPMRAIVSLSSLLLETNLSAEQRLMVETILKSSDLLATLTNDVLDVSKLENGSLELEIAPFNLHSTFTDVVNLIKPVAACKRLSVMVTLAPELPLHAIGDQKRLMQIILNVAGNSIKFTKEGHVSITASMARPDALRGPHEPDYHPVVSDGFFYLAVQVKDTGCGISPQDMPHTFRKFAHPENAGKWNSGSGLGLALSRRFVSLMEGNIWLESEGVGKGCTAMFFVKLGMPEKPNANLRRMAPHPLQPNQGAGGPDALSISIMDSNPRVPRVRYQSSV

SEQ ID NO: 982 - protein, 539 aa, Pantoea agglomerans
  misc_feature (533)..(533): Xaa can be any naturally occurring amino acid
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVASAVEELKALSVPCSDSKAIAQVGTISANSDETVGKLIAEAMDKVGKEGVITVEDGTGLEDELDVVEGMQFDRGYLSPYFINKPETGAVELESPFILLADKKISNIREMLPVLEAVAKAGKPLVIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVGQIRKQIEEATSDYDREKLQERVAKLAGGVAVIKVGAATEVEMKEKKARVDDALHATRAAVEEGVVAGGGVALVRVAAKLAGLTAQNEDQNVGIKVALRAMEAPLRQIVSNAGEEPSVVANNVKAGEGNYGYNAATEEYGNMIDFGILDPTKVTRSALQYAASVAGLMITTECMVTDMPKGDAPDLXAAGMGG

SEQ ID NO: 983 - protein, 539 aa, Enterobacter amnigenus
  misc_feature (533)..(533): Xaa can be any naturally occurring amino acid
  misc_feature (535)..(535): Xaa can be any naturally occurring amino acid
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVIAAVEELKTLSVPCSDSKAIAQVGTISANSDETVGKLIAEAMDKVGKEGVITVEDGTGLEDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDMGQAKRVIINKDTTTIIDGVGEEAAIQGRVGQIRKQIEEATSDYDREKLQERVAKLAGGVAVIKVGAATEVEMKEKKARVDDALHATRAAVEEGVVAGGGVALIRVASKLSELRGQNEDQNVGIKVALRAMEAPLRQIVLNCGEEPSVVANTVKAGDGNYGYNAATEEYGNMIDMGILDPTKVTRSALQYAASVAGLMITTECMITDVPKGDGPDLXAXGMGG

SEQ ID NO: 984 - protein, 213 aa, Kineococcus radiotolerans
MSARIEHLVTSGTFSLDGQTFDVDNNVWIVGDDREVVVLDAPHDVDVIAAAIGERTLLAVLCTHAHDDHVRRAPALAGRFSTPERRVPVLLHPADREVWDLTHPGVATTDLSNGEVVTVAGTELHVLHTPGHTPGAVSVYAPELSTVFTGDTLFAGGPGATGRSFSDFATIVDSIRDVLFELPADTRVHTGHGEDTTIGDESPHLQEWIARGH

SEQ ID NO: 985 - protein, 539 aa, Enterobacter asburiae
  misc_feature (533)..(533): Xaa can be any naturally occurring amino acid
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLEDELDVVEGMQFDRGYLSPYFINKPETGAVELESPFILLADKKISNIREMLPVLEAVAKAGKPLVIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVGQIRKQIEEATSDYDREKLQERVAKLAGGVAVIKVGAATEVEMKEKKARVDDALHATRAAVEEGVVAGGGVALVRVAAKLAGLTAQNEDQNVGIKVALRAMEAPLRQIVSNAGEEPSVVTNNVKAGEGNYGYNAATEEYGNMIDFGILDPTKVTRSALQYAASVAGLMITTECMVTDLPKGDAPDLXAAGMGG

SEQ ID NO: 986 - protein, 540 aa, Enterobacter gergoviae
MAAKDVKFGNDARVKMLRGVNVLADAVKVTLGPKGRNVVLDKSFGAPTITKDGVSVAREIELEDKFENMGAQMVKEVASKANDAAGDGTTTATVLAQSIITEGLKAVAAGMNPMDLKRGIDKAVAAAVEELKALSVPCSDSKAIAQVGTISANSDETVGKLIAEAMDKVGKEGVITVEDGTGLQDELDVVEGMQFDRGYLSPYFINKPETGAVELDSPFILLADKKISNIRELLPVLEAVAKAGKPLLIIAEDVEGEALATLVVNTMRGIVKVAAVKAPGFGDRRKAMLQDIATLTAGTVISEEIGMELEKATLEDLGQAKRVVINKDTTTIIDGVGEEVAIQGRVTQIRQQIEEATSDYDREKLQERVAKLAGGVAVIKVGAATEVEMKEKKARVEDALHATRAAVEEGVVAGGGVALIRVASKITELKGQNEDQNVGIKVALRAMEAPLRQIVLNCGEEPSVVANTVKSGDGNYGYNAATEEYGNMIDMGILDPTKVTRSALQYAASVAGLMITTECMVTDLPKADAPDLGGAGGMGG

SEQ ID NO: 987 - protein, 355 aa, Dechloromonas aromatica
MSHLFDPLKLRDITLKNRIGIPPMCQYSAQDGMAADWHFVHYGSRAVGGAGLMIVEATAVVPEGRISPGDLGLWKDEQIEPLAKIARFAREQGCVAAIQLAHAGRKASVGLGWGEQRTLRADEGGWQSVAPSAISFGEGYAVPHELSIAGIAEVVAAFVAAARRAVVAGFQAIEIHAAHGYLMHQFLSPLSNQRTDAYGGSFENRTRLLREVVTAVRAVWPESLPLLIRLSATDWVEGGWSADETVALCRDLKTLGVDLADISTAGLVPTAKIPVGPGFQTEFAARVRHEAGLPTAAVGLITSAAQADHVLRTGQADMVLLGREILRNPYWPQQAAQELRQGGAWPNQYLRAALR

SEQ ID NO: 988 - protein, 539 aa, Kluyvera intermedia
MAAKDVKFGNDARVKMLRGVNVLADAVKVTLGPKGRNVVLDKSFGAPTITKDGVSVAREIELEDKFENMGAQMVKEVASKANDAAGDGTTTATVLAQSIIAEGLKAVAAGMNPMDLKRGIDKAVVAAVEELKALSVPCSDSKAIAQVGTISANSDETVGKLIAEAMDKVGKEGVITVEDGTGLEDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDMGQAKRVVINKDTTTIIDGVGEEAAIQGRVAQIRKQIEEATSDYDREKLQERVAKLAGGVAVIKVGAATEVEMKEKKARVDDALHATRAAVEEGVVAGGGVALIRVASKLSNLRGQNEDQNVGIKVALRAMEAPLRQIVLNCGEEPSVVANTVKAGDGNYGYNAATEEYGNMIDMGILDPTKVTRSALQYAASVAGLMITTECMVTDLPKGDAPDLRAAGMGG

SEQ ID NO: 989 - protein, 540 aa, Erwinia aphidicola
MAAKDVKFGNDARVKMLRGVNVLADAVKVTLGPKGRNVVLDKSFGAPTITKDGVSVAREIELEDKFENMGAQMVKEVASKANDAAGDGTTTATVLAQSIITEGLKAVAAGMNPMDLKRGIDQAVIAAVDELKKLSVPCSDSKAIAQVGTISANSDATVGELIAQAMEKVGKEGVITVEEGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIAVLTGGTVISEEIGMELEKAGLEDMGQAKRVVINKDTTIIIDGTGEEATINGRVTQIRQQIEEATSDYDREKLQERVAKLAGGVAVLKVGAATEVEMKEKKARVEDALHATRAAVEEGVVAGGGVALVRVASKLAELRGQNEDQNVGIKVALRAMESPLRQIVSNAGEEPSVVTNNVKAGEGNYGYNAQTEEYGDMIDFGILDPTKVTRSALQYAASVAGLMITTECMVTDLPKGDAPDLGAGGGMGG

SEQ ID NO: 990 - protein, 540 aa, Pectobacterium carotovorum
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVIAAVEELKALSVPCSDSKAIAQVGTISANSDETVGKMIAEAMDKVGKEGVITVEEGTGLQDELDVVEGMQFDRGYLSPYFINKPETGAVELESPFILLADKKISNIREMLPVLEAVAKAGKPLVIVAEDVEGEALATLVVNTMRGIVKVAAVKAPGFGDRRKAMLQDIATLTGGTVISEEIGLELEKATLEDLGQAKRVVINKDTTTIIDGTGEEAAIQGRVAQIRQQVEEATSDYDKEKLQERVAKLAGGVAVIKVGAATEVEMKEKKARVEDALAATRAAVEEGVVAGGGVALVRVAAKLASLTAQNEDQNVGIKVALRAMEAPLRQIVSNAGEEPSVVANNVKAGDGNYGYNAATEEYGNMIDFGILDPTKVTRSALQFAASVAGLMITTECMVTDLPKGDAPDLGGAGGMGG

SEQ ID NO: 991 - protein, 492 aa, Vitis vinifera
MDPYKYRPSSAYNSPYFTTNAGAPVYNNDSSLTVGSRGPVLLEDYHLVEKLANFQRERIPERVVHARGASAKGFFEVTHDVSDLTCADFLRAPGVQTPVIVRFSTVIHERGSPETIRDPRGFAVKFYTREGNFDMVGNNFPVFFIRDAMKFPDVIHAFKPNPKSHIQEYWRVVDFLSYHPESLSTFAFLFDDVGIPQDYRHMEGFGVHTFTLLNKAGKANYVKFHWKPTCGVKCLLEDEAIRVGGTNHSHATQDLYDSIKAGNYPEWKLFIQTMDPEHEDKFDFDPLDVTKTWPEDILPLQPVGRLVLNKNIDNFFAENEMLAFNPALVVPGIYYTNDKMLQGRIFAYSDTQRHRLGPNYLQLPVNAPKCAFHNNHHDGSMNFMHRDEEVDYFPSRFDPVRHAETFPIPSTICHGKREKVVIEKENNFKQPGERYRSFAPDRQERFINRWVETLSDPRVTYEIRSIWISYWSQADRSLGQKLASRLNVKPKY

SEQ ID NO: 992 - protein, 1122 aa, Rhodopirellula baltica
MTDPDSPLIVGVGASVAGQEAFRLLAEASSRIVWIADCDGKFIEDSPSWRAFTGQTIDQLASTRWLDTVHPEDQRSVADALKDSRRDGGVSVEFRLRRHDGAFIGVQVQGVPQRQPEGSIDCWVLMSSAIDDPGTHQSKQASLSESAGQPKTARQSEAAEREAHLRRVINHQLGLVGVIDRDGILVEVDDRSLEIAKVARQDVIGKHFAEAPWWTYDPRVAARVREAMQRAFAGEVVRFDVSLFAYGEEGVRIDFMIAPVINDEGEVEFLIPSGTDIRDRHRAEVELRKSERLVRTIAENSTQGLVMMDATGHVIYCNQALLDMTGFDSEEIRSAPLHDLIHHHYPDGRPYPMSECPIDRALPEDFSVRAHEDLFFRKDGSSFSVVCAASPIFEDGKPVSTVIEVRDTTVQKAHEVELKRAAARLDKSLAFAGIAAWGWDHSEQRLILDVPLRRMWGFDDEQDVTLDDFAQRITPNHRDRVVASITNAMKTFSSYREEYTIDLPSGNQRWIRAIGQVVADGNGGIADFFGVTMDVTADLRRQVKARVRSELLEQLSELTDPEAIMQLATQRIRKHFSASRCYLAYIRLDAQTTEVFHESHDEHLSPIVGTHQIRDFLNDHEMREIESGKPVRIDDISQSGRSSEKVQQFADLGIAAVTQGSFEATKVLHRTLFITKDKPYRWRDDEVRFLDNLTEMVYLRIERAESQLELEQARAVAEAASQSKSAFVANMSHEIRTPMTAILGYADLVRDMIEDPQAIEHLETIRRNGDYLLEIINDILDLSKIEAGKLEVNHEKFEPARLIEDVRSIMEVRAKEGGLSLDVQYIGLLPKTIESDGKRLKQILINLVGNAIKFTQKGWVQIRVRFNKLLHIDIVDTGIGMSDEQQKRLFKPFSQGDASVTRTFGGTGLGLAISKRLTEMLGGTIIASSTEGVGSTFTVSVAVGDLADVAMVDYSHTFDADHDETSSKYADGSLGTGVNRLAGVEKPLRCHVLVVDDRHDIRFLSRALLTKAGATVDECEDGQLAVDYMTDRLNNDDCPDLILLDMQMPNLDGYETARTLRRMGYSGWIIALTADAMQGDMNECLEAGCNDYLSKPIDANRMIGLIAQFTQSNSDAVERKGN

SEQ ID NO: 993 - protein, 443 aa, Silicibacter pomeroyi
MKKVVLAGLAGTLAGIIATTQIAGPLVAQEAKANSNVYEQLDLFGDIFERIRAQYVEEVDAGELIEAAIDGMLTSLDPHSSYLSPDDAAQMRVQTRGEFGGLGIEVTQEEGFVKVVSPIDGTPADEAGIEAGDFITHVDGESVLGLTLDKAVDLMRGPVGSEIVITVVREGEDEPFDVSIIRDTIKLTAVRARTEGTSVVLRVTTFNDQTYSNLEDGLAKQVEAAGGIDKINGFVLDLRNNPGGLLTQAIKVSDAFLDSGEIVSTRGRNPEDGERFNATLGDLAQGKPVVVLINGGSASASEIVAGALQDHRRAIVVGTKSFGKGSVQTVMPLRGDGAMRLTTARYYTPSGRSIQALGVSPDIVVEQPRRRPEAEEERVTPRSRSEADLRGRLNNDSLSEDEIRQIEEDRAKAEATAELRQEDYQLAYAIDILKGLSAFAPAD

SEQ ID NO: 994 - protein, 857 aa, Arabidopsis thaliana
MENGNSSSDNKSSHKPIRCKAAVSRKAGEPLVMEEIMVAPPQPFEVRIRIICTALCHSDVTFWKLQVPPACFPRILGHEAIGVVESVGENVKEVVEGDTVLPTFMPDCGDCVDCKSHKSNLCSKFPFKVSPWMPRYDNSSRFTDLNGETLFHFLNVSSFSEYTVLDVANVVKIDSSIPPSRACLLSCGVSTGVGAAWETAKVEKGSTVVIFGLGSIGLAVAEGARLCGASRIIGVDINPTKFQVGQKFGVTEFVNSMTCEKNRVSEVINEMTDGGADYCFECVGSSSLVQEAYACCRQGWGKTITLGVDKPGSQICLDSFDVLHHGKILMGSLFGGLKAKTHIPILLKRYLSNELELDKFVTHEMKFEEINDAFQLLLEGKCISDFPEDFIFGAATSAYQVEGAAHEDGRGPSIWDTFSEKYPEKIKDGSNGSIASDSYHLYKEDVGLLHQIGFDAYRFSISWSRILPRGNLKGGINQAGIDYYNNLINELLSKGIKPFATIFHWDTPQSLEDAYGGFLGAEIVNDFRDYADICFKNFGDRVKHWMTLNEPLTVVQQGYVAGVMAPGRCSKFTNPNCTAGNGATEPYIVGHNLILAHGEAVKVYREKYKASQKGQVGIALNAGWNLPYTESAEDRLAAARAMAFTFDYFMEPLVTGKYPVDMVNNVKDGRLPTFTAKQSKMLKGSYDFIGINYYSSSYAKDVPCSSENVTLFSDPCASVTGEREGVPIGPKAASDWLLIYPKGIRDLLLYAKYKFKDPVMYITENGRDEASTGKIDLKDSERIDYYAQHLKMVQDAISIGANVKGFFAWSLLDNFEWATGYSVRFGLVYVDFNDGRKRYPKKSAKWFRKLLSEKKRN

SEQ ID NO: 995 - protein, 554 aa, Holospora obtusa
MSVKQIAFGSKVGESLLNGVIKLANCVQVTLGPNGRNVLIEQSFGDPRVTKDGVTVAKHVELEDRYENLAAQLVKSVASKTADMVGDGTTTATVLARSIYSEAFKGTSAGMNSMELRAGIDHAVEIVVEKLKELSIPVKGDYQKISQVATVSANGDTEIGDMIAQAMEKVGSDGVITVEEAKSFKTELDVVPGMQFDRGYISPYFITRQDKGIAELERSYILLYDGKISSAQSLLPVLEKCAKESASLLIIAEDVEGEALRMLVVNKLRGVLKVAAVKSPGFGDRRKAMLGDIAVLTNGYVVSSEVGMRLEDVRIEDLGRADTIVIEKDNTTVIVNGPARSSVKERCDKIRSEIQEATSDYDKEKLQERLAKLSGGVAVIRVGGATEVELKERKDRVEDAMHATKAAVEEGIIPGGGTAFLRCVKPLEEVIKSAKVQERGRDFICGIDAVRKALSSPCYQIASNAGKEGGVVVAEVLKASDVNVGYDARHDQYVDMIKSGIIDPTKVARTALQNAGSVAGLLNTTEVIIAQVPEKEKPNMGGGMGGGMGGGMDF

SEQ ID NO: 996 - protein, 355 aa, Rhodococcus equi
  misc_feature (152)..(152): Xaa can be any naturally occurring amino acid
MTTNQGVKVSEDEHSLKAGSRGPTLMEDFHFREKMTHFDHERIPERVVHARGFGAHGYFQVYEPMAEYTRAKFLQDPSVKTPVFVRFSTVAGSRGSADSVRDARGFATKFYTEEGNYDLVGNNIPVFFIQDAIKFPDLVHSFKPEPHNEMPXASTAHDTFWDFVANILKQAHMIMWTMSDRAIPRSFRMMEGFGVHTFRFVNEQGKARFVKFHWKPVLGTHSLVFDEAQKLAGKDPDFHRRDLWEAIEMGNYPEFELGVQMIEEEDEFSFDFDILDATKLWPEEMVPVKIIGKMTLNRNQDNVFAETEQAAFHPGHVVPGIDFSNDPLLQGRLFSYTDTQLIRLGGPNFHEIPIK

SEQ ID NO: 997 - protein, 485 aa, Lycopersicon esculentum
MGFEIAKTNSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMPSDEKFVDNFLRESAMRLGKRHKHFTNGLEVVGIKCLKNNAGLFCWMDLRPLLRESTFDSEMSLWRVIINDVKLNVSLGSSFECQEPGWFRVCFANMDDGTVDIALARIRRFVGVEKSGDKSSSMEKKQQWKKNNLRLSFSKRMYDESVLSPLSSPIPPSPLVR

SEQ ID NO: 998 - protein, 749 aa, Thiobacillus denitrificans
MALDYATCSFLLTYTGEAGSPLLVVYLWVTLGNGFRYGVFYLYIAAAMAITGFLLVLTYSSYWNSHMSIGLAFLLSMIAVPLYSASLLKQLHSAVERERKASLAKSSFLANMSHELRTPLNGVIGVADLLAETKLNKEQKEFAQIIRTSADTLLELIDNVLDISRIEAGRILTSSEDFDLHRVINGTVAMMETQANAKGLVLAAHIAPQTPFQLQGDAPHLRQVLINLIGNAVKFTEHGRVDVYVRPVGQGNPQRLRLEVVDTGIGIPPDAQIRIFDSFTQADASITRRFGGTGLGTTIAKQLVEAMGGEIGLHSREGEGTTFWFELPFALRSSGQPAEERFDAPMRVALLASGDLADRMQAAIRAWDVEAVTLRSAAQLGSQLSASPASEASFGAIVVERSLLPADPVAFLSQLREGPVRSSLPVILIESDARIPPSEDALLLRAGYASVLRSPVNTGLLFNAIHAVTSRELPPNVISLANRFQAQTAQATGLNILVAEDNPVNQRVLRGLLEHAGHKTTLAHDGEEALDLLDSDGASFDLAIIDMHMPELSGPEVVQRWRFLEKGHLPIIMLTADARSEAETACKEAGADAFLTKPVNSRELIDAITRLGVPSPSPVTAPAAKAVRTGELDETVLDDLAELGGAEFVRELLASFEDDSARALRDAEFALVAHEYGQWHHHLHMLKGGASDVGANLLAERCAEAERVKPFELATPLARTRLDAVRTALEEARTALSRYQERRLRAEHS

SEQ ID NO: 999 - protein, 1022 aa, Cryptococcus neoformans
MPSSANAHDGAARQATVTRKRTNGSSTRDEKQYIGQWRIGRTIGKGSSGRVKIAKHAVTGKYAAIKIVPKGLILNSRMSMSEAGAKADKVLLGIEREIVIMKLIDHPNVLNLYDVWETSSELYLIMEYVPGGELFDYLVKRGRLPVSEALHYFQQIIYAVDYCHRFNICHRDLKPENLLLDKDKNIKVADFGMAAWEAGERMLETSCGSPHYASPEIVAGKAYHGSSSDIWSCGIILFALLTGRLPFDDDNIRSLLQKVKIGIFEMPDEIKDPARDLLRRMLERDPERRITMPEILSHPFFISRPPRPIPGRSLVSPPSLDEVERPVNSVDEIDPDIMGNLKTLWSGVSDEEIIKALMCKDKTWEKTIYHLLIKYRNKHLENYNMEEEEYAEARERRQARKQLQSSSSPARRKGVPAQDQSARLAPLGENETVANTPVKRPQAPTPNKASRKAPPECPTPTKQVSQARSPAGPRPANSRGNSGASNSSQAPAIVLQGATPTKELPPPHTTSSHPRPEMITTPTSPAPLSVPRVEDANLQTFLNQIADQMNRFSVRSSVASQSSTSSSAVLGSDYQACLAFAAGVTPSANPSSSVTESVIEEQGQFEDAADDQTDTEVASIHSGFTASIAPQSPLAGLGLGAPSAAVRPGLHPVAGPNQQRWSYASSAGSSYQGSSVGSYAPVESPQYIHSPLEVQAPVLQAERSAPRPPPRATRPAPPPISRPLPFSPAQQTYSEPTESLLPRDTSYVIIDNSELPSDASLSSWGSKSSGFKAHRGLDGFGMLKKKKLNVEPVPYSYGNLGSSATSPLNSPKRSWFNNLFNFKPATCTLLSRDNVANTRERVRKILLSIGVRTAVTEIDGHKALKCRLDEVRDNGNVTTKGVRFRVEFTRASTSQTYSTLVTLTQEKGAESSFRACFAELKHFMDSQPSAPTTLSLNRPSVEQSRSVNSSNLLPAHSYQQQRYSSTSADTPAGAPTSPLLSAPPIRYTASAPTTPVIESSPRFTSPYLQLPVSPQSLQMPSY

SEQ ID NO: 1000 - protein, 367 aa, Lentinula edodes
MDDRTTAFIVGSSYQPLDIIGEGAYGVVCSAVHIQSQRKVAIKRITPFDHSMFCLRTLREIKLLRHFQHENIIGILDILKPNLGPDGSLDGMTEVYLVQELMETDLHRVIKTQELSDDHCQYFIYQTLRALKALHSADVLHRDLKPSNLLLNANCDLKLCDFGLARSASPLPDHPVDASTFMTEYVATRWYRAPEVMLTFKQYTKAIDKWSLGCVLAEMLSGKPLFPGRDYHHQLSLILDVLGTPTLDDFYAISSSRSREYIRALPFRKKKVFGKPVHEGGVKGFEGKNPLAIDLMEKCLSFNPKRRIDVEGALAHPYLAPYHDPSDEPGAERIDSEFWSFDTFNNGKGLSKEELKVLIYEEVMRGA

SEQ ID NO: 1001 - protein, 725 aa, Xanthomonas oryzae
MSPLNAGVPAHPRLSMRRPASAAYANPSRIRQGRPFPRGAVFDGKGTNFALFSAHATRVEVCLFDEQGNETRVDLPEYTNEIWHGYLPDTKPGQRYGYRVHGPYAPTEGHRFNHNKLLLDPYARELEGDLIWADELYGYTVGHPDGDLSFDERDSAPFMPKCVVVEDIYDWGDDTRLLKPWNEMVIYETHVRGYTMGNPQVPEAVRGTFAGLAQPQVLQYIKDLGITAVELLPVHAYLDDQHLLDKGLRNYWGYNTIGFFALKSRYLASGHRDEFRDMVKAMHKQGLEVILDVVYNHTAEGSELGPTLSFKGIDNASYYRLAEDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGETDNAEILQIRERQMKNLLATLLLSQGAPMMLSGDERGQTQGGNNNTYCQDNAITWLDWENDPTDGRLTDFVKALTKLRKRYPILSRGRFLNGQYNEEAGVRDLTWLNPGGIEMDDAHWTDASARSVGLLLEGKAQTSGVKELANDDTLLIVINAYHEGVSFTLPSSDEPVHWKLVLSTDEALEVDMMPAAASEFLAPPRSVSVFECKSDQ

SEQ ID NO: 1002 - protein, 634 aa, Unknown
  Gladiolus hybrid cultivar 'Traveler'
MEGCDCIEPQWPADELLVKYQYISDFFIALAYFSIPLELIYFVKKSSFFPYRWVLIQFGAFIVLCGATHLINLWTFTMHSKTLALVMTVAKVSTAVVSCATALMLVHIIPDLLSVKTRELFLKNKAEELDREMGLIRTQEETGRHVRMLTHEIRSTLDRHTILKTTFVELGRTLDLAECALWMPSRTGLNLQLSHTLHNQIPVGSTVSINLPTVNQVFNSNRAVRIPHTSPLARIRPLAGRYVPPEVVAVRVPLLHLSNFQINDWPELSARSYAVMVLILPSDSARKWHVHELELVEVVADQVAVALSHAAILEESMRARDLLMEQNVALDLARREAEMAIRARNDFLAVMNHEMRTPMHAIIALSSLLLETELTPEQRIMVETMLKSSNLLATLINDVLDLSRLEDGSFELEKSSFNLHTVFREVINLIKPIAAVKRLSVSVSLAPDLPLCAMGDEKRLMQTILNVAGNAVKFTKEGHISITASVSRPDSFRDPQVHEFYPVFTDGHFYLCVQIKDTGCGISPQDIPFLFTKFAHTQNGGNKGYSGSGLGLAICKRFISLMEGHIWLESEGLGKGCTATFIVKLGICESQNGHQQQMIPTNRLLLGGADFPGPGALLKEDNKAIPSKLRYLSV

SEQ ID NO: 1003 - protein, 464 aa, Oryza sativa
SNLYIDPEAEVVALSPATLMATNRFVCEICGKGFQRDQNLQLHRRGHNLPWKLKQRGSKEAVRKKVYICPEASCVHHDPSRALGDLTGIKKHFFRKHGEKKWKCDKCSKKYAVHSDWKAHSKICGTREYKCDCGTIFSRRDSFITHRAFCDALTEESAKAIGGIPAAMAAPGHHHHHHQLLFSPPPVMAHHQELAALQEQQQQQHHQDVMQSPHQHQQQQQQRQQLVQQNCGYAVKPEMAPWPTTMPYDHHHPLLQPLCNANAAATAQSSATSAPPTTPQLPAAAAAAHLSATALLQKAAQMGATIGGAGTGAAGAHYAHMASPAGAGAPAGGSATFGLGLSCLNTHQDGGGGGGNGLIPAGMMGHLARTASHGRSGEDVAGAGGGGGDGMTRDFLGLRAFSHRDILLAGFDSSCMGHVNAAAGMAGYEPPPPHHGQPQHQHQQQQQQQQGGSNEPWHGMGSHS

SEQ ID NO: 1004 - protein, 540 aa, Raoultella ornithinolytica
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIIAEGLKAVAAGMNPMDLKRGIDKAVVAAVEELKTLSVPCSDSKAIAQVGTISANSDETVGKLIAEAMDKVGKEGVITVEDGTGLEDELDVVEGMQFDRGYLSPYFINKPETGAVELESPFILLADKKVSNIREMLPVLEAVAKAGKPLVIIAEDVEGEALATLVVNTMRGIVKVAAVKAPGFGDRRKAMLQDIATLTGGTVISEEIGMELEKATLEDLGQAKRVVINKDTTTIIDGVGEEGAIQGRVAQIRKQIEEATSDYDREKLQERVAKLAGGVAVIKVGAATEVEMKEKKARVDDALHATRAAVEEGVVAGGGVALVRVAAKLAGLTAQNEDQNVGIKVALRAMEAPLRQIVSNAGEEPSVVANNVKAGEGNYGYNAATEEYGNMIDFGILDPTKVTRSALQYAASVAGLMITTECMVTDLPKSDAADLGAAGGMGG

SEQ ID NO: 1005 - protein, 540 aa, Klebsiella oxytoca
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIIAEGLKAVAAGMNPMDLKRGIDKAVVAAVEELKTLSVPCSDSKAIAQVGTISANSDETVGKLIAEAMDKVGKEGVITVEDGTGLEDELDVVEGMQFDRGYLSPYFINKPETGAVELESPFILLADKKISNIREMLPVLEAVAKAGKPLVIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVTQIRKQIEEATSDYDREKLQERVAKLAGGVAVIKVGAATEVEMKEKKARVDDALHATRAAVEEGVVAGGGVALVRVAAKLAGLTAQNEDQNVGIKVALRAMEAPLRQIVSNAGEEPSVVANNVKAGEGNYGYNAATEEYGNMIDFGILDPTKVTRSALQYAASVAGLMITTECMVTDLPKSDAPDLGAAGGMGG

SEQ ID NO: 1006 - protein, 540 aa, Raoultella planticola
MAAKDVKFGNDARVKMLRGVNVLADAVKVTLGPKGRNVVLDKSFGAPTITKDGVSVAREIELEDKFENMGAQMVKEVASKANDAAGDGTTTATVLAQSIITEGLKAVAAGMNPMDLKRGIDKAVAAAVEELKTLSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKSTLEDLGQAKRVVINKDTTTIIDGVGEESAIQGRVTQIRQQIEEATSDYDREKLQERVAKLAGGVAVIKVGAATEVEMKEKKARVEDALHATRAAVEEGVVAGGGVALIRVASKIAELKGQNEDQNVGIKVALRAMESPLRQIVLNCGEEPSVVANTVKSGDGNYGYNAATEEYGNMIDMGILDPTKVTRSALQYAASVAGLMITTECMVTDLPKGDAPDLGAAGGMGG

SEQ ID NO: 1007 - protein, 541 aa, Pantoea ananatis
MAAKDVKFGNDARVKMLRGVNVLADAVKVTLGPKGRNVVLDKSFGAPTITKDGVSVAREIELEDKFENMGAQMVKEVASKANDAAGDGTTTATVLAQSIITEGLKAVAAGMNPMDLKRGIDQAVIAAVEELKKLSVPCSDSKAIAQVGTISANSDETVGTLIAQAMEKVGKEGVITVEEGTGLQDELDVVEGMQFDRGYLSPYFINKPETGAVELETPFILLADKKISNIREMLPVLEAVAKAGKPLLIIAEDVEGEALATLVVNTMRGIVKVAAVKAPGFGDRRKAMLQDIAILTGGTVISEEIGMELEKAALEDLGQAKRVVINKDTTTIIDGVGEETTIQGRVTQIRQQIEEATSDYDKEKLQERVAKLAGGVAVLKVGAATEVEMKEKKARVEDALHATRAAVEEGVVAGGGVALVRVAAQLTELRGQNEDQNVGIKVALRAMESPLRQIVSNAGEEPSVVANNVKAGDGNYGYNAQTEEYGNMIDFGILDPTKVTRSALQYAASVAGLMITTECMVTDLPKGDAPDLGAGAGGMGG

SEQ ID NO: 1008 - protein, 653 aa, Unknown
  Magnetococcus sp. MC-1
MCGISGFYQPAASEQELAHNITRMTATLQRRGPDDGGFWLEPSCGLALGHRRLAIQDLSPLGHQPMADASGRYQIVFNGEIYNFLELKQNLERHYGPQPWRGHSDTEVLLALIGHSGLEAALAQCRGMFALALWDRQQRILTLARDRLGEKPLYYGRQGDSLLFASELKALRAHPHWQGGVDRHALTLFMRHSTVPAPYTIHPGIHKLQAGCYQRFQWHPEQGMQDLGMIHYWSMSQVVAHANAHPFDGDETAALQAVEQQLMAIIGRQMVADVPLGAFLSGGIDSSLITAMMQAQSSRPVQSFTIGFAEASHDESAYAQAIARHLGTQHTTLQVTPQDALALVPSLPLIYDEPFSDASQLPTTLLAGLTRQHVTVALSGDGGDELFGGYDRYGESMALWRLRGRVPSPLRRPLARAGRALPSGVWSALLRPVAACLPAKARDNPGDIVHKMMDLLVQPDFAHLYRHMLSHWSDPGNLVVGGHEPPTNLTRGWTQPWRQDPVAQMMYWDTLLYLPDDILVKVDRAAMWSSLECRIPLLDHRLVELVWSMPMHFKRRDGVPKWLLQRLLGKRVPEALFERPKMGFGVPLERWLRGPLKGWAQDLLAPALLQRQGYLNPEPIARIWRQHQQGSHNWHHLLWDLLMWQAWLAEHEG

SEQ ID NO: 1009 - protein, 207 aa, Fusobacterium nucleatum
MKVKCFHLGAYGTNCFLAYDENNIAYFFDCGGRNLKQVYEYIEEHKLNLKCIILTHGHGDHIEGLNDLASHYPEAKVYIGEEDKDFLYNSELSLSDAIFGEVFRFKGELITVKEGDTIGDFKVIDTPGHTIGSKSFYDEKDKILMSGDTLFRRSYGRYDLPTGSLEMLCHSLEKLSKLPDETVVYNGHTDNTTIGEERRFLERVGIL

SEQ ID NO: 1010 - protein, 156 aa, Brassica napus
  misc_feature (138)..(138): Xaa can be any naturally occurring amino acid
MATENHADKNVVFRKLKAKSENKVCFDCSAKNPTWASVTYGVFLCIDCSAVHRNLGVHISFVRSTNLDSWSPEQLRTMMFGGNNRAQVFFKQHGWNDGGRIDAKYTSRAQHGWNDGGRIDAKYTSRAADLYKQTLAKXVAKAMAGRSSFAFICCCY

SEQ ID NO: 1011 - protein, 259 aa, Zea mays
MLNMMTDLSCGPSSKVKEQVAAAPTGSGDRQGQGRGKIEIKRIENTTNRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAISKIRARKNELLYAEVDYMQKREMDLQTDNMYLTSKIAESNETGQPAMHMMGVPPPTSEYDHMAPFDSRNFLQVSMPQHYSHQLQPTTLQLG

SEQ ID NO: 1012 - protein, 540 aa, Serratia ficaria
  misc_feature (533)..(533): Xaa can be any naturally occurring amino acid
MAAKDVKFGNDARVKMLRGVNVLADAVKVTLGPKGRNVVLDKSFGAPTITKDGVSVAREIELEDKFENMGAQMVKEVASKANDAAGDGTTTATVLAQSIITEGLKAVAAGMNPMDLKRGIDKAVVAAVEELKKLSVPCSDSKAIAQVGTISANSDETVGKLIAEAMEKVGKEGVITVEEGTGLQDELDVVEGMQFDRGYLSPYFINKPETGSVELESPFILLADKKISNIRELLPVLEAVAKAGKPLLIVAEDVEGEALATLVVNTMRGIVKVAAVKAPGFGDRRKAMLQDIATLTAGTVISEEIGLELEKATLEDLGQAKRVVINKDTTIIIDGVGDEATIQGRVTQIRQQIEEATSDYDREKLQERVAKLAGGVAVIKVGAATEVEMKEKKARVEDALHATRAAVEEGVVAGGGVALIRVAGKIAGLKGDNEDQNVGIKVALRAMESPLRQIVINAGEEASVIANNVKAGEGSYGYNAYSEEYGDMIAMGILDPTKVTRSALQYAASVAGLMITTECMVTDLPKADAPDLXGAGGMGG

SEQ ID NO: 1013 - protein, 540 aa, Serratia marcescens
  misc_feature (535)..(535): Xaa can be any naturally occurring amino acid
MAAKDVKFGNDARVKMLRGVNVLADAVKVTLGPKGRNVVLDKSFGAPTITKDGVSVAREIELEDKFENMGAQMVKEVASKANDAAGDGTTTATVLAQSIITEGLKAVAAGMNPMDLKRGIDKAVVAAVEELKKLSVPCSDSKAIAQVGTISANSDETVGKLIAEAMEKVGKEGVITVEEGTGLQDELDVVEGMQFDRGYLSPYFINKPETGSVELESPFILLADKKISNIREMLPVLEAVAKAGKPLLIIAEDVEGEALATLVVNTMRGIVKVAAVKAPGFGDRRKDMLQDIATLTAGTVISEEIGLELEKATLEDLGQAKRVVINKDTTIIIDGVGDEATIQGRVAQIRQQIEEATSDYDREKLQERVAKLAGGVAVIKVGAATEVEMKEKKARVEDALHATRAAVEEGVVAGGGVALIRVAGKIAALKGDNEDQNVGIKVALRAMEAPLRQIVVNAGEEASVIANQVKAGEGSYGYNAYSEEYGDMIAMGILDPTKVTRSALQYAASVAGLMITTECMVTDLPKADAPDLGAXGGMGG

SEQ ID NO: 1014 - protein, 539 aa, Serratia rubidaea
MAAKDVKFGNDARVKMLNGVNILADAVKVTLGPKGRNVVLDKSFGAPTITKDGVSVAREIELEDKFENMGAQMVKEVASKANDAAGDGTTTATVLAQAIVNEGLKAVAAGMNPMDLKRGIDKAVIAAVEELKKLSVPCSDSKAIAQVGTISANSDETVGKLIAEAMEKVGKEGVITVEEGTGLQDELDVVEGMQFDRGYLSPYFINKPETGSVELESPFILLADKKVSNIRELLPVLEAVAKAGKPLLIVAEDVEGEALATLVVNTMRGIVKVAAVKAPGFGDRRKAMLQDIATLTAGTVISEEIGMELEKATLEDLGQAKRVVINKDTTIIIDGIGDEATIQGRVAQIRQQIEEATSDYDREKLQERVAKLAGGVAVIKVGAATEVEMKEKKARVEDALHATRAAVEEGVVAGGGVALIRVASKIAELKGDNEDQNVGIKVALRAMEAPLRQIVINAGEEASVIANSVKAGEGSYGYNAYSEEYGDMIGMGILDPTKVTRSALQYAASVAGLMITTECMVTDLPKEDKADMGAAGMGG

SEQ ID NO: 1015 - protein, 224 aa, Glycine max
EGSDEIFGGYLYFHKAPNKKELHEETCQKIKALHLYDCLRANKSTAAWGVEARVPFLDKEFINVAMSIDPEWKMIRPDLGRIEKWVLRNAFDDDKNPYLPKHILYRQKEQFSDGVGYSWIDGLKDHANKQVTDATMMAANFIYPENTPTTKEGYLYRTIFEKFFPKNSAKATVPGGPSVACSTAKAVEWDASWSKNLDPSGRAALGVHAAAYDGAVDTTKNGPL

SEQ ID NO: 1016 - protein, 592 aa, Thiobacillus denitrificans
MPFGTRITPEGVRFRLWAPGCERVMLHIEEGAAVGRMMMPSGDGWFELLVDGAGAGTPYRFEVNDGLRVPDPASRFNPDDVHGASVVVDPTAFAWRDTAWKGRPWEEAVVYELHVGTFSPSGTFAGVIERLDYLVDLGVTAIELMPVADFPGVHNWGYDGVLLFAPDSRYGTPDDLKALVQSAHDKGLMVLLDVVYNHFGPEGNYLHVYARKFFSERHHTLWGAAINFDGSGSRTVRDFFIHNALYWLQEYHFDGLRLDAVHAIIDDSARHILTELAERVHAEIGSERAVHLILENDANEAHHLGQGGYTAQWNDDIHHALHVLATGEADGYYGDYADAPLVHLGRCLTEGFAYQGQASAYHEGESRGEPSGHLPLQAFVAFVQNHDQVGNRAFGERLTQLAPESALRAVAAVLLLAPSVPMLFMGEEFGARTPFQFFCDFGGELRDAVTQGRRREFRKFARFADPAAQAAIPDPNRPETFLASRLDWSEAGAGALDQYRGLLKLRRETIVPRLRLIEPGSAAFEVVAGVLRVRWGLHDGASLQLTAHLSQEPLGEVALEGEVIFATSDAAAAGVLGPWSVVWTLAAAETQA

SEQ ID NO: 1017 - protein, 351 aa, Xanthomonas oryzae
MATMAAHLLYRLPVPMSRPSLTRFLIEEQHAGRIDAELRQLITIVSRACKRISIAVSKGALGGVLGDAGTGNVQGEAQKKLDVLSNDILLEANAWGGHLAACASEEMDHSQPVPEQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPDETAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAAATRYHLDADKA

SEQ ID NO: 1018 - protein, 375 aa, Unknown
  Shewanella sp. ANA-3
MRILETIMNKPPIIWLNVILFSLTFLSAVILVPWYGLTHGYGASEWIAFVVLAFASGLSITAGYHRLWSHKAYKAHPAVRFLYALGGALALQNSALHWASDHRVHHKHVDDNDKDPYSANMGFWYSHIGWMLREYQAQRYHDYQNVRDLQNDRIVMWQHKHYLALVILMNIGLPALLGWFTGNIAGMLLMAGLLRLVVVHHCTFFINSLAHVWGSQPYTDKNTARDNGFLAMLTYGEGYHNFHHIFENDYRNGIKWWHYDPTKWLIKGLSWVGLAKDLRTSPQERIESARLQMQLLHAKNKVVHLPNADEVIEKIQQEYELMKEHLLEYYQAKKALLDAKRKQLVDQQLLLQVEELKTRFLTQQKSWKSLTASYS

SEQ ID NO: 1019 - protein, 421 aa, Arabidopsis thaliana
MEKKGSVLMLRYEVGKFLGQGTFAKVYHARHLKTGDSVAIKVIDKERILKVGMTEQIKREISAMRLLRHPNIVELHEVMATKSKIYFVMEHVKGGELFNKVSTGKLREDVARKYFQQLVRAVDFCHSRGVCHRDLKPENLLLDEHGNLKISDFGLSALSDSRRQDGLLHTTCGTPTYCAPEVISRNGYDGFKADVWSCGVILFVLLAGYLPFRDSNLMELYKKIGKAEVKFPNWLAPGAKRLLKRILDPNPNTRVSTEKIMKSSWFRKGLQEEVKESVEEETEVDAEAEGNASAEKEKKRCINLNAFEIISLSTGFDLSGLFEKGEEKEEMRFTSNREASEITEKLVEIGKDLKMKVRKKEHEWRVKMSAEATVVEAEVFEIAPSYHMVVLKKSGGDTAEYKRVMKESIRPALIDFVLAWH

SEQ ID NO: 1020 - protein, 72 aa, Castanea mollissima
VGGVSDVKGHENSLQIDDLARFAVDDHNKKANTLLQFKKVVNAKQQVVSGTIYILTLEVEDGGKKKVYEAKI

SEQ ID NO: 1021 - protein, 342 aa, Ashbya gossypii
MATVNPQRRDSAEAIDTDIITLARFILESQRSSAKNATGEFNLLLNSLSFAFKFISQTIRRAELVNLIGLSGASNATGDQQKKLDVLGDEIFINAMKASGNVKVLVSEEQEDLIVFPETGGTYAVCCDPIDGSSNLDAGVSVGTIVSIFKLTPDSSGTIKDVLRSGREIVAACYAMYGASTHVMLTTGQGVNGFTLDTSIGEFILTYRDLKMPALRNIYSINEGNMRFWTDGIRRFVEALKDSDKPYSARYIGSMVADVHRTLLYGGLFSYPLDMKNPNGKLCLLYEAFPMAFLVEQAGGKAVNDRGERILDLTPEHIHDKSSIWLGSAGEVDKYLAHIGRA

SEQ ID NO: 1022 - protein, 480 aa, Lactobacillus plantarum
MSEFPEGFLWGGATAANQLEGGYQEGGRGLSIADALPGGKDRFKIVSQPDFDWTIDTDKYTYPNHEGIDFYHHYKEDIALFAEMGFKCYRFSIAWSRIFPNGDETQPNEAGLKFYDDVIDECLANNIEPVITISHYELPLNLAKRYGGWKNRYLIEFYETFARTILTRYASKVKYWMTFNEINSAAHFPVMGQGLVPSTGANDKKNVFQAWHNQFVASAKAVKIAHELRDDIQVGCMILYATSYAYDSNPVNQLANLQHNQDFNFFCADVQVRGAYPTYTKRLLAEYNLTFDDLETTDGDLALLQQYPVDYIGFSYYMSSAVETTGSVTDTVAGNLMGGVKNPFLKASDWGWQIDPTGLRIALNELYDRYQKPLFVVENGLGAIDKPDKNFYVEDDYRIDYLKQHIEAMAGAIDDGVDLMGYTPWGCIDLVSASTGEMSKRYGFIYVDLDDQGHGTLARYPKKSFYWYQDVIKHNGLTKK

SEQ ID NO: 1023 - protein, 747 aa, Aspergillus oryzae
MANIVAGGLHKVQEAVQGAASKDKKLVDLAPDTHNVQSSKEPLTTDHGVRISDTDHWLKEVNDNHTGPMMLEDQIAREKIHRFDHERIPERVVHARGTAAFGNFKLHESAEDVSYAGILTDTSRNTPVFLRFSTVQGSKGSADTVRDVRGFAVKFYTDEGNWDLVGNNIPVFFIQDAIKFPDFVHAVKPEPHNEVPQAQTAHNNFWDFVYLHPEATHMFMWAMSDRAIPRSYRMMQGFGVNTFSLINKEGKRHFVKFHFIPHLGVHSLVWDEALKLAGQDPDFHRKDLMEAIDNGAYPKWDFAIQVIPEEKQDDFEFDIFDATKIWPEELVPLRVIGELELNRNVDEFFPQTEQVAFCTSHIVPGIDFSDDPLLQGRNFSYFDTQISRLGINWEEIPINRPVCPVLNHNRDGAKRHRIAQGTVTTWSNRSEAGPPAPVEHGGFASYPAKLNGIKKRGLSPKFREHHNQAQLFYNSLSEHEKVHVKKAFGFELDHCDDPIVYERLAGHRLAEIDLTLAQEVAELVGAPIPDKALRPNHGKRSKHLSQTEFPGKQPTIASRRIAIIIGDGYDPVAFNGLKGAITAVGALPFVIGTKRSPIYADGEDKSSSKGVIADHQYDGQRSTMFDATFIPGGPHVESLKANGQIRYWIIETFGHLKALGATGEAAAFIKEALGSALDVKVATSDNPQPVEWYGVVTAGKIHKPESFKEGIQIVKDAKDFISTFFYQISQHRNYKRELDGLASTVAF

SEQ ID NO: 1024 - protein, 639 aa, Magnaporthe grisea
MPICLWHGYAPSSAQRLLNSSIYLPKCSLGQFNTMAPRNQKRKAASPAGSHGSDSKKIKTESVEPISTSDPLRRPHTFYKESEENGIVLREFYPHEMSNERARAYNNDEIPRPIEDLYQAMSQTHPIRQKVKVKGAVVHWFKMDLRVADNTALRLASEKAKSAGVPLIALYTVSPKDWEAHLRAPVRVDFTLRSLEVLRQDLAKLDIPLHVETVDDRRAMKQRVLSLMEEWDASHLYANMEYEVDELRREANLVRLLAENGKSMEVVHDTCVVPPGKLQTGTGRQYAVYSPWYRAWLKHLSGDPELLEPMEPPHKNPASAREKFSHLFDGKIPAAPKSKQMNEEEQQRLAAMWPAGEHEARKRLDAFIKRRIDGYAAKRNFPADDGTSSISVHLAAGTLSARTAVHLAHKASGTRKLDGGSQGIQTWISEVAWRDFYKHVLVNWPYVCLTSAGSCPHSMNKPFKPEYSNIAWSYDMEHFAAWCEGRTGFPIVDAAMRQLRGTGWMHNRCRMIVASFLAKDFLIDWRMGERYFMENLVDGDFASNNGGWGFAASVGVDPQPYFRVFNPLLQSEKFDPNGEYIRKWIPELKGIKGKAIHDPYGRGCGVEAKKKGYPKPLVDHKGCRERALKAYKEGISKEI

SEQ ID NO: 1025 - protein, 365 aa, Zea mays
  misc_feature (124)..(124): Xaa can be any naturally occurring amino acid
  misc_feature (355)..(355): Xaa can be any naturally occurring amino acid
MECLTSSTLYGYSSLSFLFPADKMKFGATYEEYLRAERDKFLGQCSHVEYKRLKKVLKKCRVGRSLQADGTNGDEQQEGRDESSNICECNSCTLCDEMFFTEPNKEASEIAGCFRSRVQRLLHXHVPSGLQRCIWRFRQCFIDDQQIMVQEGRMLLNYVTMNAIAIRKILKKYDKIHGSVSGRDFKSKMQTEHIELLQSPWLIELAAFHLNCDDSDADEPRAGEFFKNGFFKNFSCDLSGAQPLLTMTISETLKYEYSLTCPICLDTLFNPYALSCGHLFCKACACGAASVYIFQGVKSAPPEAKCPVCRAVGVFDRAVRMTELELLLKRRDKDYFLQRLREERSVMVKQAKEYXDSQAMLSMGI

SEQ ID NO: 1026 - protein, 427 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKVRFLPCLL

SEQ ID NO: 1027 - protein, 526 aa, Rhodopirellula baltica
MRRDFQILVRTAQRVRRDQTKAFMAAGPRTSLTTDWHVMANALVWFRNDLRTIDHEPFLRASTADRCFAVHCIDPRQFETTELGFQRTGPFRARFLIENLTDLRSRLRSLGGELIVRVGRPETVLQHLLPSLAIDAVHFHHEPRTEEADTAESVQQLCDQHGIATHVAYGDTLIHPDELPFEIADTPELFTDFRKEIEKQCEARSPLEEPIRIHGTLPEEVNAGDIPTLESLGLSTPPLDDRCLNQFTGGQNAAQQRMEEYIWNEDRLRVYKETRNGMLHPNDSSKFSPWLAQGCLSPRMIADHVRRYEEERVKNKSTYWMIFELLWRDYFRWISRKHGATLFRAGGLRGVNVDWKSDRELFRRWQDGTTGYPLVDANMRELRTTGYMSNRGRQNVASFLTKNLGIDWRWGARWFESQLVDYDVASNYGNWNYAAGVGNDARGFRFFNITKQSRDYDSQGEYAKHWLPELRDLDVTEIHEPWKMSPERQQEVGATLGKEYPHPIVDLFDSAKENETIYMRAKAASH

SEQ ID NO: 1028 - protein, 547 aa, Escherichia coli
AAKDVKFGNDAGVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTVAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNADQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 1029 - protein, 582 aa, Bacteroides thetaiotaomicron
MSTRNSSRFTPIIIAISVVAGILIGTFYAKHFAGNRLGIINGSSNKLNALLRIVDDQYVDTVNMTDLVEKAMPQILAELDPHSTYIPAQNLEEVNSELEGSFSGIGIQFTIQNDTIHVNAVIQGGPSEKVGLMAGDRIVNVDDSLFVGKKLNNELAMRTLKGPKGSQVKLGVKRVGEPKLLDFTITRGDIPQNTVDAAYMLNDDIGYVKVSKFGRTSHVELLNALAQLNHKKCKGLIIDLRGNTGGYMEAAIRMVNEFLPEGKLIVYTQGRKYPRAEEFANGTGSCQKMPLVVLIDEGSASASEIFTGAIQDNDRGTVVGRRSFGKGLVQQPIDFSDGSAIRLTIARYYTPSGRCIQRPYESGKDKNYELDIYNRYEHGEFFSRDSIKLNENERYLTSLGRTVYGGGGIMPDVFVPQDTTGVTSYLSSVINRGLTLQFTFQYTDNNRKKLSQYETEEDLLNYLRHQGLVEQFIRFADSKGVKRRNILIQKSYKRLEANIYGNIIYNMLGLEAYLKYFNKSDATVQQGIELLEKGEAFPKAPAETEEEVTKDNKDGKKKRTAQAYGITEDPTRIFDFAEATIS

SEQ ID NO: 1030 - protein, 462 aa, Bacillus clausii
MAHAYSFPKDFWWGSAVSATQIEGAANEGGKGKNIWDHWYELEPNRFFEEVGPSATSDFYHRYQDDIALMKAIGHNSFRFSISWSRLIPGGEGEVNKEAVAFYNNVIDELIANGIEPFVNLFHFDMPFELQEKGGWENREVVELYAQYAAACYDLFGDRVKKWFTFNEPIVPVEGGYLYDFHYPNIVDARRAFQVAYHTVLAHALAVAAFRTRSIEDGKIGIILNLTPSYPRSDHLGDQKAAAIADLFFNRSFLDAVVLGSFPKELVALLDEYGQLPTYEKEDVALINAQRIDLLGVNYYQPRRVKAKEHLPNPASPFMPEWFFDHYDMPGRKMNHYRGWEIYEKGIYDIMVNLKDNYGNIESFVSENGMGVQNEERFMENGQIQDKYRIEFIKGHLKWLHQAIQEGCNVRGYHLWTFMDNWSWTNAYKNRYGFISVDVQTQKRTPKKSAEWIKAVSQQNGF

SEQ ID NO: 1031 - protein, 736 aa, Neurospora crassa
MSNIISQAGQKAKEALTSAPSSKKVDDLKNEFKETDKSARLTTDYGVKQTTADDWLRIVSDDKIGPSLLEDPFARERIMRFDHERIPERVVHARGSGAFGKFKVYESASDLTMAPVLTDTSRETPVFVRFSTVLGSRGSADTVRDVRGFAVKFYTEEGNWDLVGNNIPVFFIQDAIKFPDVIHAGKPEPHNEVPQAQSAHNNFWDFQFNHTEATHMFTWAMSDRAIPRSLRMMQGFGVNTYTLINAQGKRHFVKFHWTPELGVHSLVWDEALKLAGQDPDFHRKDLWEAIENGAYPKWKFGIQAIAEEDEHKFDFDILDATKIWPEDLVPVRYIGEMELNRNPDEFFPQTEQIAFCTSHVVNGIGFSDDPLLQGRNFSYFDTQISRLGVNFQELPINRPVCPVMNFNRDGAMRHTISRGTVNYYPNRFDACPPASLKEGGYLEYAQKVAGIKARARSAKFKEHFSQAQLFYNSMSPIEKQHMINAFGFELDHCEDPVVYGRMVQRLADIDLGLAQTIAEMVGGEAPTTTNHPNHGRKTINLSQTEFPPATPTIKSRRVAIIIADGYDNVAYDAAYAAISANQAIPLVIGPRRSKVTAANGSTVQPHHHLEGFRSTMVDAIFIPGGAKAAETLSKNGRALHWIREAFGHLKAIGATGEAVDLVAKAIALPQVTVSSEAEVHESYGVVTLKKVKPESFTDAVKIAKGAAGFLGEFFYAIAQHRNWDRELDGLHSMIAY

SEQ ID NO: 1032 - protein, 278 aa, Bacillus halodurans
MIQSIQDRVKLANGVEMPWFGLGVYKAAEGEEVIGAVRAALKAGYRSIDTASLYQNEVGVGQAIRESGIPRDEIFVTTKVWNTEQGYDETLAAFERSRKRLGLEVIDLYLIHWPVREKFLDTWRALETLYKERKVRAIGVSNFNIHHLETVMNISDINPMVNQVEFHPFLTQKPLLTFCKAHDIQLEAWRPLTKGEIFTHPVVQALAKKYGKTPAQIVLRWNLEHRVVTIPKSVREERIQENANIFDFHLSPEDVEALDGLNEDRRLGQDPDSFSFDF

SEQ ID NO: 1033 - protein, 280 aa, Leuconostoc mesenteroides
MSLNELYELNDGHQLPKIGLGTFQIRGYQGVDQILNAIQIGYRLLDTSTNYDSEGAVGEAIRRSGIPRSQFYVTTKLPGKYHHFDDALKIIEESLLRLGLDYLDLYLIHWPLPKRDNYVEAWQALIEAQRRGLVRSIGVSNFEKEHLDKIISATGVTPAVNQNEIHPYWPQESLVATNQEYGIVTEAWSPLGRGSSELTEPLILKLAEKYDKNAGQIILRWHIQRGILPVAKSTTPQHQRRNLDIFDFTLTETEVSQISDLERKDGRVDDQDPKEYEEFV

SEQ ID NO: 1034 - protein, 131 aa, Glycine max
MSFINPSPSSTSRAIAPSGFATRRPWEEFFALHSFTRPYTLGEASLRVKRNLGHFRVNYAMAVLLVVFLSLLWHPISLIVFLAVFTAWFFLYFFRDGPVVVLRHELDDRLVLAALTAVTVAALVLTGVWLN

SEQ ID NO: 1035 - protein, 384 aa, Brachylophon curtisii
DLEPVNPADVPVTAAGALKSYKLAAKAISRLQSLPSGNISMLCDVLVKEVRDLTGYDRVMVYKFHEDEHGEVVSECRRPDLEAYLGLHYPATDIPQASRFLFMKNKVRMICDCLAPPVKVIQDERLPQPLSLCGSTLRSPHGCHAQYMANMGTIASLVMSVTINEDDDMMDGDQRQMARKLWGLVVCHHTSARFVPFPLRYACEFLIQVFGVQINKEVELAAQVREKHILRIQTLLCDMLLRDAPVAIITQSPNVMDLVKCDGAALYYKKKFWLLGITPTEAQIRDIAEWLLEYHNGNTGLSTDSLMEAGYPGASVLGDAVCGMAAVSITSRDFLFWFRSHTAKEIKWGGAKHDPDDKDDGRKMHPRSSFKAFLEVVKWRSLPW

SEQ ID NO: 1036 - protein, 186 aa, Cicer arietinum
MAASESKESPANNPGLHTTIDEATKGYFMQQTMFRIKDPKVSLDFYSRVLGMSLLKRLDFPEMKFSLYFMGYEDTTEAPSNPVDRTVWTFAQKATIELTHNWGTESDPEFKGYHNGNSDPRGFGHIGITVDDTYKACERFQNLGVEFVKKPDDGKMKGIAFIKDPDGYWIELFDRKTIGNVTEGNA

SEQ ID NO: 1037 - protein, 370 aa, Arabidopsis thaliana
MENGEAKQSVPLLTPYKMGRFNLSHRVVLAPLTRQRSYGNVPHAAIYYSQRTTPGGFLITEATGVSDTAQGYQDTPGIWTKEHVEAWKPIVDAVHAKGGIFFCQIWHVGRVSNSGFQPNGKAPISCSDKPLMPQIRSNGIDEALFTPPRRLGIEEIPGIVNDFRLAARNAMEAGFDGVEIHGANGYLIDQFMKDTVNDRTDEYGGSLQNRCKFPLEIVDAVAKEIGPDRVGIRLSPFADYMESGDTNPGALGLYMAESLNKYGILYCHVIEARMKTMGEVHACPHTLMPMRKAFKGTFISAGGFTREDGNEAVSKGRTDLVAYGRWFLANPDLPKRFQVDAPLNKYDRPTFYTSDPVVGYTDYPFLESTA

SEQ ID NO: 1038 - protein, 389 aa, Triticum aestivum
ALTEENLLFLEAWRAVDRAYYDKSFNGQSWFRYRERALRDDPMNTRQETYAAIKKMLATLDDPFTRLLEPEKFKSLRSGTQGALTGVGLSIGYPLALKGSPAGLSVMSAAPGGPAEKAGIVSGDVILAIDDTSAQDMDIYDAADRLQGPEGSSIDLTILSGADTRHVVLKRERYTLNPVRSRMCEIPGSEDSSKIGYIKLTTFNQNAAGSVKEAIKKLREKNVKAFVLDLRNNSGGLFPEGIEIAKIWMDKGVIVYICDSRGVRDIYEADGASTIAASEPLVVLVNKGTASASEILAGALKDNKRAVVYGEPTYGKGKIQSVFALSDGSGLAVTVARYETPAHTDIDKVGVTPDRPLPASFPTDEDGFCSCLRDPASCNLNAARLFVRS

SEQ ID NO: 1039 - protein, 486 aa, Unknown
  Shewanella sp. MR-4
MSQQYLTSQSGSPIADDQNSLSAGERGPLLLQDWHLIEKLAHFNRERIPERVVHAKGTGVYGTFTLTKDLSEYTIADHFNGVGKQTETFVRFSTVGGEMGSADAERDPRGFGLRFYTARGNHDIVGNNTPTFFLRDGIKFPDFIHTQKRNPLTNLKDPQAMWDFWSLNPEAMHQVTILMSDRGIPANYRQMHGYGSHTFSFWNAKGERFWVKFHFKSQQGVVNLTNEQADKLKGIDPDSSQRDMVVAVTDGNFPRWTVNVQIMPEADANTYHINPFDLTKVWPHGDYPLIEIGVLELNRLPQNYFAEVEQVALAPSNLVPGVGASPDKMLQARLFAYADAQRYRIGANYNQLPVNCPHATKANHHQRAGAMAGTQCPYHGSQTGGDAAANYGPNSTAGALVEPANFAEPPLRLDGEAARYSRYNQDDYTQAGNLYRIFSEAEKARLVETISGSLRQASVEVQQRMLAHFHKADADYGQRIQTALGL

SEQ ID NO: 1040 - protein, 226 aa, Oryza sativa
MGLNEKPLVPPLSPTPVDFRAHQVFPSKHHDFDTSKSRNISGSVAIGSDSEEEYLATSLLMLAHGIRDETKDIRGMGDVKGVGVDTLELVKPSQRAYECSVCGKVYWCYQALGGHMTCHRNLFAQVVAGDELSSDRTMVVKGHKCSICRLEFPSGQALGGHMRVHYVGGVEGGSVKEKNVVKTKVTGALKLVLKDFDLNVPVVATMVGDEAESSHSEAKARMMTLP

SEQ ID NO: 1041 - protein, 473 aa, Nicotiana plumbaginifolia
MCRNKMFSQPNWRHSKLFIDKQSFLVTQNGLAFLPRKFRTILRKTVKHSEIFRNIVPDIFVRSCIGLMLVMALNAAVAKAPSFALTEQNLLFLEAWRTIDRAYIDKTFNGQSWFRYREDALRKEPMNTRQETYAAIKKMIATLDDPFTRFLEPEKFKSLRSGTQNALTGVGLSIGYPTGKTESAPGLVVVSASPGGPADRAGISSGDIILEIDNSSTENMGIYDAAERLQGPEGSGVELTVRRGSETRNLPLIREKVLLNPVKSRICKLPTGGDDAPQIGYIKLSTFNQNASGAVREAIEALRKNNVNAFVLDLRDNSGGLFPEGVEIAKIWLNKGVIVYICDSRGVRDIYDTDGSNVVAASEPLAVLVNKGTASASEILAGALKDNTRAQLFGEPTYGKGKIQSVFQLSDGSGLAVTVARYETPAHNDIDKVGVIPDHPLPASFPKDDESFCNCLLNPASACHLNRVELFSK

SEQ ID NO: 1042 - protein, 457 aa, Staphylococcus epidermidis
MAIGVILNRVFRLNNNPLFDYIYSNKESINHCYFIIPTEEFEEEAKKKAQYYYGSIQKFMYELQRYDIEPFLMSYDKLIDFCKKQAIDKVVVAGDIMSYHHEEYDILHQRKRFKQANIQVISLRANHYFNPRKTHNKQGEPYKVFTSFYRKWRPYLMIRDEYDYHLEDISKVVVKSQHKIKEDYHSYGISERDVQNRWSEFLSQDIENYKENREYLPEVLTSQLSIYLAYGMIDIIQVFNDLLQNYDKNEQNYETFIRELIFREFYYVLMTNYPETAHVAFKEKYQQLKWSYNEENFKLWKDGNTGFPIIDAAMEELKTTGFMHNRMRMVVSQFLTKDLFIDWIWGESFFKQKLIDYDAASNVHGWQWSASTGTDAVPYFRMFNPIRQSERFDNNARYIKTYIPRLNQVDAKYLHDTHKFEQQIKGQGVEIGKDYPKQMIDHKESRQRVMSEFKALD

SEQ ID NO: 1043 - protein, 373 aa, Drechslerella dactyloides
MASPTPPNSTASPKPQAPPSQVQACRYKTGKTLGSGSYSVVRECVHIHTGRYYAAKIINQKLMAGREHMVRNEIAVLKKVSMGHQNILTLVDYFETMNNLYLVTDLALGGELFDRICRKGSYFESDAADLIRATLSAVAYLHDHGIVHRDLKPENLLFRTPEDNADLLIADFGLSRIMDEERFHVLTTTCGTPGYMAPEIFKKTGHGKPVDIWAIGVITYFLLCGYTPFDRDSNLEEMQAILKADYKFEPAQYWSDISENAKDFIRRCLTIDPKARPTAHAALEHPFICEDQPEREADLLPTVRKNFNARRTLHAAIDTIRAINKLREGGMMDGALSSAPENQKEKQPQNQPATGLWQGTAQAATAKGLWSKS

SEQ ID NO: 1044 - protein, 345 aa, Bacillus cereus
MHSKLFSPYTIKDVTLKNRIVMSPMCMYSAENEDGQVTNFHLVHYGTRAAGQVGLVMIEATAVLPEGRISNKDLGIWDNSLIEGLHKTTTFIHDNGAKAAIQLAHAGRKAELETDALAPSAIPFNETMKMPIEMSKHQIKDTVLAFQQAAVRSKQAGFDVIEIHGAHGYLINEFLSPLSNKRTDEYGGSPENRYRFLREIIDSINEVWNGPLFVRISANDYHPDGLTVQDYVQYTKWMKEQGIDLIDCSSGAVVPARIDVYPGYQVQYAKHIKEHANIATGAVGLITTGAQAEQILNNNEADLIFIGRELLRNPYFPRIAANELGFELKEPYQYERAPGKISTNK

SEQ ID NO: 1045 - protein, 407 aa, Haloarcula marismortui
MNRSHTVSVRLLTIIGTDSAYAEPAVNYVIRLPGGVTLFDSTTLNELPLDNRVGLAPMTRVSATDDGRATAEMAQYYQRFADGGFSFLITEGTYPDEAHSQGYLNQPGLATDTQAASWQQVTETVHEAGVPIFAQLMHAGAQSQGNPHVAGEQTIAPSAVQPDGQKAEAYGGSGDFPTPKAATVDELADIRDSFVTSAQNAIDAGFDGVEIHGANGYLLHEFLSADFNQRDDEYGGEPANRVRYPREVVAAVDEATPADFVVGIRVSQSTALDEDHRWPEGEDAAAVFFEELSAAGADYIHVTEPDATTPAFGDDGPTLAEAAAEYAADETVIIDNGGLGTPDAAREKIDAGADLVTLATSALANPDWPDKVEAGEELTAFDPAKFLAPSAALSEHEVQTGGASADD

SEQ ID NO: 1046 - protein, 338 aa, Listeria monocytogenes
MSKLFSEYKLKDVTLKNRIVMSPMCMYSVENKDGIATDFHFAHYVSRAAGGTGLVILEATAVQEVGRISEFDLGLWNDEQVPALKSLVDGLHYHGAKAGIQLAHAGRKAVLPGEIVAPSAIPFDEKSAKPVELTKEAIKEVVADFKRAAYRAKEAGFDVIEIHAAHGYLIHQFLSPITNRREDNYGGPAGNRYKILSDIIKAVKEVWDGPIIVRVSATDYAHGGLQLEDHIPFAKWMKADGVELIDVSTGGLVNVAPPVFPGYQVPFADEIRRGAGIATGALGLITRGEQAEEILCNERADLIIVGRELLRNPYFAKDAAKQLGETIEGPKQYSRAWK

SEQ ID NO: 1047 - protein, 277 aa, Bacillus anthracis
MSLTSLKDYTTLHNGVKMPWFGLGVFKVEDGSQVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQDIAKKYNKSTAQIILRWDLQNEVVTIPKSIKEHRIIENANIFDFELSSDDMKAIQALNEDHRVGPDPDNFNF

SEQ ID NO: 1048 - protein, 404 aa, Glycine max
MDRRVYHHRPAPPAHASPPEYFVLQGNTTYKDDLYLRKRTGMRRWLCCTCQVEESYPSNENEHLKSPRNYGDGNQKGSKVSAPVKPETQKAPPPIEAPALSLDELKEKTDNFGSKALIGEGSYGRVYYATLNNGKAVAVKKLDVSSEPESNNEFLTQVSMVSRLKNGNFVELHGYCVEGNLRVLAYEFATMGSLHDILHGRKGVQGAQPGPTLDWIQRVRIAVDAARGLEYLHEKVQPPIIHRDIRSSNVLIFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKSPAPAAPES

SEQ ID NO: 1049 - protein, 374 aa, Pseudomonas fluorescens
MNHSSFFTPVTLGRHILKNRIVLPPLTRQRSTQPGNVANELMAEYYQQRAGAGLLVTEGTQIEPRGQGYAWTPGIHTPEQIVGWRKVTEAVHASDGVIFAQLWHVGRVSHTALQPNGDAPVSASAIATDRVSVFIETAPGVGALVPPSAPRALTTDEVQELVQLYIQAARNAMDAGFDGIELHCANGYLVNQFISAHSNLRTDQYGGSLHNRLRFLREVVAGVAKCIGKEKVGVRFAPLFTTTDEARTYLGMVEEDPHTTYIEAIKVLQDVGIAYLSIAEADWDDAPVMPQTFRRAVRDTFGGAIIYAGRYNAESGARLLESGLADLVAFGRPFMANPDLPARIANDWPLNSLNPATVYGGDAEGYVDYPVYGE

SEQ ID NO: 1050 - protein, 532 aa, Hordeum brevisubulatum
MGQCCSRATSPDSVQGGANGYGYSHQPKQAQAPPSYNNAQPPPRAEVRYTPPAMNPPVVPPVVAPSKPMPDTILGKQYEDVRSVYSLGKELGRGQFGVTYLCTEISTGRQYACKSISKRKLVSKADKEDIRREIQIMQHLSGQPNIVEFCGAYEDKGSVHVVMELCAGGELFDRIIAKGHYSERAAATICRGVVNVVNVCHFMGVMHRDLKPENFLLATKDENAVLKATDFGLSVFIEEGKMYRDIVGSGLLCCSEVLRRNYGKEIDVWSAGVILYILLSGVPPFWAETEKGIFDAILQGEIDFESQPWPSISESAKDLVRKMLAQDPKKRISSAQVLRHPWLREGEASDKPIDSAVLSRMKQFRAMNKLKKMALKVIASNLNEEEIKGLKQMFMNMDTDNSGTFTYEELKAGLAKLGSKLSEAEVKQLMDAADVDGNGSIDYVEFITATMHRHKLERDEHLFKAFQYFDKDNSGFITRDELETALIEHEMGDADTIKDIISEVDTDNDGRINYEEFCAMMRGGIQQPIKLK

SEQ ID NO: 1051 - protein, 335 aa, Brassica juncea
MLSKACSLVASSLPRCSSSAAPTIREAAVVAAKRAQENGLGKPLLYGIGTLLVMPLRTLHGVGRMFGAGRFLCNMTSVSSSLQIELVPCLQDNYAYILHDVDTGTVGVVDPSEATPIINALEKRNQNLTYILNTHHHYDHTGGNLELKAKYGAKVIGSAKDRDRIPGIDITLSEGDTWMFAGHQVLVMETPGHTSGHVCYHFPGSGAIFTGDTLFSLSCGKLFEGTPQQMYSSLQKIIALPDETRVYCGHEYTLSNSKFALSIEPGNKDLQEYAANAADLRKRNTPTVPTTIGREKQCNPFLRTSSPEIKNTLSIPDHFDDARVLEVVRRAKDNF

SEQ ID NO: 1052 - protein, 195 aa, Arabidopsis thaliana
  misc_feature (74)..(74): Xaa can be any naturally occurring amino acid
  misc_feature (110)..(110): Xaa can be any naturally occurring amino acid
MSLIPSFFGNNRRINNNIFDPFSLDVWDPFKELQFPSNSSSAMLLGHQQAKEQHLAHGSHSAFGIHSRNCNSRXSLSGETAAITNARVDWKETADAHVFKADLDGMKKVXVKVEIEDDSVLKISGERHVEKEEKQDTWHRVERSSGQFSRKFKLPENVKMDQVKASMENGVLTVTVPKVEEAKKKAQVKSIDISG

SEQ ID NO: 1053 - protein, 1005 aa, Cryptococcus neoformans
MTSFNPAPAQIQAAQDHTYGSMPTPTYMGMVDTGAQWDYVGRRGSSRSREPSASPQRAATESGIPRTSTHAASASASSSYAPVAGASGQASSAPHEPTIREEATAVVDRSMRAHQQTTGPSNGNGNSQPKKSKVRMVGDWQLNKTLGAGSMGKVKLATNIVTKEKCAVKIIPRYTDANRKEETTRTPEEVEKQRLKDESKEIRTIREAHISLLLHHPYICGMREFISHQNHHYMVFEFIDGGQMLDYIISHGRLRERAARKFARQIGSALNYCHQNSIVHRDLKIENILISKNGNIKLIDFGLSNLYSPSRHLSTFCGSLYFAAPELLNARPYTGPEVDVWSFGIVIYVLVCGKVPFDDQSMPALHAKIKRGVVEYPSWLSAEVKSLLSRMLVTNPAERATLAEVLSHPFMTKGYDGPPDSFLIRRELLRAEEIDMNVVEAMEGFTFGDANTIYRNLHSILTSEDYLHCVATFEAHREKLRTSSPGVSTNDPSDSPKKKRFSGFDLKKRLFKEDKKVEEAPFKEKVRDPTKGYDPLISIYFLAREKIERERVFGPGFFASSQLSLDTFNTSQGYGMAVPNLPPPASTHVMGHDSSRGPDFASEPRPRSDDVPNPVMAHPSADREQSKLADIPSAVHRRQPSLSQPPLPSSMPAAVERSADEGLTKKFSMLGRGPRPPSAGPAGPSRSASTKRESMTASPSMPIQEHRRATTVVHSDKSKQERRVSVGSFTNSVSKASGLARRASQRDRPPATPPDSRWLNAPAEAEEYHQVETSVRPSSTPREPEPDTANEPQSYDDVKPSYLKGIFSVSTTSTKPANVLIRDIAMVLDRIGIKHRPIKGGFECVHMPSIDLASVVNGDEASTSLSNVPSHASGARRKQSLRRKGSKVNMNGISSNGAGSRATSPGPHRVLTGNSSGTVSGGDVAHLSVPSGKNRHHVGTVEEDEVDAWALAQSGGAGSSLIVRFEIFVVKVPVLPLHGIQFRRVGGDGWQYQMLAKAILREMRL

SEQ ID NO: 1054 - protein, 97 aa, Triticum aestivum
  misc_feature (80)..(80): Xaa can be any naturally occurring amino acid
KALHQYDCLRANKATSAWGLEVRVPFLDKEFIDVAMSMDPEWKLYDADLGRIEKWVLRKAFDDEKEPYLPRHILYRQKEXFNDGVGYNWIRRLKRFY

SEQ ID NO: 1055 - protein, 398 aa, Ralstonia solanacearum
MNLIDSFLSFLANGTLNWAWWQILIFTLVVTHMTIASVTIFLHRCQAHRALDLHPAAAHVFRFWLWLTTGMVTKEWAAIHRKHHAKCETEEDPHSPQTRGIRKVLLEGAELYRAEAKNRETIQKFGHGTPNDWIEQNLYSKYTWQGVGLMLILDVLMFGTLGLTVWAVQMLWIPIHAAGIINGLGHYWGYRNFDCEDASTNVFPWGLIIGGEELHNNHHTYATSAKFSIKWYEFDVGWGYIRALEMVGLAKVKKVAPKARFGDVKPVDQNTLEAIIANRYDVMARYAKTVKVAYRQELAKLKDARDVEYRALKPARKWFHRDEAKLGAPQREQLSQIVSDHSALHTFVEMRRDLGALWGRSNATREQLLHQLQEWCKRAEESGIHALQEFAVRLRRYA

SEQ ID NO: 1056 - protein, 641 aa, Rhodococcus erythropolis
MCGLLGLLTSGGTSEDAVSRVDQAMHCLRHRGPDEHGTWNDDHLVFGFNRLAIIDIAHSHQPLRWGPPENPERYALTFNGEIYNYLEIRAELVKDHDAKFFTEGDSEAIVAAFHYWGEDAVRRLRGMFAFAIWDTDTRELFIARDPFGIKPLFIATGAGGTAFGSEKKSLLELTDLIGIGTELDPRAIEHYTVLQYVPEPETLHKEIRRLESGSFARVRPGEEPTFTRYFTPKFPAKPFAPGTEKARYQEIAEALEDSVAKHMRADVTVGSFLSGGIDSTAIAALAMRHNPNLITFTTGFEREGYSEVDVAAESAAAIGAKHVVKVVSPAEFAAAIPEIVWYLDDPVADPALIPLWFIAKEARKHVKVVLSGEGADELFGGYTIYREPLSLKPFEYLPKGLRRAAGKLSERIPDGTRGKSLLNRGSLTLEERYYGNARSFNDAQLRAVLRDFRPEWTHQDVTAPIYAQSRDWDPVARMQHLDLFTWLRGDILVKADKMTMANSLELRVPFLDPEVFDVASRVPLDQKITKDTTKYALRQALEGIVPHHVLHRAKLGFPVPLRHWLRGTELFDWAHLQIEESGTDHIFDKQAVVKMLNDHREGVSDHSRRLWTVLTFMVWHGIFVEKRIVPQIQEPVYPVNI

SEQ ID NO: 1057 - protein, 236 aa, Gossypium hirsutum
MGRGRVELKRIENKINRQVTFAKRRNGLLKKAYELSVLCDAEVALIIFSNRGKLYEFCSSSSMIKILERYQKCNYGAPEPNVSSREAALELSSRQEYLKLKARYDALQRSQRNLLGEDLGPLSSKELESLEKQLDSSLKLIRSTRTQYMLDQLNDLQRKEHLLNEANRTLKQRLVEGYQVNSLQLNPNATEDVGYGRQQVHHQPHGDAFFHPLDCEPTLQIGYQHDPMSVVTAGPV

SEQ ID NO: 1058 - protein, 223 aa, Gossypium hirsutum
MGRGKIEIKRIENTTNRQVTFCKRRNGLLKKAYELSVLCDAEVALIVFSSRGRLYEYSNNNIRSTIDRYKKACSDTSNTNTVTEINAQYYQQESAKLRQQIQMLQNSNRHLMGDSLSSLTVKELKQVENRLERGITRIRSKKHEMLLAEIEFLQKREIELENESVCLRTKIAEIERLQQANMVTGPELNAIQALASRNFFSPNVIEHPSAYSHPSDKKILHLG

SEQ ID NO: 1059 - protein, 483 aa, Buchnera aphidicola
MQKNLIWFRNDLRVYDNTALHQACQNDTDKVISLFISTPKQWHNQSVSKKKISFMYYHLISLQKELLKLNIILYYHESTDFLNSIEYLIFFCKKHKVNNLFYNYEYAINERYRDYLVKKKLSQKGFLVKGFHDNLLFSNRQIRNQKNETYKVFTFFKKKVIQNLHNNIPQCFPVPSKRKSDRDIFLTSISLKNVNLNFNKNFFPVGEKEAINRLKNFCIYKFNDYFLKRDYPFLDATSMLSPYLSAGIISSRYCLKVLLKTKNSLPLNVLLTSPWFDQILWREFYYHLLIGFPKISRSESLVTWEKEIHWINNIKHFNAWKEGNTGFPIIDAGMRQLNELGWMHNRLRMITSSFLVKNLLINWREGEEHFISNLIDGDLALNNGGWQWSASVGCDSVPYIRIFNPLHQSKTFDESGNFIKKFIPELKNVPNHHIHQPHEWSKQKNFKIDYPNPIINYSESRKTSLSLFKQARLKLHKNGLKNS

SEQ ID NO: 1060 - protein, 472 aa, Escherichia coli
  misc_feature (309)..(309): Xaa can be any naturally occurring amino acid
MTTHLVWFRQDLRLHDNLALAAACRNSSARLLALYIATPRQWAAHNMSPRQAELINAQLNGLQIALAEKGIPLLFREVDDFAASVEIVKQVCAENSVTHLFYNYQYEVNERARDVQVERTLRNVVCEGFDDSVILPPGAVMTGNHEMYKVFTPFKNAWLKRLREGMPECVAAPKVRSSGSIKPAPSITLNYPRQSFDTAHFPVEEKAAIAQLRQFCQNGAGEYEQQRDFPAVEGTSRLSASLATGGLSPRQCLHRLLAEQPQALDGGAGSVWLNELIWREFYRHLMTYYPSLCKHCPFIAWTDRVQWQXNPAHLQAWQEGKTGYPIVDAAMRQLNSTGWMHNRLRMITASFLVKDLLIDWREGERYFMSQLIDGDLAANNGGWQWAASTGTDAAPYFRIFNPTTQGEKFDREGEFIRQWLPELRNVPGKSVHEPWKWAEKAGVKLDYPQPIVEHKEARVQTLAAYEAARKGK

SEQ ID NO: 1061 - protein, 365 aa, Ashbya gossypii
MPRTITFDIPSHYKLVDLIGEGAYGIVCSAIHKPTGTKVAIKKIQPFTRPMFVTRTLRELKLLKFFHSHENIISVLDIVRPTSYQDFEAVYLVQELMETDLQRIISQPNSFLSDDHIQYFTYQILRALKSLHSAQVIHRDLKPSNLLLNSSCDLKLCDFGLSRCLASSDRSRENMVGFMTEYVATRWYRAPEIMLSFQEYTTAMDIWSCGCILAEMISGKPLFPGRDYHHQLWIILEILGTPSFEDFEQIKSKRAKAYIANLPMRPKIPWNVALSTNDINPLAMDLLDKMLTFNPDKRISAADALKHPYLETYHDAEDEPDYELLNLQDNFWKVDNEARQKTEEEELSMDTLKAMLYEEVMKPLQ

SEQ ID NO: 1062 - protein, 768 aa, Nostoc punctiforme
MEMNLQFPGINLISLKEAPIHISSQIQPHGVLLVLEEPELKILQVSTNTLKVFGIAPENMLHKKLEDLLDPFQIERIKTGLSGENLDFINPTKVWVRKKGDEYVVFDAIFHRNIEGFLILELEPAITQENIPFLSFYHLARASINQLEKTANLRDFCQVIVQEVRKITEFDRVMLYKFDDDGHGSVIAEEKLESLEPYLGLHYPESDIPKPARKLFAANSIRIIPDAYSQPVKLFPVNNPISDRPINLTNSILRSAASCHTEYLHNMGVGASLTISLIKDQKLWGLIACHHQSPKYVSYELRKACEFLGRVIFAEISAREETEDYYHRINLTHLQSILIEYMSQEENFIDGLVKNPQHLLDLASAQGAAVCFAGNCTVVGETPREEDLNFLVQWLKNNVEEEVFYTDSLPQIYPDAESFKNVASGLLAIPIAKRTYVLWFRPEVIQTVNWGGDPNKAFEVSQSEGNVRLCPRKSFELWKETVRLTSLPWKDVEVKAALELRKAIVNIVLRQADELAQLAQDLERSNAELKKFAYVASHDLQEPLNQVVNYVQLLEMRYSEELDEDAQEFISYAVQGVSLMQTLIDDVLAYSKVDMQAIAFQMNDVETALMRGLGNLRQRINETGATITHDPLPTVMADSTQLMQLFQNLIGNAIKFHSDQPPQIHVGAERIEDAWLFSVRDNGIGIDPKFSDRIFVIFQRLHTRDEYTGTGMGLAICKKIVECHRGRIWVESELGQGATFYFTIPVGGRELERRNGRKTQNHLFGRGQ

SEQ ID NO: 1063 - protein, 483 aa, Propionibacterium acnes
MPIDPSKPSTNTNGSPAPSDEYSLTVGADGPVVLHDAHLIDTLAHFNRENIPERKPHAKGSGAFGHLEVTADVSEYTKASFLQKGRETPMLARFSTVAGELGSPDTWRDVRGFSLKFYTDEGNFDMVGNNTPVFFMRDPMKFPHFIRSQKRLPNSGLRSPNMMYDYWSLSPESAHQVAYLMGPRGIPLSYRTMNGYSSHTYSWVNAEGKITWVKYHFISDQGVHNMTADRAKAIVGDHPDIHREDLFNHIADGDYPSWTVKVQLMPYDEAKDYRFNPFDITKVWPHKDYPLHTIGKFTLDRNPENFFAQIEQAAFSPSNTVEGTGLSPDRMLLGRVFAYNDAARNRLGVNYEQLPVNRPTTPTNQYTFDGQMAFEHSGSAPTYAPNSYGRDFATGYRTGSEATWEADGELVRSAQTRHAEDDDFGQAHALVHDVFSDAERDELVDTLVDLMTNFDMEEPVIGNALSYWRNIDAGIAEATEGRI

SEQ ID NO: 1064 - protein, 304 aa, Brucella melitensis
MCWHKFARYWDVEIREIPMEPGRLFMGPEQMLEAVDENTIGVVPTFGVTYTGNYEFPEPLQDALDKLQKTKGLDIDIHVDAASGGFLAPFCAPDIPWDFRLPRVKSISASGHKYGLAPLGCGWVVWRDKEALPEELIFNVDYLGGQVGTFAINFSRPAGQVISQYYEFMRLGREGYTKVQQAAYRVAQYIAREIEPLGPYEFICAGEEKGGIPAVCFRIREGEDPGYSLYDLSERLRLTGWQVPAFALSGKASDITVMRVMCRRGFEMDLAALFIRDFKAGIEFFKSHPSPKITPSMGTGFHHT

SEQ ID NO: 1065 - protein, 157 aa, Brassica rapa
SNADKLLTEFIEKQLIDYAKNSKKVVGNSTSLLSPYLHFGEISVRRVFQCARMKQIIWARDKNGQGEESAVLFLRGIGLRDYSRYICFNFPFTHEQSLLSHLRFFPWDADVEKFKAWRQGRTGYPLVDAGMRELWATGWMHNRIRVIVSSFAVKFLL

SEQ ID NO: 1066 - protein, 167 aa, Brucella melitensis
MKITLEVIMTGSNYPARDLIASVFGTEALQEIAASRGFREKEMQANAVYQIIHDELFLDGNARQNLATFCQTWDDDYVHKLMDLSINKNWIDKEEYPQSAAIDLRCVNMVADLWNAPKFADNATGTNTIGSSEACMLGGMAMKWRWRKKMQEMGKPTDKPNFVCGPV

SEQ ID NO: 1067 - protein, 378 aa, Burkholderia fungorum
MQDGRTTLSKFLIDTLDRQPCSTETARNAGLSALLIDVAAAIKSISAMLTKGALGGNYGSAQSINTHGEEQKKLDVATNEIFVQQCEWDGLLAAMVSEEMESVYAIPPGYPRGDYLLAFDPLDGSSNIDINGVVGSIFSVLRNGEGNGNANEKNGSDPRGTVGESAFLRPGCEQVAAGYAVYGPSTMLVLSVGNGTHGFTLEREIGNFVLTHSNIRIPEDTVEFAINASNERFWEPPVRRYVQECKDGRSGCRASDFNMRWIASMVAEVHRILMRGGVFMYPRDSKTPAMEGRLRLLYEANPMSFLVEQAGGLSITGRERILDVVPRALHGRVPVILGSKHEVERIGRYHGEYDRGEDQPFTSPLFSRRSLFLPGFTA

SEQ ID NO: 1068 - protein, 263 aa, Unknown
  Azoarcus sp. EbN1
MNDQHSKIGSIEIIPLPAFRDNYLWLLRCGQLAAVVDPGDAAVVEDGLAAQGLDLCAILLTHHHADHVGGVTELIASRDIPVFGPAAADIQGVNNPVAEGDEVSLDRLGIRFRVLEVPGHTASHIAYLAPGLLFPGDTLFSAGCGRLLGGTAAQLHASLRRLADLPGDTAVYCTHEYTLANLAFARVADPGNPERDEWLVECEARRDAGRPTLPTTIARERRVNPFLRTGEPAVMGVIADRTGVRPRDSLECFAALRAWKDVF

SEQ ID NO: 1069 - protein, 339 aa, Glycine max
MDERYETLKELGSGNFGVARLAKDKETGELVAIKYIERGKKIDANVQREIVNHRSLRHPNIIRFKEVFLTPTHLAIVLEYAAGGELFERICNAGRLSEDEARFFFQQLISGVSYCHSMQICHRDLKLENTLLDGNPAPRLKICDFGFSKSALLHSQPKSTVGTPAYIAPEVLSRKEYDGKVADVWSCGVTLYVMLVGAYPFEDPEDPKNFRKSIGRIMSVQYAIPDYVRVSKECRHLISRIFVANPAKRINISEIKQHLWFRKNLPREIIEAERRGYEETQKDQPSQSVEEIMQIIQEARTKIHTGEQAGTGTSDVVRGDEANEEVDINDHFAKYLTLD

SEQ ID NO: 1070 - protein, 559 aa, Glycine max
  misc_feature (227)..(227): Xaa can be any naturally occurring amino acid
  misc_feature (528)..(528): Xaa can be any naturally occurring amino acid
IGAKNSSADTNAVIPCWCPVELLHTPITDERRIECGEIVTGDDDGHTGILFLVIHTRKLHIGGVISNVHEGGIHHLVVDSVLGGSTKTTSSCIKIVDEESTHLSLLDQVCGFTVSLPDQFCWLSCISTFQLSSTHHDGVDSHLGKDKLTLERFSLSLASPDTKNERNLDVGQGHEVLGNVNNMDGFYIAPAFMDKLVVHITKNFMTLPNIKACHYKHINSLHKLNSXTFAKLGDTFIFFSSIFYQVPLILGIWGGKGQGKSFQCELVFAKMGINPIMMSAGELESGNAGEPAKLIRQRYREAADMIKKGKMCALFINDLDAGAGRLGGTTQYTVNNQMVNATLMNIADNPTNVQLPGMYNKEENPRVPIIVTGNDFSTLYAPLIRDGRMEKFYWAPTREDRIGVCTGIFRTDGIPEQDIVKLVDTFPGQSIDFFGALRARVYDDEVRKWISGVGVDSVGKKLVNSKDGPPTFEQPKMTLEKLLLYGNMLVQEQENVKRVQLADKYLNEAALGNANEDAIQRGTFFQSXLEAKQTWQVNISVREGCCTNPSARSCDGTCV

SEQ ID NO: 1071 - protein, 638 aa, Lactobacillus acidophilus
MVTIVEVKQHIKKFAAGNELYLQEVLGCHYENDIYTFRVWAPNAQKVWLVGDFNDWDKSLEMSQTLDGVWEIKTSLPKEGQLYKFLVKQADGREVMKIDPMAFELEPRPGSAAVIVKLPNKKWLDGAWMGRNKRSNHFARPINIYEVHASSWKRHTDGSLYTLKDLQKELIPYVKEQGFNYIEFLPLTAHPLDASWGYQTIGYYALERTYGTPRELQDFVEACHKENIGVLADWVPGHFCINDDALAYYDGTPCYEFSEKWRAENKGWGALNFDLGKPEVQSFLLSSALFWLEFYHLDGLRVDAVSNMIYRDYDRSDGEWKTDKFGGNRNLEGIEFLQKLNRTIKGKHPECLMIAEESSAQVKITGRIEDGGLGFDFKWNMGWMNDILRFYEMDPLFRKFNFNLATFSFMYRMSENFILPLSHDEVVHGKRSLMNKMFGDRDKQFAQLRNLLTLQMTYPGKKLLFMGSEFGQYLEWRYNDGLDWAELKDELNAKMKHFDQDLNSFYLNEPALWQLEQREDSVQIIDADNKDESVLSFIRQGKTRHDFLIVILNFTPVDRKKITIGVPYAGKYCEVFNSARKEYGGSWNQEKQNLKTQNNSFKNFNYQVQLDIPGFSAVILKPVDVHIKRRINRKTKTK

SEQ ID NO: 1072 - protein, 156 aa, Triticum aestivum
  misc_feature (68)..(68): Xaa can be any naturally occurring amino acid
MSLIRRGDVFDPFSLDLWDPFDGFPFGSGSGSIFPRTTSSDTAAFAGARIDWKEMPEAHVFKADVPGXLKKEEVKVEVDDGNVLQISGERNKEQEQKTGTWHRVERSSGKFLRRFRLPDNVKSEEIKAAMENGVLTVTVPKAEAKKPDVKPVQITG

SEQ ID NO: 1073 - protein, 485 aa, Arabidopsis thaliana
MSGVVRSSPGSSQPPPPPPHHPPSSPVPVTSTPVIPPIRRHLAFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQLQAEIENLALEEQALGNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 1074 - protein, 536 aa, Xylella fastidiosa
MKQNMRIKTGIKKALILMLSVVLVSLVAIAAIAAHRFYIRLPQSRLFYAWKKMDEVYYDRTFAGFDWPAVLATYKKQLPRFDSDGQKTSPIINDMLSLLEVSHLQHFPAFMVSEEKKKTAVLANYFPELRDISGMVMVMDMLPRISRVLSLETWSPLYTHGVRVGDRILLETLDTDISDKNKPVRLYCYHINTAGVKKEFEFDLPAPPLGTQQTAVPAGDHVLHITRFDQGEIQALKHVSEDRNSSITQLHYISLGAVTTALHLPKNKVIDVVKDSEADKAGVEIGSIIGNGTNIKAGPENIGGKKVIKTNSRYEVVLPDGRKVTFSINKIIPKLNDFEGIRSAQLIGQTLVIAFNEMSDENTQWALQQIKNTPATAIVLDLRSNTGGSGIAGEKLLAGFLPSGTRIATEIRGKKTNVINVPSGYTPTDKPMAVLISLLSSSGAELAARTLQFHHRARIYGAQSSGQLLASRFYKLTDGTYMQIADTNLLDPAGKPLEWYGVMPDVKKWKALSDVRAGRDPVLECALTDLSGGQCH

SEQ ID NO: 1075 - protein, 510 aa, Pseudomonas syringae
MPLLNWSRHMVCLTAAGLITVPTVYAADTLTRDNGAVVGDNQNSQTAGAQGPVLLQDVQLLQKLQRFDRERIPERVVHARGTGVKGEFTASADISDLSKATVFKSGEKTPVFVRFSSVVHGNHSPETLRDPHGFATKFYTADGNWDLVGNNFPTFFIRDAIKFPDMVHAFKPDPRTNLDNDSRRFDFFSHVPEATRTLTLLYSNEGTPAGYRFMDGNGVHAYKLVNAKGEVHYVKFHWKSLQGLKNLDPKEVAQVQSKDYSHLTNDLVGAIKKGDFPKWDLYVQVLKPEELAKFDFDPLDATKIWPDVPEKKIGQMVLNKNVDNFFQETEQVAMAPANLVPGIEPSEDRLLQGRVFSYADTQMYRLGANGLSLPVNQPKVAVNNGNQDGALNTGHTTSGVNYEPSRLEPRPADDKARYSQLPLSGTTQQAKITREQNFKQAGDLYRSYSAKEKTDLVQSFGESLADTDTESKNIMLSYLYKADPDYGTRVAEVAKGDLSKVKSLAASLKD

SEQ ID NO: 1076 - protein, 442 aa, Magnaporthe grisea
MSAEKKTLSKPAAGVPYYTPAQEPPAGTPLQQQDAIPTLFKPLKIRGVELSNRFGVSPMCTYSADDGHLTDFHLVHLGQFALHGTALTIVEATSVTPNGRISPEDSGLWQDSQIAPLRRIVDYVHSQGQKIAIQLAHAGRKASTKAPWHDSFTPSGEYKPREGLQVVGPEYGGWPDDVWAPSAIPFSEDFPNPKEMTVEEIEGLVTSFVDAAKRAIEAGVDIIEIHGAHGYLITEFLSPLSNKRTDKYGGSFENRTRVLIDIIKAVRAVIPEEMPLFVRISATEWMEYAGEPSWDLEQSTQLAKLLPDLGVDLLDVSSGGNSVAQKIELTPYYQIDLAAKIREAVGDRLLIGAVGNINTADIARDVVDEQGAEKVAEAKQTHDTIEVVSESHGGKTKADLVLIARQFLREPEFVLRTAHNLGVNVQWPHQYHRAVWRKGARI

SEQ ID NO: 1077 - protein, 140 aa, Arabidopsis thaliana
  misc_feature (11)..(11): Xaa can be any naturally occurring amino acid
  misc_feature (18)..(18): Xaa can be any naturally occurring amino acid
  misc_feature (50)..(50): Xaa can be any naturally occurring amino acid
  misc_feature (66)..(66): Xaa can be any naturally occurring amino acid
  misc_feature (85)..(85): Xaa can be any naturally occurring amino acid
  misc_feature (122)..(122): Xaa can be any naturally occurring amino acid
  misc_feature (126)..(126): Xaa can be any naturally occurring amino acid
  misc_feature (131)..(131): Xaa can be any naturally occurring amino acid
PTHAFVLLDTXTITQFCXLPINDGDWEKLPFYRVLHTTYILYPMALAVAXYSMGGFPFILRVMVLXLVWVYHLTWIVNSTCYVWXNQVWYTGDLFNNNWGVAALAFWEGWPNNHHAFEFLSXHGLXWWQLXDMTWFVFKS

SEQ ID NO: 1078 - protein, 680 aa, Shigella flexneri
MFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNAQWDSKVKFDELSLKLTGKTDKEIRETLTRRYKFAIRRLAQTNSEDVFSLAMTAFAREIDPHTNYLSRRNTEQFNTEMSLSLEGIGAVLQMDDDYTVINSMVAGGPAAKSKAISVGAKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLSKDYQEPDPYLDETVNIALDLAKLEKARPAEQPAPVK

SEQ ID NO: 1079 - protein, 434 aa, Aspergillus niger
MLPKDLQWGFAKAAYQIEGAVDQDGRGPSIWDTFCAQPGKIADGSSGVTACDSYNRTAEDIALLKSLGAKSYRFSISSRIPEGGRGDAVNQAGIDHYVKFVDDLLDAGITPFITLFHWDLLHQRYGGLLNRTEFPLDFENYARVMFRALPKVRNWNEPLCSAIPGYGSGSFAPGRQSTSEPWTVGHNILVAHGRAVKAYRDDFKPASGDGQIGIVLNGDFTYPWDAADPADKERLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWTSKRYGSPPIYVTENGTSIKGESDLPNEKILEDDFRVKYYNEYIRAMVTAVELDGVNVRFGVTYVDYENGQKRFPKKSAKSLKPLFDELIAAA

SEQ ID NO: 1080 - protein, 645 aa, Bacillus cereus
MNVINCEEVKRDEFHTEKYYESYNIFGAHIVTEDEMRGVRFTVWAPHAKAMSVVGDFNEWDYEQHKMLQVTEEGIWSLFIPHIEEKEIYKYAIETMAGDVIFKADPYAVYAEVRPNTASVVFDIKGYEWNDKNWSRKKKKKSVYKEAMTVYELHFGSWKKKEDGTLYSYREMAEELIPYVVEHQFTHIEIMPLVEHPYDRSWGYQGTGYYAATSRFGTPHDLMHFVDECHKYGIGVILDWVPGHFCKDAHGLYLFDGTPTYEYKDKDVQENPVWGTVNFDLGKREVRNFLISNALFWMRYFHIDGFRVDAVANMLYWNKEGQEQSNEHAVSFLRELNEAVFAEDEDFLMTAEDSTAWPLVTAPTYEGGLGFNYKWNMGWMNDVLKYMECAPEYRKYIHEKMTFSLLYAYSENFILPLSHDEVVHGKKSLLNKMPGDYWDKFAQLRLLYGYFFTHPGKKLLFMGGEFGQFDEWKDLEDLDWNLHDFEMHRYMHDYFKELIALYKRSKPLWQLDHSPEGFQWIDANNNEQSIFSFIRQGDKQEDALVVVCNFTKATYENYKVGVPDFEYYNEVLNSDAEQYGGSGQVNKKRLKAIQEPFHNQAAHVEITIPPFGVSILRPVKTRKGSKKQDGSKTKVRSNVTSRGKR

SEQ ID NO: 1081 - protein, 414 aa, Arabidopsis thaliana
SESRSPRVRVDSVFHTLASGDVLLIIRGKGMVDSVFQAPMGTGTHHAVLSSYEYVSQGLRQYNLDNMMDGFYIAPAFMDKLVVHITKNFLTLPNIKVPLILGIWGGKGQGKSFQCELVMAKMGINPIMMSAGELESGNAGEPAKLIRQRYREAADLIKKGKMCCLFINDLDAGAGRMGGTTQYTVHNQMVNATLMNIADNPTNVQLPGMYNKEENARVPIICTGNDFSTLYAPLIRDGRMEKFYWAPTREDRIGVCKGIFRTDKIKDEDIVTLVDQFPGQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKGAQQVNLPVPERCTDPVAENFDPTARSDDGTCVYNF

SEQ ID NO: 1082 - protein, 354 aa, Pseudomonas fluorescens
MQMGALQLTNRIVMAPVTRSRMAEDGVPNELHATYYAQRASAGLIIAEATNISAQGRGYAMTPGIWSDAQGAGWKKVTDAVHAAGGRIVSQLWHVGRFSSVELQPDRAAPVAPSAIKAEGSTYTENGFVEVSMPRALETSEIPGIIEQYKRAAENARRAGFDGVEVHSANSYLLDQFLRDSTNQRTDRYGGTIENRARLTLEVTEAVISIWGSDRVGIRLSPVTPDAGNTPPDSNVMATYGYLIQQLNRLNLAYLHFVEGATATSRTVPDGVDLDALSAQFEGPFIGNNNYDLEMALERRAQGRIDAVAFGRLFISNPDLVERLRRGTELTIAPRESYYGGGAKGYTDWPTADH

SEQ ID NO: 1083 - protein, 484 aa, Glycine max
MGLMAANQTQLLSKMAIGDGHGEASPYFDGWKAYDENPFHPKENPNGVIQMGLAENQLTSDLVEDWILNNPEASICTPEGINDFRAIANFQDYHGLPEFRNAVAKFMGRTRGNRVTFDPDRIALGGGATGAHEVTTFCLADPGDAFLVPIPYYPGFDRDLRWRTGIKLVPVMCDSSNNFKLTKQALEDAYEKAKEDNIRVKGMLITNPSNPLGTVMDRNTLRTVVSFINEKRIHLVSDEIYSATVFSRPSFISIAEILEEDTDIECDRNLVHIVYSLSKDMGFPGFRVGIIYSYNDAVVNCARKMSSFGLVSTQTQHLLASMLNDDEFVERFLEESAKRLAQRHRVFTSGLAKVGIKCLQSNAGLFVWMDLRQLLKKPTLDSEMELWRVIIHEVKINVSPGSSFHCTEPGWFRVCYANMDDMAVQIALQRIRTFVLQNKEVMVPNKKHCWHSNLRLSLKTRRFDDIMMSPHSPIPQSPLVKATI

SEQ ID NO: 1084 - protein, 249 aa, Unknown
  Chrysanthemum x morifolium
MGRGRVELKRIENKINRQVTFAKRRNGLLKKAYELSVLCDAEVALIIFSNRGKLYEFCSSSSMLKTLERYQKCNYGAPETNVSAREALELSSQQEYLKLKARYEALQRSQRNLLGEDLGPLNCKELESLERQLDTSLKQIRSARTQFMLDTLTDLQKKEHALNDANRTLKQRLMEGHQVTSLHWNPHVQQEMGYDQQHEPQHQNGEAFFHPLDCGPTLQMGYPSDSLTAEAAASVAGPSCSNYMPGWYQ

SEQ ID NO: 1085 - protein, 1028 aa, Methanosarcina acetivorans
MNVSRKILVIIYIIFALLTSVVIFASQNILDSSFSGLEEKEAIENVESVHNVIDFQIIQLDETSSALVSREDVRAFMVSENPKDLGGTLLTDLFTLSGCDFVFFVNSSGTMIYSQVSDSKNASDASSDLIITEIDQKINEGDLLCRERLSPLSGILLLENGPVIVSCRPVSAALDNSKMIGTIVLGKKLDSDFVDSIQKITGNPVLLYGPDNAPPEFEHVFSENGSENFTQLVDVEGDRLAGYFIHRDINGNPTIMVRTTADRNIYEEGRKSLRYIVLFLLFSGLMVGAGCKFLLDREVVSRLVAIDSFVDRVGKDEDFSAHCIMEGDDELSRLTEGINRMLDRLRLNSDKVKAQEHEKKVILNSLSELVIFMDLELKIVWANRASLDYAGLKLENIVGHSYEKLSPISDAVSGRALAQKALESGNEETGEVVTPDGKIWTIRMNLIKDEDGKVTGFLQTGLDITAHRRSEEKLLQAKLEAEAASCTKSEFLANMSHELRTPLNSIIGFSDILIERVFGELNEKQLKYVNNISGSGKHLLGLINDILDLSKVEAGKMDLHYSEFTVDSVFEEVKSTLFPLAQAKSLEINFVVGPDFGDIQADRSRLIQILYNLVSNAIKFTPEGGRVSVYCKKSGSRALFSVTDTGIGISSEDQKKLFQPFTQIDSSSARQYCGTGLGLALVKKIVNLHKGDIWVESELEKGSTFMFTIPLTKPPESPKADTKGIEDVMLEFEMSKAAAFSAKECEEALKEELELPEILLPENREAQSLVLVVDDDINSNELISVVLREAGYSTASLHNGKDVLEVAKKLKPDVITLDVLLPDTSGWNVLKQLKSDLDTTSIPVLIISVTDNNELGVALGATYSFTKPVRRVELLDSLREITGKFSFDEPKVLIIDDDENAVELLSSMIESEGFEIVKAYSGQAGLDKLFSEQQPDILILDLLMPEISGFEIISRLRDGEQTKDIPLIVCTAGEFTEKNIEKLNGELKGHLISIMKKGTFGRKELINRIKQLAMLKRREDERNSYCRR

SEQ ID NO: 1086 - protein, 246 aa, Unknown
  Chrysanthemum x morifolium
MGKGRLELKRIENKINRQVTFAKRRNGLLKKAYELSVLCDAEVALIIFSTRGKLYEFSSTSSMLKTLERYEKSSFGPPEQRRPAKEDLQEQSSYQEYMRLKERYDALKQLERNYYGEEIDNLSTNELESLERQLHCSLKQIRTIRTQSLVDRLYEQQKMEHHLYESNKTLRLKFEEESQAEALQWEAHARANGMVYGHPQHQLSQTTHDAFYHPTGCETTLQIGYQTDMSAVTSTSMNHQMQGWPA

SEQ ID NO: 1087 - protein, 465 aa, Oceanobacillus iheyensis
MTEQNYQFPAGFWWGSATSATQIEGAANQYGKGQNIWDHWYNIQPERFYNQVGPEHTSDFYHRYKEDIALMKEFGHNSFRLSISWSRLIPDGVGEVNEEAVSFYHNVIDELIANDIEPFVNLFHFDMPLPLQEIGGWENREVIEMYRQYAKKAFELFGDKVKKWFTFNEPIVPVEGGYLYNFHYPNVVDAKRAIQVAYHTIIAHATAVQTFKELNIENGKIGIILNLTPSYPRSENTADQKAAHIADLFFNRSFLDPAVLGEYPEDLINLLKEHNHLPQTEDGDAGLIKENTIDILGVNYYQPRRVKAKDNLPNPYSPFMPDWFFDSYEMPGRRMNEYRGWEIYEKGVYDIMINLKENYHNIESFISENGMGVQGEEHFIENGQIQDDYRITFIKDHLKWLHRAIDEGCNAKGYHLWTTMDNWSWSNAYKNRYGFFSVNIDTMERTPKKSAYWFKQISEQNGFHA

SEQ ID NO: 1088 - protein, 265 aa, Unknown
  Chrysanthemum x morifolium
MANSDAFELDFSCIDRSMSFPDESADMSPQRKLGKGKIEIKRIENTTNRQVTFCKRRNGLLKKAYELSVLCDAEVALIVFSSRGRLYEYANNSVRGTIDRYKKACLDPPSSGSVSEANAQYYQEESGKLRSQIANLQNQNRQFYRNIMGESLTDMPMKDLKNLETKLEKAITRIRSKKNELLFAEIEYMQKRELELHNNNQFLRAKIAENERSAQQQHMSLMPGSSDYELVTPHQPFDGRNYLQSNEMQPSNDYSCQDQTPLQLV

SEQ ID NO: 1089 - protein, 806 aa, Oryza sativa
MALLVCFQDSKDMTVMPSLRHRAVAKKPKWIIILVSLDWLPSVTRRERTDEEIISSVVLRDILAMPMPVSKNPKIALMFLTPGTLPFEKLWEKFLQGQEGRYSIYVHASREKPVHTSSLFVGRDIHSDAVVWGKISMVDAEKRLLANALADVDNQFFVLLSDSFRDPGPHGNGRYSPEMLPEIEEKDFRKGAQMVDPGGIANWSVTHVDWSEGKWHPRSYRAADVTYDLLKNITAVDENFHVTSDDKITWTAHTTTQQGLPYRRRKDWLPNSLNKSMREGYWLGTGPRASHVAPLTSLHVAPLPTLPSTFPSLPPRLANQPPISKMLHFLSSSSPLNPQFLLLPRQSARLRVLLSIPVSAMSSSSSSSSRGALAAAAVPSLSADEAGAAADEAFLRYTSPSMRRSGGGGVAIVWFRNDLRVLDNEAVVRAWAASDAVLPVYCVDPRISAGSTHYFGFPKTGALRAQFLIECLEDLKRNLTKQGLDLLIRHGKPEDILPSIAKAVTAHTVYAHKETCSEELLVEHLVRKGLEQVVIPQGGASNQKKPRNPKLQLIWGATLYHVDDLPFSVNNLPDAVESKSSVRNCSKLPPSLGPPPGSGLDEIGEKGMHFVGGESAALGRVHEYFWKKDQLKVYKETRNGMLGPDYSTKFSPWLASGSLSPRYICEEVKRYEKQRIANDSTYWYPLIDANMKELLATGFMSNRGRQIVCSFLVRDMGIDWRMGAEWFETCLLDYDPASNYGVGNDPREDRYFSIPKQAKTYDPDGEYVAYWLPELRSIAKERRNFPGASYIKQNFSFRGVEDGVAK

SEQ ID NO: 1090 - protein, 550 aa, Dechloromonas aromatica
MAAKEVKFGDSARARMVEGINILADAVKVTLGPKGRNVVLERSFGGPTVTKDGVSVAKEIELKDKFANMGAQMVKEVASKTSDIAGDGTTTATVLAQSIVREGMKFVAAGMNPMDLKRGIDKAVVATIAELQAFSKPCTTTKEIAQVGSISANSDSDIGEIIANAMEKVGKEGVITVEDGKSLANELDVVEGMQFDRGYLSPYFINNGDKQQALLENPFVLLFDKKISNIRDLLPILEQVAKAGRPLLIIAEDVDGEALATLVVNNIRGILKTVAVKAPGFGDRRKAMLEDIAILTGGTVIAEETGLTLEKAVLKDLGQAKRIEVAKENTTIIDGAGEAAAIEARVKQIRIQIEEATSDYDKEKLQERVAKLAGGVAVIKVGAATEVEMKEKKARVEDALHATRAAVEEGIVAGGGVALIRARAAVGKLKGDNHDQDAGIKIVLRAMEQPLREIVANAGDEPSVVVDKVQRGKGNYGYNASTGEYGDMVEMGVLDPTKVTRTALQNAASVAGLMLTTECMVAELAEDKPAGGMPDMGGMGGMGGMGGMGM

SEQ ID NO: 1091 - protein, 451 aa, Oryza sativa
MVEQKGNILMKRYEIGKLLGQGSFAKVYHGRNIKNSQSVAIKVIDKEKILKCELMDQIRREISVMNLVRHPCIVQLYEVMATKTKIYFILEYVKGGELFNKVRRGRLKEEVARKYFQQLISAIDFCHSRGVYHRDLKPENLLLDENRNLKISDFGLSALAECKRQDGLLHTTCGTPAYVAPEVINRKGYDGAKADVWACGVILYVLLAGYLPFQDKNVINMYKKICKAEFKWPSWFSSDIRKLLRRILDPNPATRISVSEIMEDPWFRVGLNSDLLNKTIPTDKVDKVVHVDMDSTFGNLSNNINEGKQEAENLTSLNAFDIISLSSGFDLSAMFEDENSKEESKFTSTNTATTITKKLEDVAKNLRLKFLKKNGGLLKMEGSKPGRKGVMSINAEIFQITPDFHLVEFTKINGDTLEYQKVKQEMRPALKDIVWAWQGEQPQPQSLNEQS

SEQ ID NO: 1092 - protein, 1417 aa, Pseudomonas aeruginosa
MNVQQSKFRLSRWAGATLALGLLLSGLGAWGLALVNEQQARMALEREAELLAEAVIRRVELYQYGLRGVRGALLTAGEAHIDRELFRRYSLTRDIDREFPGARGFGFIRRVAAADEAGFLRQARADGQPEFRIQQLTPHDGERYVIQYIEPVARNGQALGLDIASEANRREAARAALETGQVRLTGPITLVQASGLRQQSFLILMPIYRSGITPPPGPQRELEGFGWSYAPLLTGEVLAGLPIDNAAIHLELSDVTGDGAAVPFFVNGAAAPAQRLFGHMLRREIYGRHWQMAFSALPLFVQRLHQPSPRILFLAGSLVSLLLAALVNASALGRQRRHREAATQARLAAIVGNSADGIIGVGLDGVISDWNRGAEALFGYREEQAVGRRVVDLLVPPSKENEELDILARIARKEQVVSFDTVRRHQDGHLLDVAVTVSPILGPDGGVVGASKTVRDISAKKAAEARIRELNTGLEHQIAERTAELRRLNVLLGSVLQAASEVSIITLDRDGIISGFNLGAERMLGYRADEVVGKASPTLLHSERELLARGQELGEEGFRVLVARAEQEGAETREWTYLRKDGSPLSVTLSVTVLRDEAGAINGYLGIAVDVTEWRNAEREMAAARDQLQMAADVARLGIWRWNLADDSLQWNERMCELYGQPLALRDGGLVYEHWRSRLHPEDLERTEASLRAAVEGRGNYDVIFRVVLPDGGIRFIQAGAQVERDADGNPLQVTGINIDITSDQQLQARLREAKEQADAASAAKSSFLANMSHEIRTPMNAVLGMLQLARQTDLNERQRDYLDKASSAATSLLGLLNDILDYSKIEAGKLVLEMLPFELEPLMQDLAVVLSGNQGDKDVEVIFDIDPELPSAVVGDRLRLQQILINLAGNALKFTARGHVLVSLRRLAHDAHLVRLRVLVADTGIGISAEQQQRIFEGFTQAEASTSRRFGGTGLGLFICKRLVDLMGGELRVESAPGSGSRFWFDLDLDVAHDQPLRAACPGAGEPLRLLVADDNLVAGELLERTVGALGWRADCVGSGSEAVARVQAAMAEGRRYDVVLMDWRMPDLDGLSAAQLIRQLQGDLPPPMVIMITAYGREVLADARDHSAPPFVDFLTKPVTPKQLADSVLHALHGEQGAPANPPPRPVERTQRLRGVRLLVVEDNALNRQVAAELLSSEGARVALADGGLAGVQQVLEASVPFDAVLMDMQMPDIDGLEATRRIRADGRFAGLPILAMTANASLADREACLAAGMNDHVAKPIDKERLVLCLLGHLGRSGDRGAPATTADAGELVEARGDIVGRFGGSLELIVQVLRRFVPDMQDLFAQLERQLGEGDVQGSAATLHTIKGSASTVGASALAGRASELEQALRRADPRRGMEILAGIRLDELRTLCDACLLRLQAMFGDVQAESAS

SEQ ID NO: 1093 - protein, 547 aa, Bordetella parapertussis
MAAKQVLFADEARVRIVRGVNVLANAVKTTLGPKGRNVVLERSFGAPTVTKDGVSVAKEIELKDKFENIGAQLVKDVASKTSDNAGDGTTTATVLAQAVVQEGLKYVAAGFNPIDLKRGIDKAVAAAVEELKKLSKPVTTSKEIAQVGSISANSDASIGQIIADAMDKVGKEGVITVEDGKSLENELDVVEGMQFDRGYLSPYFINSPEKQVAALDDPYVLIYDKKVSNIRDLLPVLEQVAKSSRPLLIIAEDVEGEALATLVVNNIRGILKTTAVKAPGFGDRRKAMLEDIAILTGGTVISEETGMSLEKATLQDLGQAKRIEVAKENTTIIDGAGDGKSIEARVKQIRAQIEEATSDYDREKLQERVAKLAGGVAVIRVGAATEVEMKEKKARVEDALHATRAAVEEGVVPGGGVALLRAKQAITGLKGDTADQNAGIKLILRAVEEPLRTIVTNAGDEASVVVNTVLNGKGNYGYNAATGEYGDLVEQGVLDPTKVTRTALQNAASVASLLLTAEAAVVELMEDKPAAAPAMPGGMGGMGGMDF

SEQ ID NO: 1094 - protein, 593 aa, Candida glabrata
MLHKHTDKQRLPVNIVDHHHIDPCLQDFKLLSKELQDIASNSEKLKALGSKENKESHLLSMKYVIPKEGVPADQAYDMIHNELTLDGNTHLNLASFVNTSTTHEVRKLISENLTKNLADNDEYPQLIELTQRCISMLSGLWNANPEEEPIGCATTGSSEAIMLGGLAMKKMWEKKMKAAGRTDTSKPNIIMSSACQVALEKFARYFDVECRLVPVSRKSHHMLDPNLLWDFVDENTIGCFVIMGTTYTGHLENVAEVGDVLTAIEKQHPEWANKDIPIHVDGASGGFIVPFAFSREQLKAYGVPNWGFDHPRVVSINTSGHKFGLTTPGLGWVLWRDESHLAPELRFRLKYLGGVEETFGLNFSRPGFQVVHQYYNFMNLGYDGYRDTFKRSLFVARVFAHQILRSPIFNDYFEVVSSIHESIDGDKVPDAANDYWENPEKYKPGVPLIAFKFSDKFQKEYPEVPQALLSHMLRTRGWIIPNYPLPHSTDGSDKCEVLRVVFRNEMSLDLAQLLLSDIQAVLRKLQGSYSGLKTISHESDSDKRRDYVYKMLLALASPDADIGEDEDEETKEKKASKKEEIKQRLKRNYRGTC

SEQ ID NO: 1095 - protein, 727 aa, Unknown
  Acinetobacter sp. ADP1
MKLQVIACAVAVATGGFFFSHAINEALAATDTVSVTQSIQPTKEQALVSRQLATLVDRQHYLNMRLDATTSNRILDMYLDSLDPDHSILLASEVAEYKKKYGPTFGAALKAGDLSGPFAIHAQYRARLKAFYEYVLGELKKPQNLKQSNVYVDTDREKAPYFKTVAEQQDYWRKMLVSQLINLTISKEEDLAKQKALKDNPALANGQDLASAEDLTPVQTLTKRYTRQLERINRVKSDDVLDKTLNAMMATYDPHSNYYPPIDAMELNRQTTLQLEGIGVSIRPERGNEDYTKIETIVEGGPASKSGQIKSGDRIIGVAQDGDKMVDVIGWPSSEIVGLIRGKRGTKVTIKLLGPGAQMSQARTVTLVRDVIQEDDAGVRSRTVEITRDGKKHVFGVIEIPSFYLNYRARRAGTEYRSVSEDTNNALKALSAKNVEGIIIDLRNNPGGSLEEVARMLGQVIKSGPVVQIRDGNGNVSVFEDNDGGAQTYAGPLAVLINLASASASEIYSAAIQDYERGVVIGSTTTGKGTAQVQLDSLAYGQATLTQRKFYRVTGGSTQNKGVIPDVKLVDIYDEEFGERKAKNALKWDTIPTAPFKREGSIQPYVTKLSQLSLQRVDKDPQFTYLETRKSIAQETKDQKRVVLDIDQRKAEILSLEKQTLDAENKRRLATGLKPYANWESYQASLDALSESRAKMKATQRPALPEEEAFVTEAGNVLLDYSKLQGH

SEQ ID NO: 1096 - protein, 509 aa, Zea mays
MDGSSKGSGHSEALRNYNLGRTLGIGTFGKVKIAEHKLTGHRVAIKIINCRQMRNMEMEEKAKREFKILKLFIHPHIIRLYEVIYTPTDIYVVMEYCKYGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVEPMKRITIREIREHQWFQIRLPRYLAVPPPDTTQQAKMIDEDTLRDVVNMGFNKNHVCESLCSRLQNEATVAYYLLLDNRFRATSGYLGADYQESMDRNLNQLASSESSSSGTRNYVPGSSDPHSSGLRPYYPVERKWALGLQSRAHPREIMVEVLKALQELNVRWKKNGHYNVKCRWCPGFPEVNDTLDASNSFLGDSTIMDNDDANGRLPTVIKFEFQLYKTKDDKYLLDMQRVTGPQLLFLDFCAAFLTKLRVL

SEQ ID NO: 1097 - protein, 354 aa, Triticum aestivum
  misc_feature (267)..(267): Xaa can be any naturally occurring amino acid
LATTAPPRTPRSHLLFSSIRFLSLSLSLSVLCAEYFSCFLVLQIAAHERLGGCACACKAAVRCHPALSSEGKASIRGVVGELLAAAGKDKGLVSLGVGDASAHACFRRGGEFAADAVACAARSGDFDCYAPSYGFPAARRAVADHLSLSAGTHHRIRESDVFMTVGGTGAITAITMVLGGSPGANILLPRPGFAPYEVACELVGAEPRFYDLLPRQGWEADLAGVRAMADGATAAIVVINPNNPCGVVYSTQHLLQIAETAKELGIXVIADEVYAHMVFGASKFVPMASYAHIAPVITIGAISKRFMLPGWVSVGLASCDPWDISALLPLRMLLNVTSRTSLHHFRQQVPDSFG

SEQ ID NO: 1098 - protein, 1362 aa, Ustilago maydis
MNPSYTERRASAHPTMSSSAHHASSTPSAASIDPTTSHAISSGIPITSPAALSYFAAHPRRQQVHFGNYLLLQTLGEGEFGKVKLGVHKEWGEEVAVKLIKRDKVANDAAPLHLDDSAQKDPAKMSKVEREIQVLKDVRHPNIVRLYEVIESDRYIGIVLEYASGGELFDHILAHKYLKEEHACRLFAQLISGVSYLHHKKIVHRDLKLENLLLDRNRNVIITDFGFANNFEHKRNDLMATSCGSPCYAAPELVVQDGLYAGSAVDVWSCGVILYAMLAGYLPFDDDPANPDGDNINLLYKYILATPLSFPEYITAQPRDLLSKMLVPDPTRRATLEQVMQHSWLRHYRELFKFSVDDLERAAMEQQTKKRQMYRQQMMYQQQLQEQQRRQQMERSQSVRHNVSHLPVGTAYTANTAVSAVSAANVAHRQTLPISATVPDRLYEPIGSASRGADHSVTPQRAPTASSHQPPVAPTASADAAIAPLPRASTHNNVAAAADAAAAVAAAPSPVDPVTALGNARGEPRTRLDDAVPTIAAAYETEPRQLAAQKVQRHTIQLEYGGDERPRKESAPGSRQASQTQRNASASSTSSKLAEIERTKTAADKPAANANAIVPPSVLQSTSVQVPATSVVVPESEKANISKAGAPDMMRSVSASAASRVSVPPPIMEQTQPSVSAHRSTQPTSSSRVRAPSSASRNNADSGSTGHATRIPTSASQRVVSTSSAASEPVGFPSSATERTIPSADADAAAGRISASRRASNGAEITEPSHRSPSATRHATADNAPVTSASASARHRKGMSTDKFFLSRLLGSNSANQPNGAGVAGDKVSANGSDAAGDKTKRDSMNRPAPERAPSSSSTGKNGRRKAMSLVVGHASGEASSAAADRNRALKAGMPHSATRATFGTQVSGKADDSVSSAQKQRKGSASLASQTTSTSRAAQSSTRPQPLQPSLQQQQQQQDKAFNDGSTIASSSTAGPSSNAAKKVMDWFRKKSLSRGTFNEQPPLGLFERSPTSSYMHGSASQTPSVIVTSAPNGTSRHAEAPSGGSSVPSSRSTSGTHSENSEATEMTQLTNLSDASHQEGDGLKSSASTVQQQATPKASLSAVSNVSDASAAGSLVSTRSQQQQRPQPRVATATSASTTPARFNEARLRYHLGAVDQSALTSRSPIEVLKEVQRVLYEMGIDVRTEKDEDFKLECVRRKRAKTLMSATHGFGMSIRSSVFPPTQADVERSSRMSHRDSLTPSASSPGGGSLRSFLKRSSLQPGATSPKMGSSTLPSSATVTSNLGGAVHDENQPPPLYGDASVDGGQEIRFSVEVTRIKNLTGLYSLDIRRMKGNLWAYKFVYQALLDRCQLGSSTAAVG

SEQ ID NO: 1099 - protein, 429 aa, Methylobacillus flagellatus
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLSRQCARAVGDPDRAGRYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEAKPRKRAQTTSQSASA

SEQ ID NO: 1100 - protein, 484 aa, Lactobacillus plantarum
MTEKLTTETGQPWANNEHSQTAGARGPVLMQDYNLLEKLAHFDRERIPERVVHAKGAGAKGFFELENDMGEYTKADLFNGVGKKTPVILRFSQVAGEKGYPDTVRDVRGFALKFYTQQGNYDLVGNNTPVFFVNDPLKFPDFIHSQKRDPKTNRRTQNMQWDFWAHSPESLHQVTYLMGDRGLPASYRTMNGYGSHTFKWVNQNGEQFWVKYHFISDQGVKNMTAQAAEKAMSQDLDYLQDDLYDAIQEKNYPSWTMYVQILPYEEGLNYKWDIFDVTKVISHKDYPLIKVGKLTLNENPTNNFTDIEEAAMSPANFVPGIEPSPDKLLQGRLFSYKDAQRYRLGANFEDLPVNKPVVPVHNYERDGYMKINNQGAEVNYEPNALHGPEEVPDAAFSPDSVRGETRAQPYRYQVDYTTQAGDLYRLMSEPEQERLINTIKDALGQVTLPGVKELEIKQFYEADKNYGTRVANALGMNIADIISD

SEQ ID NO: 1101 - protein, 164 aa, Zea mays
MDAVMFGLETPLMAALQHLLDVPDGDAGAGGDSDNKTGGGATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 1102 - protein, 772 aa, Ralstonia solanacearum
MKIVCLGGGPAGLYFGLLMKLQDPSNDVVVIERNRPYDTFGWGVVFSDATMGNLREADPVSGATIGDAFNRWDDVEVHFKGEAVRSGGHGFIGIGRKKLLNILQARCEEVGVQLVFEQYVEDDQAIARKYGADLVLASDGLNSLVRKRYAETFRPDIDTRKCRFVWLGTKKVFDAFNFIFVPTEHGWFQAHAYRFEDGTSTFIVETPEATWKAAGIDQMSQEEGIAYCEKLFAPYLDGHPLISNASHLRGSAIWIQFPRVICERWVHWNEIDGKHVPVVLMGDAAHTAHFSIGSGTKLALEDAIELARTLKNVDGPLEAALQHYEAVRSVEVLKIQNAARNSTEWFENVARYAGLAPEQFAYSLLTRSQRISHENLRLRDPKWLEDYERWLAQRAGVPAADGGRPCPPLLTPYTVRGITLKNRVVVSPTLLYSSQDGVPGAFHLVHLGSRALGGAGLLLTEMTAVAPEARMTPGCPGLWNDEQAAAWKRVTDFVHGHGDTRIGVQLGHAGRRGSTRVGWDTPDQPLAEGNWPLVSASALPYLPGRSQLPREASLDDLARIREQFVEATRRAAAAGFDWLELQAGHGFLLSSFISPLTNQRTDAYGGALENRLRFPLEVLAAVRAAWPAHLPISVRISCTDWAPGGTTVDEAVEIARRLHLGGADLVDVSSGEVTPDQKPVYGRLYQTPFADRIRNEARVPTIAVGAISDADQVNGIVASGRADLCALSRAHLADAAWVLRESARLGWHDVEWPPAYRFGKEPLERSFARGRA

SEQ ID NO: 1103 - protein, 166 aa, Zea mays
MDAVMFGLETPLMAALQHLLDVPDGDAGAGGDSDNKTGSGGSATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 1104 - protein, 606 aa, Unknown
  Delphinium 'MagicFountains dark blue'
MDSCACIDTQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVLKNSNLLAALINDVLELSRLEDGSLELDIRTFSLHGIFREVLNMIKPITAVKKLSLTLMLSPDLPVVAVGDEKRLVQIMLNVVGNAVKFTKEGYVSVIASVAKAESLRDWQAPEIFMVSSDSHFHLCVQVKDSGCGISPQEIPHLFTKFTQLRSGQNRSNDGAGLGLALCKRFLNLMEGHIWVNSDGTDKGCTVTIIVKLGICEGQPEPSNLQVVSRPRLS

SEQ ID NO: 1105 - protein, 477 aa, Pseudomonas fluorescens
MNKLTTAAGAPVVDNNNVQTAGPRGPMLLQDVWLLEKLAHFDREVIPERRMHAKGSGAFGTFTVTHDITRFTKARLFSSVGKTTDVFVRFSTVAGERGAADAERDIRGFAIKFYTEQGNWDLVGNNTPVFFLRDPLKFPDLNHAVKRDPRTNMRSARNNWDFWTLLPEALHQVTIVMSDRGLPRTYRHMHGFGSHTFSFISPANERFWVKFTWKTQQGIENLTDQQAATLIGDDRESAQRDLYNAIEEGHFPQWKLYVQVMPELDAETYPINPFDLTKVWPHADYPLIEVGVLELNRNPDNYFADVEQAAFNPANVVPGISFSPDKMLQARLFSYGDAQRYRVGVNHHQIPVNAPRCPVNSYHRDGQMRTDANAGSTIGYEPNSYGQWAEQPDFSEPPLALKGSAGHWNHREDDDYFSQPGALFRAMSTAQQQVLFENTARSIHGASAQTRQRHIDNCTRADPAYGAGVAQAIEALG

SEQ ID NO: 1106 - protein, 530 aa, Cryptococcus neoformans
MSSVCRISNCLSPRALSTAIRPKVTFRATPPSCRRRTFLSRRRTSFWAPSYPESKPLASTLQVPFTPPPPTDNGDDHLSEETRPEVIVAEPRDKKNRYLNSLMEKAGELSLKCSILDAEGNWGAEGQKYTKLELCREYDLDPRDLRKLDSLSPSLVPVILTRKTCILISMLHFRALIKPDSVIVFDSSHAHKDVTRRFKYHLERNIKAGLGIKVGGADEEKCDEIVLSYEHRALESILVVTANALEEEMAFSRHIVQQLLADLEDHIDRENLKKLLHYSKKIAAFQSRARYVKSAIDELLDSDEDLSAMYLTSRAQGRPRALHDHEQLELLLESFVKQVEEIVSEVDTTVVNMQSTQEIAELMLDSGRNALLALDIKISIATLGIGSGALLAGLFGMNLTTQLEETPYAFAVISSTAFLVTVLITAYGLRTLRRVRRVALSGRNPAVLSSVLGSASWDSSVAQFSQGFDPALVDMRTEMAKRAIWERLWWGSKRKEVEEGEKWRKAYTYASAKKEQEKRKWARLPGGQTR

SEQ ID NO: 1107 - protein, 729 aa, Triticum aestivum
MTGGTAEKLQSSEPTQGIVETITDGVTKGVKELVVGEKPRVVPKPGDGQKIYEIDPTLKDFRSHLDYRYREYKRIRAAIDQHEGGLEAFSRGYEKLGFTRSAEGITYREWAPGAHSAALVGDFNNWNPNADAMTRDDYGVWEIFLPNNADGSSAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYNFDGFRFDGVTSMMYTHHGLQMTFTGNYGEYFGFATDVDAVVYLMLVNDLIHGLYPDAVSIGEDVSGMPTFCIPVPDGGVGFDYRLHMAVADKWIELLKQSDESWKMGDIVHTLTNKRWLEKCVTYAESHDQALVGDKTIAFWLMDKDMYDFMALDRPSTPRIDRGIALHKMIRLVTMGLGGESYLNFMGNEFGHPEWIDFPRGPQTLPTGKVLPGNNNNYDKCRRRFDLGDAEFLRYRGMQEFDQAMQHLEEKYGFMTSEHQYVSRKHEEDKVIIFERGDLVFVFNFHWSNSFFDYRVGCSKPGKYKVALDSDDALFGGFSRLDHDVDYFTTEHPHDNRPRSFSVYTPSRTAVVYALTE

SEQ ID NO: 1108 - protein, 563 aa, Candida glabrata
MGRRKRSPSNNNHNQNFEVPKLGADANTINGEQSQSDETAEPVDPDDSSKLPPNISIRNSTTSTTSTTRTTRTTRTTATYYDKDADKAAKLDIDISVARAFAATPFPRTSGRPAQNSNSSFSSSSSSSSSSTPSFSSSSPLSYLSPSSSVTTANVQPSTGATPQYLKPSSAPCGVLSMSSLMRKHTSASYNVSQTTATGTTHYAKTVSKSRLSSSLATENPATRSTLLNTPPPHLLLKRYPSDNSSSDILDVDLVIEKLLKMGTQPNGTAPTTTKSKRDFPFRSWEIQLICSHAREIFLEEPSLLRLQAPIKVVGDVHGQFNDLLRILKLSGAPPDTNYLFLGDYVDRGKQSLETILLLLCYKLKYRNNFFMLRGNHESANVTKIYGFYDECKRRMGSKSWRFFVDVFNTLPIAATIQDRIFCVHGGVSPELKELNQINQIMRPTDIPDQGLLTDLLWSDPDPQIQDWSLNDRGVSYTFSKRNVYDICSRFKFDLIIRGHMVVEDGYEFFAKKKLVTVFSAPNYCGEFQNWGAVMSVTTGLMCSFELLKPHSLKNKKTRKTRR

SEQ ID NO: 1109 - protein, 702 aa, Xanthomonas campestris
MAKSPSKSAQVPALAPVSATVDGARGTGDELHQKAGGTHPQLTTNQGIPVGDNQNSLRATPRGPTLLEDFILREKITHFDHERIPERIVHARGSAAHGYFELTKSLSQYTTAKIFTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMVMWAMSDRTIPRSLRMIEGFGIHSFRFLNDKGESTFVKFHWRPKLGLQSTIWDEAVKIAGADQDFHRRDLFEAIQNGDFPEWELGVQLFTEAQAATFPFDHLDSTKVIPEELVPLQIVGRMVLDRWPDNFFAETEQVAYCPANIVPGIDFSNDPLLQGRLFSYLDTQLSRLGGPNFHQIPVNAPKCPFANNQRDGHMQMGVPKGRVAYEPSSLQADAPREALRGFPSHATPAEEGAKGRVRAESFADHYSQARLFFRSQTAPEQAHIASALVFELSKVETAHVREAIVGHLRHIDQELAQRVADGMGMTALPPAPPAAVAPIDMPLSPALQVIGKMKDTLKGRTVGILIHDGSDAAAIKAVRKAAEAAGATVKIVAPKLGGAKLSDGKQLAADGQLAGTPSVVFDAVAVLLSSEAAKLLTRESAALNFVSFAWAHLKAIAFDEGAQVLLKAGNVGKDAGVVPAADTKAFITAAKTRQWAREPKVRMLA

SEQ ID NO: 1110 - protein, 110 aa, Glycine max
  misc_feature (93)..(93): Xaa can be any naturally occurring amino acid
MPPKPLDYGSINENVKKSQYAVRGELYLRASELQKEGKKIIFTNVGNPHALGQKPLSFPRQVVALCQAPFLLDDPNVGLLFPADAIARAKHYXSLTSGGLRAYSDSRRLP

SEQ ID NO: 1111 - protein, 156 aa, Thermus thermophilus
MAMTLVRRDARPMELTPFRTWSPFTLVDEVNRLFEEAFSDLVRPAAAYVAPADLYETDEALILEMAVPGMTPEDLEVSLEGNKLTIRGQVKPVADERVRRYYLQEMAHGSFVRTFTLPVEVDASGVKAEFRNGILRLTLPKVAEARARRIPIEVVQ

SEQ ID NO: 1112 - protein, 207 aa, Thermus thermophilus
MRVFPVTLGPLQENAYLVETGEGPVLIDPGDEPEKLLALFQTTGLIPLAILLTHAHFDHVGAVAPLVEALDLPVYLHPLDLPLYEGADLAARAWGLAIPKPPLPVRPLEEGMRLFGFQVLHLPGHSPGHVAFYDPEGAQVFSGDLLFRGSVGRYDLPGADPKALFASLKRLLSLPPETRVHPGHGPGTTLGLEARTNPFLTGLEWEA

SEQ ID NO: 1113 - protein, 368 aa, Pseudotsuga menziesii
IQPFGCMVAVNDKTFEVIAYSENAPDMLQVSAHAVPSVEDQQILCIGSDARTLFTPSSTMALQKAAKFGDLNLLNPILVHSKSSGKPFYAILHRIDVALVMDFEPIKPSDVSTSAMGALQSYKLAAKAISRLQSIPSGNIGLLCDMIAQEVHELMGYDRVMAYKFHDDDHGEVISEIRRSDLEPYLGLHYPATDIPQASRFLFMRNRVRMICDCCAPPVIVIQDKRLPRDLSFCGSTLRAPHGCHAQYMANMGSIASLVMAVVVTEKEEDADSEGQIQQKGRRLWGLVVCHHTSPRYVPFPLRYACEFLMQVFGIHLNKEVELAIQMKEKRILRTQTLLCDMLLRDAPLGIVSQKPNIMDLVKSDGAA

SEQ ID NO: 1114 - protein, 544 aa, Ralstonia pickettii
MAAKDVIFGDAARAKMVEGVNILANAVKVTLGPKGRNVVLERSFGGPTVTKDGVSVAKEIELKDKLQNMGAQMVKEVASKTSDNAGDGTTTATVLAQSIVREGMKYVAAGMNPMDLKRGIDKAVTAAVEELKKVSKPTTTSKEIAQVGAISANSDTSIGERIAEAMDKVGKEGVITVEDGKSLADELEVVEGMQFDRGYLSPYFINNPEKQVVQLDSPFVLLFDKKVSNIRDLLPVLEQVAKAGRPLLIIAEDVEGEALATLVVNNIRGILKTAAVKAPGFGDRRNGMLEDIAILTGGTVIAEEIGLTLEKATLNDLGQAKRIEIGKENTIIIDGAGDAGAIEGRVKQIRAQIEEATSDYDREKLQERVAKLAGGVAVIKVGAATEVEMKEKKARVEDALHATRAAVEEGIVPGGGVALLRARAAISALTGENADQNAGIKIVLRAMEEPLRQIVLNAGEEASVVVAKVIEGKGNYGYNAASGEYGDLVEMGVLDPTKVTRTALQNAASVASLMLTTDCAVAESPKEESAPAMPGGMGGMEGMM

SEQ ID NO: 1115 - protein, 167 aa, Listeria monocytogenes
ARGAGAHGKFVTKKSMKKYTIAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREIRGSSVHAFKWINEEGKTVYVKLRWIPKAGI

SEQ ID NO: 1116 - protein, 449 aa, Zea mays
MSASVGRTRVGRYELGRTLGEGTFAKVKFARNVETGENVAIKILDKEKVLKHKMIAQIKREISTMKLIRHPNVIRMYEVMASKTKIYIVMELVTGGELFDKIASRGRLKEDDARKYFQQLINAVDYCHSRGVYHRDLKPENLLLDASGTLKVSDFGLSALSQQVREDGLLHTTCGTPNYVAPEVINNKGYDGAKADLWSCGVILFVLMAGYLPFEDSNLMSLYKKIFKADFSCPSWFSTSAKKLIKKILDPNANNRITIAELINNEWFKKGYQPPRFETADVNLDDVNSIFDESGEPAQLVVERREERPSVMNAFELISTSQGLNLGTLFEKQTGSVKRETRFASRLPANEILSKIEAAAGPMGFNVQKRNYKLKLQGENPGRKGQLAIATEVFEVTPSLYMVELRKSNGDTLEFHKFYHNISNGLKDVMWKPESGIVEGDEARQRRSP

SEQ ID NO: 1117 - protein, 518 aa, Zea mays
MAAITPPTQSEPSPQTGRPASSAAAAAKRGGGGAGAAGGPLMGKYELGRLLGHGTFAKVYHARHVDTGDNVAIKVLDKEKAVKSGLVPHIKREIAVLRRVRHPNIVHLFEVMATKTKIYFVMELVRGGELFSRVSKGRLREDTARRYFQQLVSAVGFCHARGVFHRDLKPENLLVDEQGNLKVSDFGLSAVAEQFRPDGLLHTFCGTAAYVAPEVLGRRGYDGAKADVWSCGVILFVLMAGYLPFHDKNIMAMYKKIYKGEFRCARWFSKDLTSLLMRILHTNPNTRITLPEIMESRWFKKGFKPVKFYIEDDQLHNVIDDEDGLLDMGPAGPVPPPLPPPPPPLPPPKVDGDESGSDSDSSISSCPASMLSDESQRPRGSLPRPASLNAFDIISFSRGFNLSGLFEEKGDEVRFISAEPMSDIITKLEDIAKLKSFKLRRKDWRICLEGTREGVKGPLTIGAEIFELTPPLVMVEVKKKAGDNEEYENFCDKELKPGMQHLVHHMVRAPSMLLTDAK

SEQ ID NO: 1118 - protein, 753 aa, Shigella flexneri
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGNRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKAMKAKGVHAKLLYSRMGEVTADDGTVLPIAATFAGAPSLTVDAVIVPCGNIADIADNGDANYYLMEAYKHLKPIALAGDARKFKATIKVADQGEEGIVEADSTDGSFMDELLTLMAEHRVWSRIPKIDKIPA

SEQ ID NO: 1119 - protein, 547 aa, Ralstonia pickettii
MAAKDVVFGDAARAKMVEGVNILANAVKVTLGPKGRNVVLERSFGGPTVTKDGVSVAKEIELKDKLQNMGAQMVKEVASKTSDNAGDGTTTATVLAQSIVREGMKYVAAGMNPMDLKRGIDKAVTAAVEELKKVSKPTTTSKEIAQVGAISANSDTSIGERIAEAMDKVGKEGVITVEDGKSLADELEVVEGMQFDRGYLSPYFINNPEKQVVQLDSPFVLLFDKKVSNIRDLLPVLEQVAKAGRPLLIIAEDVEGEALATLVVNNIRGILKTAAVKAPGFGDRRKAMLEDIAILTGGTVIAEEIGLTLEKAGLNDLGQAKRIEIGKENTIIIDGAGDAGAIEGRVKQIRAQIEEATSDYDREKLQERVAKLAGGVAVIKVGAATEVEMKEKKARVEDALHATRAAVEEGIVPGGGVALLRARAAISALTGENADQNAGIKIVLRAMEEPLRQIVLNAGEEASVVVAKVIEGKGNYGYNAASGEYGDLVEMGVLDPTKVTRTALQNAASVASLMLTTDCAVAESPKDESAPAMPGGMGGMGGMEGMM

SEQ ID NO: 1120 - protein, 471 aa, Unknown
  Parachlamydia sp. UWE25
MTNPSIVWFRQDFRLEDNPALNAATQKGGPVIPVFNWVFNPEKEWQLGGASQWWLYYSLISLKNDLSELGLSLIIRKEDPLKSLLEIAHETGADTVYWNRRYEPMLIQDDAKIKTELQKQGIKAHSFNGNLLFEPWTIANKQGKPFQVFTPFWNQCLKLNDPEVPLPVPHSLKKFVGQLQTESIDSLNLLPKIKWDKGLKEVWSPGAKSAKALLKKGLTGVIDQYLDIRDLPDHDGTSLLSPYLHFGEISPRMIWQAVKENSTSKGAEGYLRQIGWREFAHHLLYHFPETPQKPLRSQFNSFSWKNDKQNLKAWQKGQTGYPIIDAGMRQLWKIGWMHNRVRLIVGSFLVKDLMIHWIEGAKWFWDTLVDADLANNTMGWQWIAGCGADAAPYFRIFNPITQGEKFDPEGNYVKKWVPELINLPKEWLHQPWEAPEEILRQSGIELGINYPKPIVNHAKAREEALQAYSRL

SEQ ID NO: 1121 - protein, 485 aa, Oceanobacillus iheyensis
MTKGNNDEQNNSRNYSQGFGSQGLHGYPGNASDKSHANPAAFNWNIDLPAEIHSQTVGKRGPILKQDNIEHETLQTFIHEKITERPVHVKGWGAFGYFETLYSMSDYTTLSFLQIPGTQVPVFVRFSLAVSTKGTPDTSRNVRGFATKFYSEDGIFDLICNHIPVFSVRDTIRFPEAIKAFLPSPVNNLIDPTRYWNFVARAPESLLFTLLVYSNLGTVKSLRHLPGHSVNTYVWKNAEGKRYFIKYTWAPIAGEEYIRNEEAVKLAGENPDIAGQDLHDAIERGEPVEYGLYIQIMDPKDAASLPYDPLDDTKLWDQQQFPFKPVGVMKLNKNPDNYMEQVEKAAFSPTNLLEGVELSDDKMLQGRANIYSDSQRYRIGPDFRNVPVNNQSNWWPGDLVTSGDGRFVEGELQRSDIEKQDDFTQPGLFYESLSEEDKEDLITNMAEGLSVVSNDVFNTVHGYIQEASRDLANRLNKTVILKRKK

SEQ ID NO: 1122 - protein, 443 aa, Oryza sativa
MAEQRGNMLMKKYEMGKLLGQGTFAKVYHARNTETSESVAIKMIDKEKVLKGGLMDQIKREISVMKLVRHPNIVQLYEVMATKTKIYFVLEHVKGGELFNKVQRGRLKEDAARKYFQQLICAVDFCHSRGVYHRDLKPENLLLDENSNLKVSDFGLSALADCKRQDGLLHTTCGTPAYVAPEVINRRGYDGAKADIWSCGVILFVLLAGYLPFHDKNLMDMYKKIGKAEFKCPSWFNTDVRRLLLRILDPNPSTRISMDKIMENPWFRKGLDAKLLRYNLQPKDAIPVDMSTDFDSFNSAPTLEKKPSNLNAFDIISLSTGLDLSGMFEESDKKESKFTSTSTASTIISKIEDIAKGLRLKLTKKDGGLLKMEGSKPGRKGVMGIDAEIFEVTPNFHLVELKKTNGDTLEYRKVLNQEMRPALKDIVWAWQGEQPKQQQQPTC

SEQ ID NO: 1123 - protein, 485 aa, Glycine max
  misc_feature (39)..(39): Xaa can be any naturally occurring amino acid
MGNSFGCSASGERLVSAARDGDLVEAKMLLNCNPCLAKXVALLLENGADVNSRNYCGQTALMQACRYGHWEVAQTLLLFRCNVIRADYLSGRTALHFAAVHGHVRCIRLVVADFVPSAPYQAIHAGTAVDRGGGSNCSALSKFVNKTADGGITALHMAALNGYFDCVQLLLDLNANVNAVTYNYGTSMDLIGAGSTPLHYAACGGNLKCCQILVAHGASRLALNCNGWLPLDIARMWGRHWLEQLLAPSSDATMPTFSHSNYLSLPLMSVLNIAREYGLQSSTASSDEIDFCAVCLERPCSVAAEGCGHELCVRCALYLCSTNNVSSEMVGPPGSIPCPLCRHGVVSFVKLPGSQAKENKLHVSLGLCTPCMLHPRDLDKPSLSHTPEVGRNRVASVPSEILCPVTCSPFPSMAIPLCTCNDGPCPSFEPREVETQDGLPHHSQASTVDQDKIEGPRLDKTTCSSMFWGRRSCSREHQCNSEINA

SEQ ID NO: 1124 - protein, 356 aa, Oryza sativa
MDQIKREISVMKLVRHPNIVQLYEVMATKTKIYFVLEHVKGGELFNKVQRGRLKEDAARKYFQQLICAVDFCHSRGVYHRDLKPENLLLDENSNLKVSDFGLSALADCKRQDGLLHTTCGTPAYVAPEVINRRGYDGAKADIWSCGVILFVLLAGYLPFHDKNLMDMYKKIGKAEFKCPSWFNTDVRRLLLRILDPNPSTRISMDKIMENPWFRKGLDAKLLRYNLQPKDAIPVDMSTDFDSFNSAPTLEKKPSNLNAFDIISLSTGLDLSGMFEESDKKESKFTSTSTASTIISKIEDIAKGLRLKLTKKDGGLLKMEGSKPGRKGVMGIDAEIFEVTPNFHLVELKKHLNTVRS

SEQ ID NO: 1125 - protein, 231 aa, Zea mays
KINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLP

SEQ ID NO: 1126 - protein, 401 aa, Bacillus cereus
MNRSTKFTVKNRFYKAAMSETMATKNNNPTEELVTLYGRWAQGGAGLLMTGNVMIDREALGEPGNVVIEDERDLDILKRWAKSGTQNGTQLWMQINHPGKQSPKTLSKNPVAPSAIPLTGDIKDFFNKPRELTSGEIWQLIKRFGNAARIAKKAGFTGVQIHAAHGYLINQFLSPHHNQRQDEWGGDLDGRMKFLIETYYEIRKQVGEEFPIGLKLNSADFQRGGFTEEESMKVLKKMDDLGMDLIEISGGNYENPKMFDGVRESTKKREAYFLDYAQKARTLVQAVLIVTGGFRSEEGMNEAIESGAVDMVGVGKLFALNPDFPNQIIHGNYHTVTIKPIRTGLKRLDKKISSMLELTWYERQFKLMGKGKEPNPNYSVWKTVFQMISENGMNAFQKRRA

SEQ ID NO: 1127 - protein, 318 aa, Arabidopsis thaliana
MTLGCKQAIELAVDILAKPKANVLLPSPGFPWDLVRSIYKNLEVRHYNFLPEKNFEIDFDSVRALVDENTFAIFIINPHNPNGNTYSEAHLKQLAELAKELKIMVVSDEVFRWTLFGSNPFVPMGKFSSIVPVVTLGSISKGWKVPGWRTGWLTLHDLDGVFRNTKVLQAAQDFLQINNNPPTVIQAAIPDILEKTPQEFFDKRQSFLKDKVEFGYSKLKYIPSLTCYMKPEACTFLWTELDLSSFVDIEDDQDFCNKLAKEENLVVLPGIAFSQKNWLRHSIDMETPVLEDALERLKSFCDRHSNKKAPLKDVNGVK

SEQ ID NO: 1128 - protein, 417 aa, Zea mays
MGFTKRSPQHPASPAGGEVGAQTAGKVTPVPAAPESAPVAVVPRPPDVAPFLTKVYDMVSDPATDAVISWSAGGGSFVIWDSHAFERDLLPRHFKHNHFTSFIRQLNTYGFHKVDPDRWEWANEGFVKGQKHLLKTIKRKKKSSQDVPSDLQSVPVKTAPGTENIEIGKYGGLEKEVETLKRDKALLMQQLVDLRQYQQSSSAEVQNLIQRLRVMEQNQQQMMALLAIVVQNPDFLNQLVQQQRRSNWWNDDGNRKRRFQALEHGPVDDQETSGGGAQIIQYRPPVPETSNQPIPANEAFYSTPAQPASSPALEMPMDVEMTSNNVDTFDSTGNDFTDTSALCEWDDMDIFGDELEHILQQPEQDFQVDPPLTVEDYGYDHPRLEQDCQMEAQQNCKNPQYVACVLKQRESHASDVH

SEQ ID NO: 1129 - protein, 167 aa, Listeria monocytogenes
ARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREIRGSSVHAFKWINEEGKTVYVKLRWVPKAGI

SEQ ID NO: 1130 - protein, 364 aa, Cupriavidus necator
MPEVQRMTLTQFLIEERRRYPDASGGFNGLILNVAMACKEIARAVAFGALGGLHGKASTQAGEEGAVNVQGEIQQKLDVLSNTTFLRVNEWGGYLAGMASEEMEAPYQIPENYPRGKYLLVFDPLDGSSNIDVNVSVGSIFSVLRAPEGADTVTEQDFLQPGSAQVAAGYALYGPTTMLVLTVGNGVNGFTLDPNLGEFFLTHPHLRVPPDTQEFAINASNSRFWEAPVQRYIGECMAGKSGPRGKDFNMRWIASMVAEAHRILMRGGVFMYPRDTKDPAKPGRLRLLYEANPIAFLMEQAGGRASTGRQTLMSVAPGALHQRIGVIFGSRNEVERIEGYHTNQTDPDLPSPLFNERSLFRASA

SEQ ID NO: 1131 - protein, 379 aa, Neurospora crassa
MAATAAESRLFQPLKLTPKITLGHRLAMAPLTRFRSDDEHVPIVPLMTTYYSQRASVPGTLLVTEATFISPAAGGYDNVPGIYNAAQIAAWKKITDAVHAKGSFIFCQLWSLGRAANPEVLAKEGGLKLKSSSAVPMEEGAPVPEEMTVAEIKERVAEYAAAAKNAVEAGFDGVEIHGANGYLIDQFLQDTCNQRTDEYGGSIENRSRFAHEVVKAVVEAVGAEKTGIRLSPYSTFQGMKMKKDLIPQFEDVIRKINGFGLAYLHLTQSRVAGNMDVQPEEDEENLAFAAKLWDGPLLIAGGLTPETAKHLVDREFPEKDVVATFGRHFISTPDLPFRIKEGIELNPYDRDTFYKAKSPDGYIDQPFSKEFEKVYGAQA

SEQ ID NO: 1132 - protein, 379 aa, Catharanthus roseus
MAKQVDNGQEEQQQNPQNPLLTPYKLGKFQLSHRIVLAPLTRQRSYGNVPQPHAVLYYSQRTSKGGLLISEAAGVSNTAQGYPMTPGIWTKEQVEAWKPIVDAVHAKGGVFFCQIGHVGRVSNYSYQPNGQAPISSTDKGLTPLYRANGIGYVEHTPPRRLTTDELPGIVNDFRAALNAIEAGFDGVEIHGAHGYLIDQFLKDQVNDSTDEYGGSLENRCRFALEIVEAVSNAIGADRVGIRLSPFAGYMESGDSNPEALGLYMAEALNKYGILYCHMVNPRMKTLGENCEVPHSLLPMRKAFRGTFMAAGGYDREDGIKALAENRADLVVYGRLFLANPDLPKRFELNAPLNKYNRETFYIPDPVLGYTDYPFLEATE

SEQ ID NO: 1133 - protein, 167 aa, Listeria monocytogenes
ARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMITYLFSDEGTPASYREIRGSSVHAFKWINEAGKTVYVKLRWVPKAGI

SEQ ID NO: 1134 - protein, 138 aa, Brassica napus
  misc_feature (42)..(42): Xaa can be any naturally occurring amino acid
TTQAAVLMNGQNAKTNFPVIKSNGSVSPDVNSPLSALYNANXEKNCKAQPPYLTCLRLDNNSSHIGFWQKRAGSSSSQNWVKLVELGDGVNTSAGDTGTNKLKKGNADVEEEDQMSMQMFEELLNWTCPVFASISGFS

SEQ ID NO: 1135 - protein, 209 aa, Triticum aestivum
  misc_feature (92)..(92): Xaa can be any naturally occurring amino acid
MEVQARHGVLPTGRQQHLHGHGQSHHQPPAGEDEWWEYFPCPFCYIEVEVPFLCDHLQEEHCFDMRNAVCPICADNLGADTTGHFRERHSQXLKMRKSSSSRAGAAGSDKEAYEEDDSYFEESSYIMGQPVPDDHSPDPLLSQFICTVAPPVVDPEPSKAEEEDHAAPSSDDQRLNQVVMDDASKKDLEERLRRVEFVKQMLMTTIAWD

SEQ ID NO: 1136 - protein, 708 aa, Rhodopirellula baltica
MSFRQILPVALLAVGCIGSTLIQLPATAQERTVERAAPEQAAPPQPSPQDKVIAKLIAQLMPSNHVSGKDLNDEISRRALDLFLESFDPMKLYFLQSDVDEFNRYSEVVDDQVRLGDLSLAYYIYGRFTQRVDERVAVVMELLDGDFDFTRDEQIIIDRDATQFARDADEARDRWRRQIKLALLDLRNEKTDDSESDEPEMSKDEIMADAKDQLRRRYARYARRWKQTSSDDLLELFLSSVTNGYDPHSTYMSPATLEDFAISMRLNLDGIGASLGEKDGTTVVRQVIPGGAADSHGKLKPDDVIVAVGQDAEGPMVDIVEMPLKEVVKLIRGRAGSVVRLAVRPGGTGNEEIFKIVRARIELEDSAARGEVIDHEMPGQGKVKLGYINLPSFYMDMEAARRNETDYRSSTRDVERILRDFKSQNVGGVVLDLTRNGGGSLTEAISLTGLFIDRGPVVQVKNSDGSVQQYSDDQSGTVWDGPLVVVTSKLSASASEIFAGAIKDYHRGIVVGDPATHGKGTVQTLMDIGQSLFRNNNANYGALKVTLQQFYLPDGESTQLKGVEADLVLPSMTSKLPVAEGDLEYALEFDKVPLAKHSLYAMTPDSLLNSLRINSANRVQQDKEFSELMRRIELYVREKDQKSISLNEEEFLRRRAERKAQTEAEEEELDEVLNNDEIFRDTYYNKEVMNVAHEYVTGLRSQNLAVAK

SEQ ID NO: 1137 - protein, 471 aa, Chromobacterium violaceum
MSKRYRTALVWLRRDLRLDDHAAFYHALKHSEAVLPVFVFDASILAALPRDDRRVDFIWQSAAALKAELNQLGGDLLIRHGLPQHEIPRLAAELGAEAVFCNRDYEPAARARDAEVAQRLAEQGVAFRDSKDQVIFETDEVLTGAGKPFSVFTPYKNAWLKKLTPFHLQAYPVRRYLDALMPREPQSMPSLADIGFLPSDLASLPVKAGAAGAEALFADFAGRIERYKAQRDFPGVKGVSYLSVHLRFGTLSIRRLAAYAWHDGGEGAMTWLSELIWRDFYQQVLWHRPDAAKHAFKPEYDALPFPNDPEWFDAWREGRTGYPLVDAAMRQLNRSGYMHNRLRMVAASFLVKDLLIDWRWGEQYFAEKLLDFDLAANNGGWQWAASTGCDAQPYFRIFNPVSQSEKFDPDGRFIRRYVPELAALPDKLIHAPWQAKPEQLMSAGVRLGRDYPHPIVDHAVQRELALALFKR

SEQ ID NO: 1138 - protein, 622 aa, Streptococcus agalactiae
MSNKDELYTFGIGENFHLQNYLGVHSENGSFCFRVWAPNAENVQVIGDFTDWRNRPLQMNKNQAGVWEANSLDAREGDLYKYLVTRKGGQVVEKIDPMAVYMERRPGTASVIKVLRNKKWEDGLWMGRRKRLGFQKRPINIYEVHAGSWKKDDFGHPMTFSQLKDYLIPYLVEMNYTHVEFMPLMAHPLDMSWGYQLMGYFAFEHTYGTPEEFQDFVEACHKNNIGVLVDWVPGHFIQNDDALAYFDGTATYEYQNHDRAHNYRWGALNFDLGKNQVQSFLISSALFWIEHYHIDGIRVDAVSNMLYLDYDEGPWEANQFGDNRNLEGYHFLRKLNKVIKERHPNVMMIAEESTASTPITKDLESGGLGFDFKWNMGWMNDILRFYEEDPLYRQYDFNLVTFSFMYIFNENFVLAFSHDEVVHGKKSMMHKMWGDRYNQFAGLRNLYAYQMCHPGKKLLFMGSEFGQFLEWKYNDQLEWENLNDDMNQKMQRYTKQLNQFYKDHKCLWRIDDSFDGLEIIDADNKSETVLSFIRKDDKGDLLLCVFNMTPVERPNFTIGVPQAGIYEEVLNTEMEEFGGVWKNHNPVTKTQVATWKDYDHTLSFTLPALGASVWRIKRRLRK

SEQ ID NO: 1139 - protein, 613 aa, Clostridium thermocellum
MCGIAGWINLKSDLTNQKEILNSMIDRLTPRGPDASGSWISPNALIAHKRLIVVDPEGGIQPMVRRQGENTYVITYNGELYNTADLRNELESRGHEFLTSSDTEVLLVSYIEWGAKCVEHLNGIYAFGIWDEGKKRLFLGRDRFGVKPLFYAQRGDSLIFGSELKALLANPLVEPKLDAEGLAEIFALGPARTPGHGIFKDVYELKPAHSMIFDINGIQIRKYWSLESYPHTDSEKATISKVRDFVLDAITRQLVADVPVCTFLSGGLDSSAITAVASKTFASQGKGQLNTFSVDYVDNDIYFKPSMFQPNSDEPWIKKMSESFNTCHHYVKFDTPQLVDALIDAVKARDLPGMADIDSSLFLFCREVKKFSVVALSGECADEIFGGYPWFHNEKMLFADTFPWSVSVHERTKILSPEILNLIKPEEYIQRRYRETLSEVPHLKGENRIEARRREIFYLNINWFMATLLDRKDRMSMASGLEVRVPFCDHRLVQYVWNIPWELKMYNKREKGLLRQALKGILPDDIIERKKSPYPKTHNPSYKKAVSKWLLEILNDSSSPLHQLIDVKVVRSMAEGNSDNTDPWFGQLMAQPQMLAYLIQVDFWLRDNHISIV

SEQ ID NO: 1140 - protein, 126 aa, Beta vulgaris
KFYTREGNFDLVGNNFPVFFIRDGMKFPDMVHSLKPNPKSHIQENWRVMDFFSHHPESLHMFTFLFDDIGVPANYRHMEGSGVNTYTLINKAGKVHCVKFHWKPTCGVKSLLEDEAIKVGGANHSH

SEQ ID NO: 1141 - protein, 470 aa, Arabidopsis thaliana
MKQLSRKVTSNAHGQDSSYFLGWEEYEKNPYDEIKNPNGIIQMGLAENQLCFDLIETWLAKNPDAAGLKKDGQSIFKELALFQDYHGLPEFKKALAEFMEEIRGNRVTFDPSKIVLAAGSTSANETLMFCLAEPGDAFLLPTPYYPGFDRDLKWRTGAEIVPIHCSSSNGFQITESALQQAYQQAQKLDLKVKGVLVTNPSNPLGTMLTRRELNLLVDFITSKNIHLISDEIYSGTVFGFEQFVSVMDVLKDKNLENSEVSKRVHIVYSLSKDLGLPGFRVGAIYSNDEMVVSAATKMSSFGLVSSQTQYLLSALLSDKKFTSTYLDENQKRLKIRQKKLVSGLEAAGITCLKSNAGLFCWVDMRHLLDTNTFEAELELWKKIVYDVKLNISPGSSCHCTEPGWFRVCFANMSEDTLDLAMKRLKEYVESTDSRRVISKSSHDRIKSLRKRTVSNWVFRVSWTDRVPDER

SEQ ID NO: 1142 - protein, 129 aa, Triticum aestivum
MAAASLRKGNARLPPEVNRALFVRNLPFNISSEEMYDIFGKYGAIRQIRLGNAKDTRGTAYVVYEDIYDAKNAVDHLSGFNVANRYLIVLYSQLNRMSKKTDIKKKEDEITRLQEKYGVGSKTPSANDA

SEQ ID NO: 1143 - protein, 474 aa, Erwinia carotovora
MKYRHLKRFPEGFLWGAATSAYQVEGAWNEDGKGPSVIDARTSYPEGTTDFKVASDHYHRYKEDVALFADIGFKTYRFSIAWSRIIPDGSGEVNPAGIEFYHNLIDELLHYGIEPIVTMYHFDLPQALQEKGGWYNRETVDAFERFANVLFDEYGNKVKYWLTINEQNMMILHGSALGTLDPTLENPKQNLYQQNHNMLVAQAKAMNALHEKVPGAKIGPAPNIALIYPASAKPEDVMAAFNYNAIRNWLYLDMAVYGRYNTAAWRYMEEKGYTPEILPGDMDILASAKPDFIAFNYYTSQTVEASKGDGSDEIARGGDQHLKSGEEGVHRGASNPWLQKNAFGWEIDPIGFRNTLRELHDRYHLPLIITENGLGAFDTLDENGEVQDDYRIDYLQRHIEQIQLAITDGVDVFGYTPWSALDLISTHQGCAKRYGFIYVNREEFDLKDLRRIRKKSAYWYADVIKNNGLDSSEA

SEQ ID NO: 1144 - protein, 353 aa, Burkholderia vietnamiensis
MPTLFDPVTLGELTLPNRIVMAPLTRARAGTTRVPNELMARYYAERASAGLIISEATSVTPQGVGYADTPGIWSDEQVEGWKRVTQAVHAAGGRIVLQLWHVGRISDPMFLDGDLPVAPSAIAAGGHVSLVRPERPFVTPRALELDEIPGIVAAYRKGAENAKKAGFDGVEIHGANGYLLDQFLQDSTNRRTDAYGGPIENRARLLLEVVDAAIDVWGAGRVGVHLAPRGDAHTMGDSDPAATFGYVARELGRRKIAFIFTRESYTGDQLSPRLKEAFGGPLIANEQFTPDSARQALADGSADAIAWGKLFIANPDLPRRLELGAPLNKPVPETFYAQGETGYTDYPALDDAA

SEQ ID NO: 1145 - protein, 160 aa, Aspergillus niger
VAIKKMTPFDHSMFCLRTLREMKLLRYFNHENIISILDTQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAID

SEQ ID NO: 1146 - protein, 167 aa, Listeria monocytogenes
ARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREIRGSSVHAFKWINEEGKTVYVKLRWIPKAGI

SEQ ID NO: 1147 - protein, 468 aa, Listeria monocytogenes
MKLFPFIMLLFAFVFVTALVTTIVMSLGDDKQVKVSIPERKEFTKLYDVYDEITSKYYKDTKSTTMIDGAINGMVNSLDDPYSTFMSKKESSEFNDTISASFEGIGAEIQEKDGAIVIVSPIKNSPAEKAGLRPQDIITQVDGKSVKGDTATEATQKIRGEKGTKVTLTIQRSNEDKPFDVTITRDEIPIETVYKEMGSDKIAHVTISTFSETTYDELEKALKSLEKDGMKGLVLDLRGNPGGLLDQAVSISSLFVPDGKIVVQEQDKDGDKSAIKADSSSHGDYKVKVPTTMLIDGGSASASEILAAAAKESGGIKLVGTKSFGKGTVQTATTLSDDSTLKLTVAKWLTPNSEWIHEKGITPDVVVNMPDYATMTIPSSTKVYKNGDFGDDVKTIETLLKALDYNVGKVDGLYDTDTEYAVQRFQAANKLDVTGIMTGVTTDKLVELTQKHLKETDPQLQKAKALVK

SEQ ID NO: 1148 - protein, 413 aa, Bacillus anthracis
  misc_feature (378)..(411): Xaa can be any naturally occurring amino acid
MTLLSKSKYGAIVVRIFLGGRNMTSSNKKSASIYEGTNVNAWGSFENVAETKLFNSIQIGSWPLRNRIAMAPMTRCFADNETGAVGADVVEYYRKRAADGVGLIITEGIVISPRAKGNPGVPGIYTQEQIDSWKPVTEAVHKEGGTIIAQIWHVGRMSHHEIIGGQMPQAPSAIAAEGNVPRFRKPFDTPEAMTLEEIQEVIGQYAQAAKNAIEAGFDGVEIHGAHGYLIDQFTYEFVNKRTDKYGGDLKQRLTFMKEVTEAVIEAIGADKTLLRFSAFKGDNPTYMWENPELAIETFVNMFKEVGLTMIHPSTMSYTQVIADGKNFHQLVRKYWDGAIVGVGNLNPKEAEEALQEGTIDVAAFGRPLIANPDGIIEXXXXXXXXXXXXXXXXXXXXXXXXXXXXXXXXXXIS

SEQ ID NO: 1149 - protein, 482 aa, Zea mays
MAPSVAVENLNPKVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDAIAAGITSRDGFPANADDIFITDGASPGVHMMMQLLIRNEKDGILCPIPQYPLYSASIALHGGALVPYYLDEKTGWGLEISDLKKQLEDARSKGIDVRALVVINPGNPTGQVLAEDNQYDIVKFCKNEGLVLLADEVYQENIYVDNKKFNSFKKIARSMGYGEDDLPLVSFQSVSKGYYGECGKRGGYMEITGFSAPVREQIYKVASVNLCSNITGQILASLVMNPPKVGDESYASYKAEKDGILQSLARRAKALEDAFNTLEGFSCNKAEGAMYLFPQIHLPHKAIEAAKAAKKAPDAFYALRLLESTGIVVVPGSGFGQVPGTWHVRCTILPQEDKIPAVITRFKAFHEAFMAEYRD

SEQ ID NO: 1150 - protein, 279 aa, Streptococcus pyogenes
MVTTVKMTSGYEIPVLGFGTYQAADGEEAYQSTLAAIKAGYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTQEDKKTIRYLSGMSAIPNPDTTSF

SEQ ID NO: 1151 - protein, 167 aa, Listeria monocytogenes
ARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREVRGSSVHAFKWINEEGKTVYVKLRWVPKAGI

SEQ ID NO: 1152 - protein, 689 aa, Haemophilus influenzae
MSKNVICYAWLSVCLSSAIPAFAVQPTLKPSDISIPAISEESQLATKRATTRLTQSHYRKIKLDDDFSEKIFDRYIKNLDFSHNTFLQSDIDELRQKYGTKLDEQLSQGDLSAAFDIYDVMMKRRYERYTYALSLLDKEPDLNGQDQIEIDREKAAAPQTEADANKLWDARVKNDIINLKLKDKKWSEIKAKLTKRYNLAIRRLTQTKADDIVQIYLNAFAREIDPHTSYLSPRTAKSFNESINLSLEGIGTTLQSEDDEISIKSLVPGAPAERSKKLHPGDKIIGVGQATGDIEDVVGWRLEDLVEKIKGKKGTKVRLEIEPAKGGKSRIITLVRDKVRIEDQAAKLTFEKVSGKNIAVIKIPSFYIGLTEDVKKLLVKLENQKAEALIVDLRENGGGALTEAVALSGLFIADGPVVQVRDAYQRIRVHEDDDATQQYKGLLFVMINRYSASASEIFAAAMQDYRRGIIIGQNTFGKGTVQQSRSLNFIYDLDQSPLGVLQYTIQKFYRINGGSTQLKGVAADINFPEIIDSKEYGEDKEDNALAWDKIPSASYMEVGNIDYIDNAVNILNEKHLARIAKDPEFVALNEELKVRNERRDRKFLSLNYKMRKAENDKDDARRLKDLNERFKREGKKALKDIDDLPKDYEVPDFFLKEAEKIAADFVIFNSDQKINQANGLSEAKTESKK

SEQ ID NO: 1153 - protein, 210 aa, Arabidopsis thaliana
  misc_feature (73)..(73): Xaa can be any naturally occurring amino acid
  misc_feature (75)..(75): Xaa can be any naturally occurring amino acid
  misc_feature (77)..(77): Xaa can be any naturally occurring amino acid
  misc_feature (85)..(85): Xaa can be any naturally occurring amino acid
  misc_feature (93)..(93): Xaa can be any naturally occurring amino acid
MLAPSDPRARGYWGECGQLGGYFEMTNLPPRVVEERDGVASIALSPNVSAQIFLSQSDYFPLLMGLMVNPPKXGXFXYGQFAREXKGVLESLXRKARLMPDGFTSCKNVVCNFTEGAMYSFPQKRLPTGALQAAKQAGKVPDVFYCLKLLEATGISPVPGSGFGQKEGVFHLRTTILPAEDKMPEIMYSFKKFNDEFMTQYDNNFGYSKM

SEQ ID NO: 1154 - protein, 394 aa, Oryza sativa
MRMEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 1155 - protein, 220 aa, Triticum aestivum
MAQQQSLIYSFVARGTVILAEFTDFKGNFTSVAAQCLQKLPSSNNKFTYTCDGHTFSYLVEDGFTYCVVAVDSAGRQIPMAFLERVKEDFSKRYGGGKAATAQANSFNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 1156 - protein, 270 aa, Trichodesmium erythraeum
MTISTSKTLSLDWSIIGFMAFLHIGALFALFPSNFSWTAVGLALLLHWVTGGLGITLGFHRMLTHRSFKTPKWLEYFFIFCGTLACEGGVCDWVGLHRIHHQHSDNEQDPHDSHRGFWWSHMGWMLHKLPMKSEISRYTKDIANDPVYKFLQANFILIQFAFGILLFFIGGWSFVVWGIFVRIVAVFHCTWLVNSATHKFGYRTYDSGDSSTNCWWVAVLTYGEGWHNNHHAFQYSARHGLKWWEIDTTWMMIQLLQAFGLATNVKLATK

SEQ ID NO: 1157 - protein, 193 aa, Triticum aestivum
  misc_feature (8)..(8): Xaa can be any naturally occurring amino acid
MEGMVKRXRGVTFSTNVSPQIENRILYAARGLFNKFIPDVHIFTDHRAGLSGGLSAGYGVSVVAETTTGCLISADATVSYPNVDEMSEQSKKPELMSPEDLGEQVASMLLEEVAQGGVVDSTHQGLLFMLCALCPPDVSKVRVGQLTPHAIESLRNIKEFLDVKFIIKPDPNSNTVTLKCVGAGVKNLARKIS

SEQ ID NO: 1158 - protein, 449 aa, Rickettsia akari
MLLRLIITLFFIINSICTFAEAEKETENKISNQEAYKQFQDVFERIEKDYVQVPDRQKMIDEAINGMLSSLDPHSSYYTDEDLEDIFTFTKGEFGGIGVEIMYDSGAIKIISPIDDLPAFKAGLKGGDYIVGVNDELVSTLGPNKAIKEMRGMPGTKVKLLIIKEEEAKPQELELTREIVKIKPIKAHLEKNNIAYIRITTFNESTISELKAVVKKLKTESKDNLKGIILDLRNNAGGILDQAIAVSDYFIDSGVIVTTKGRTTSSNSETKANEFSLKAPKVPMIVLINGNSASASEIVAGALQDHKRAIILGTRSFGKGSVQALTQINSRAAVKLTISKYYTPSGRSIQAEGIEPDILIEPAKVEYPEVKKIDKRFSESSLKNYLKNDNEKNKDSKKETKAKNNKQEENELSELYKKDYQFARAYDVITGLILNKKLAAKEQVKQEDK

SEQ ID NO: 1159 - protein, 609 aa, Bacillus cereus
MCMCGITGWVDWKEDLSNQHVILKKMANSIEHRGPDAEGFWFSPHAAFAHRRLIVIDPEGGTQPKTFRAGDYTYALTYNGEIYNFRELKEQLQKCGHAFETHSDTEVLLHAYLEWKEDCVQHLNGIFAFALWDDQKQQLFLARDHLGVKPLFYTERNDSIIFGSEIKALLAHPSVPAEIDADGINEIFGLGLFRTPGCGVFKHIQEVRAGHSITFTRHKKVVTKYWNLESKFHTDSIEDTSSHILSILQDTVKRQLIADVPLVCMLSGGLDSSGITALAGKEFAAENKTLHTYSVDFVNSAKDFELTFARTGLDAPWVKRVSEHVGTAHHDIIVNAEELANHLFVPLHAKDLPSAGEMETSLYLLFCEMKKDATVALSGESADEVFGGYPWFHQEELLYVDKFPWLTNWKNTSPLLLNEVSNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALQPALPDDVRNRRKSAYPTSQDPHYLQTIRNLTLDMCSHKNNPIFSLINHSILLSIADQSNKEINNFEARSAMEYMLQVNEWLKTYHIHIA

SEQ ID NO: 1160 - protein, 493 aa, Cucumis sativus
MGFQQTHETNQVLLSKIAISDGHGEDSPYFDGWKAYDNDPFHPENNPSGVIQMGLAENQLSPDLLVDWIKKHPKASICTDEGLLNFKDIANFQDYHGLPEFRNAIASFMGKARGGRVKFDPSRIVMGGGATGASEAVIFCLADPGDAFLIPSPYYAAFDRDLQWRTRAQIIPVHCNSSNNFQITREALEVAYKKAEESNIKVKGLIITNPSNPLGTIYDRDTLKSLVNFVNDNNIHLVCDEIYCATVFKSPSFISIAEIIEEMDHCKKELIHILSSLSKDMELPGFRVGILYSYNDTVVSIARKMSSFGLVSSQTQHLLAAMLSDDEFVDNFLVENSKRLAKRHARFTKELEKMGITCLNGNAGLFVWMDLRKLLKDQSFESEMELWRVIINEVKLNVSPGSSFRVTEPGWFRVCFANMDDNTVDVALGRIHSFVGKIDKKENNTIPMPPKKKPRENKLRLSFSFSGRRYEEGNVLKSPHMMSPHSPLVRAKT

SEQ ID NO: 1161 - protein, 541 aa, Nocardia farcinica
MAKTIAYDEEARCGLERGLNSLADAVKVTLGPKGRNVVLEKKWGAPTITNDGVSIAKEIELEDPYEKIGAELVKEVAKKTDDVAGDGTTTATVLAQALVREGLRNVAAGANPLGLKRSIEKAVEAVTAKLLDTAKEVETKEQIAATAGISAGDASIGELIAEAMDKVGKEGVITVEESNTFGLQLELTEGMRFDKGYISGYFVTDPERQEAVLEDPYILLVGSKVSTVKDLLPLLEKVIQAGKPLLIIAEDVEGEALSTLVVNKIRGTFKSVAVKAPGFGDRRKAQLADIAILTGGEVISEEVGLSLETAGIELLGQARKVVVTKDETTIVEGAGDAERIKGRVAQIRTEIENSDSDYDREKLQERLAKLAGGVAVIKAGAATVVELKERKHRIEDAVRNAKAAVEEGIVAGGGVALLQAAPALDELKLTGDEATGANIVRVALSAPLKQIAFNAGLEPGVVAEKVSKLEAGHGLNADSGEYEDLLAAGVADPVKVTRSALQNAASIAALFLTTRAVVADKPEKAAAPAGDPTGGMGGMDF

SEQ ID NO: 1162 - protein, 489 aa, Cucumis sativus
MVLVSSNDNGNAKKVLSKLAKGNGHGEDSSYFDGWKAYDSDPFHPIINPRGVIQMGLAENQLSFEFVEKWMKNNPRASICSVEGIDEFKDIAIFQDYHGLPEFRNAVANFMGKVRGNRVKFDPDRVVMSGGATGAHETMAFCLADPGEAFLVPVPYYPGFDRDLRWRTGVEIVPVICESSNNFKLTREALETAYEEAQKSNIKIKGLLITNPSNPLGTVYDRQTLETAVSFINEKNIHLVCDEIYAATVFAEPGFISISEVIDNSDIECDRNLVHVVYSLSKDMGFPGFRVGIIYSYNDAVVACARKMSSFGLVSSQTQYLIASMLLDDVFVDNFLAGSAEKLAARHRNFTKGLAQVGIGYLKGSGGLFLWMDLRHLLKEKTLEAEMALWKVIINEVKLNVSPGSSFHCSEPGWFRVCFANMDDNTMDISITRIRNFVLQNKEVTTKVKKQKFCWRQSSLELRLSSRRLEDIMSPHSPLPQSPMHRATT

SEQ ID NO: 1163 - protein, 205 aa, Magnaporthe grisea
MSSRKKVLLKVIILGDSGVGKTSLMNQYVNKKFSASYKATIGADFLTREVLVDDRQVTMQLWDTAGQERIQSLGVAFYRGADCCVLVFDVNNSKSFDALDSWRDEFLIQASPRDPDNFPFVVLGNKIDVEESKRVISTKRAMTFCQSKGGIPYFETSAKEAINVEQAFEVIARNALAQEESEEFSGDFQDPINIHIDNDRDGCAC

SEQ ID NO: 1164 - protein, 481 aa, Cucumis sativus
MKMLSTKATCNSHGQDSSYFLGWEAYEKNPFDETSNPNGIIQMGLAENQLSFDLLESWLTKNPDAASFKRDGKSIFRELALFQDYHGLPAFKKALVEFMAEIRGNKVTFEANNIVLTAGATSANETLMFCLAEAGDAFLLPTPYYPGFDRDLKWRTGVEIVPIHCTSSNGFQVTQPALEQAYQEAQARNLRVKGVLVTNPSNPLGTTMTRNELDLVFDFITSKGIHLISDEIYSGTVFGSPGFVSAMEVLKERSNEDEEVWKRVHIVYSLSKDLGLPGFRVGAIYSNDEMVVAAATKMSSFGLVSSQTHYLLSAMLSDKKFTRTYISENQKRLKQRQKMLVSGLEKAGIKCLESSAGLFCWVDMRHLLESDTFECELKLWKKIVYEVGLNISPGSSCHCTEPGWFRVCFANMSQSTLKLAIRRLKSFVQELRSVSTPNVSTTTTNIHDSKFSKNIKKNIFTKWVFRQSVQDQANRKLHYER

SEQ ID NO: 1165 - protein, 278 aa, Oryza sativa
MAAAEFLSPEAAAAAGVGPVRQQQHPGEAAWRAVVGWLGFLLQILLQIVRGTPSSWAHLLSFLGLRHPLLSAAPPQPSPSPSPSVAFVRLPSEAPADASSTGPPPPLRRLTVVLDLDETLVCAYESSSLPAALRAEAVEAGLHCFDMECISAEKARYAKPLVDRIDAHNRFCHRLYRPSTVTTEYREHVKDLSCLSKDFHRIVLVDNNPYSFLLQPLNGIPCLTFSAGQPVDDQLMGVIFPLLKHLSLQNDVRPALYETFHMPEWFQRHGIPQIDQAA

SEQ ID NO: 1166 - protein, 221 aa, Prunus dulcis
MGRGKIEIKRIENTTNRQVTFCKRRNGLLKKAYELSILCDAEVALIVFSSRGRLYEYSNNNIRNTIEGYKKACSDSSGSTSITEINAQYYQQESAKLRQQIQMLQNSNRHLMGDALSTLSVKELKQLENRLERGINRIRSKKHEMLLAEIEYLQKKEIELENENVCLRTKISEVERLQQANMVGPELNAIQALASRNFFSQNMMEGGATYPQQDKKILHLG

SEQ ID NO: 1167 - protein, 460 aa, Glycine max
MEQKGGVLMQRYELGRLLGQGTFAKVYHARNIITGMSVAIKIIDKEKILKVGMIDQIKREISVMRLIRHPHVVELYEVMASKTKIYFVMEHAKGGELFNKVVKGRLKVDVARKYFQQLISAVDYCHSRGVCHRDLKPENLLLDENENLKVSDFGLSALAESKCQDGLLHTTCGTPAYVAPEVINRKGYDGIKADIWSCGVILYVLLAGHLPFQDTNLMEMYRKIGRGEFKFPKWFAPDVRRFLSRILDPNPKARISMAKIMESSWFKKGLEKPAITVTENEELAPLDADGIFEACENDGPIAEPKQEQAKPCNLNAFDIISFSTGFDLSGLFEDTFLKKETRFMSKKPASIIVLKLEEICKRLCLKVKKKDGGLLKLEGSKEGRKGTLGVDAEIFEITPHFHMVELRKSNGDTMEYQKLFKQDIRPALKDIVWTWQGEKPQQEQEQHEVVQEEHQPSHTA

SEQ ID NO: 1168 - protein, 481 aa, Arabidopsis thaliana
MESVPESVPSPNSNTPSIPPPVNSVPPFLSKTYDMVDDPLTNEVVSWSSGNNSFVVWSAPEFSKVLLPKYFKHNNFSSFVRQLNTYGFRKVDPDRWEFANEGFLRGRKQLLKSIVRRKPSHVQQNQQQTQVQSSSVGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYESVSNNPDSFLLGDVPSSTSVDNGNPSSRVSGVTLAEFSPNTVQSATNQVPEASLAHHPQAGLVQPNIGQSPAQGAAPADSWSPEFDLVGCETDSGECFDPIMAVLDESEGDAISPEGEGKMNELLEGVPKLPGIQDPFWEQFFSVELPAIADTDDILSGSVENNDLVLEQEPNEWTRNEQQMKYLTEQMGLLSSEAQRK

SEQ ID NO: 1169 - protein, 613 aa, Fusobacterium nucleatum
MILMSGQVEQYLFHRGEYRQAYEYLGAHPTRSSTIFRIWAPSAKSVAVVGDFNDWIAREEDYCRKLNNVGLWEVEIKKVKKGFLYKYQIETSWGEKILKSDPYAFYSELRPHTASIVNGKPKFRWGDKKWLSNREIGYARPINIYEVHLGSWKKKEDGTYYNYQEIAELLVKYMLEMNYTHIEIMPIIDYPFDGSWGYQGTGYYSVTSRYGTPEDFMYFINYFHKNNLGVILDWVPGHFCKDSHGLYRFDGSACYEYEDSSLGENEWGSANFNVTRNEVRSFLLSNLYFWTKEFHIDGIRMDAVSNMLYYRDGLSENKHSVEFLQYINQSLHEEYPDVMLIAEDSSAWPLVTKYQEDGGLGFDFKWNMGWMNDTLKYMEQDPFFRKSHHGKLTFSFMYAFSENFILPLSHDEIVHGKNSILNKMPGYYENKLAHVKNLYSYQMAHPGKKLNFMGNEFVQGLEWRYYEQLEWQLLKDNKGSQDIQKYVKALNQMYLEEEALWHDGQDGFEWIEHENINENMLIFLRKTLDMQDFIIAVFNFSGKDHEKYPLGVPLEDGEYEVILDSNEKRFGGSYQGRKRKYKAIKKSWNYREQYIEIKIAKNSAIFLKYKKEK

SEQ ID NO: 1170 - protein, 728 aa, Salmonella enterica
MSSRIDRDVINALIAGHFADPFSVLGMHQTQAGLEVRALLPDATDVWVIEPKTGRKVGKLECLDARGFFCGVLPRRKNFFRYQLAVTWHGQQNLIDDPYRFGPLIQEMDAWLLSEGTHLRPYETLGAHADTMDGVTGTRFSVWAPNARRVSVVGQFNYWDGRRHPMRLRKESGIWELFIPGAHNGQLYKFELLDANGNLRIKADPYAFEAQMRPETASMICGLPEKVTPSEERQKANQFDAPISIYEVHLGSWRRHTDNNFWLSYRELADQLVPYAKWMGFTHLELLPVNEHPFDGSWGYQPTGLYAPTRRFGTRDDFRYFINAAHAAGLNVILDWVPGHFPSDEFSLAEFDGTHLYEHSDPREGYHQDWNTLIYNYGRREVSNYLVGNALYWMERFGIDALRVDAVASMIYRDYSRKEGEWIPNEFGGRENLEAIEFLRNTNRIIGEQVPGAVSMAEESTDFSGVTRPPETGGLGFWYKWNLGWMHDTLDYMKLDPVYRQYHHDKLTFGMLYNHTENFVLPLSHDEVVHGKKSILDRMPGDAWQKFANLRAYYGWMWAFPGKKLLFMGNEFAQGREWNHDASLDWHLLEGGDNWHHGVQRLVRDLNHTYRHHKALHELDFDAYGFEWLVVDDNERSVLIFVRRDKAGNEIIVASNFTPVPRHDYRFGINQPGRWREILNTDSMHYHGSNTGNGGVVHSDEIESHGRQHSLNLTLPPLATIWLMREGE

SEQ ID NO: 1171 - protein, 327 aa, Schizosaccharomyces pombe
MSNPDVDLDSIIDRLLEVRGSRPGRQVQLSEDEIRFLCNKAREIFISQPILLELEAPLKICGDIHGQYYDLLRLFEYGGFPPEANYLFLGDYVDRGKQSLEVICLLLAYKIKYPENFFILRGNHECASINRIYGFYDECKRRYNIKLWKTFTDCFNCLPIAAIIDEKIFTMHGGLSPDLNSMDQIQRIMRPTDVPDTGLLCDLLWSDPDKDLTGWGDNDRGVSFTFGPDVVSRFLHKHDMDLVCRAHQVVEDGYEFFSKRQLVTLFSAPNYCGEFDNAGAMMSVDESLLCSFQILKPAEKKQRYGYQGSSQNWHMTPPRKNKTGNSK

SEQ ID NO: 1172 - protein, 1129 aa, Avena sativa
MSSSRPASSSSSRNRQSSQARVLAQTTLDAELNAEYEESGDSFDYSKLVEAQRDGPPVQQGRSEKVIAYLQHIQKGKLIQTFGCLLALDEKSFNVIAFSENAPEMLTTVSHAVPSVDDPPRLGIGTNVRSLFSDQGATALHKALGFADVSLLNPILVQCKTSGKPFYAIVHRATGCLVVDFEPVKPTEFPATAAGALQSYKLAAKAISKIQSLPGGSMEVLCNTVVKEVFDLTGYDRVMAYKFHEDDHGEVFSEITKPGLEPYLGLHYPATDIPQAARLLFMKNKVRMICDCRARSIKVIEAEALPFDISLCGSALRAPHSCHLQYMENMNSIASLVMAVVVNENEEDDEAESEQPAQQQKKKKLWGLLVCHHESPRYVPFPLRYACEFLAQVFAVHVNREFELEKQLREKNILKMQTMLSDMLFREASPLTIVSGTPNIMDLVKCDGAALLYGGKVWRLRNAPTESQIHDIAFWLSDVHRDSTGLSTDSLHDAGYPGAAALGDMICGMAVAKINSKDILFWFRSHTAAEIRWGGAKNDPSDMDDSRRMHPRLSFKAFLEVVKMKSLPWSDYEMDAIHSLQLILRGTLNDASKPKREASLDNQIGDLKLDGLAELQAVTSEMVRLMETATVPILAVDGNGLVNGWNQKAAELTGLRVDDAIGRHILTLVEDSSVPVVQRMLYLALQGKEEKEVRFEVKTHGPKRDDGPVILVVNACASRDLHDHVVGVCFVAQDMTVHKLVMDKFTRVEGDYKAIIHNPNPLIPPIFGADEFGWCSEWNAAMTKLTGWNRDEVLDKMLLGEVFDSSNASCPLKNRDAFVSLCVLINSALAGEETEKAPFGFFDRSGKYIECLLSANRKENEGGLITGVFCFIHVASHELQHALQVQQASEQTSLKRLKAFSYMRHAINNPLSGMLYSRKALKNTDLNEEQMKQIHVGDNCHHQINKILADLDQDSITEKSSCLDLEMAEFLLQDVVVAAVSQVLITCQGKGIRISCNLPERFMKQSVYGDGVRLQQILSDFLFISVKFSPVGGSVEISSKLTKNSIGENLHLIDLELRIKHQGLGVPAELMAQMFEEDNKEQSEEGLSLLVSRNLLRLMNGDVRHLREAGVSTFIITAELASAPTAMGQ

SEQ ID NO: 1173 - protein, 145 aa, Brassica napus
DEERPYLPKHILYRQKEQFSDGVGYSWIDGLKAHAAENVNDKMMSNAAFIFPHNTPLTKEAYYYRMIFERFFPQNSARLTVPGGATVACSTAKAVEWDASWSNNMDPSGRAAIGVHLSAYDGSKVALPLPPHKAIDDIPMMMGQE

SEQ ID NO: 1174 - protein, 526 aa, Oryza sativa
  misc_feature (267)..(267): Xaa can be any naturally occurring amino acid
  misc_feature (348)..(348): Xaa can be any naturally occurring amino acid
  misc_feature (437)..(437): Xaa can be any naturally occurring amino acid
  misc_feature (455)..(455): Xaa can be any naturally occurring amino acid
  misc_feature (463)..(463): Xaa can be any naturally occurring amino acid
MTKPGGSVAQYCSYKDTATFLLLPPAYCLSLSLYLISCSASSSSSLPQPRSPPTHRARRRRDGRWLRRRPVPKSRAIASRRLAGLRHRSPESVVVFELVPRGAVAAWSEGPVPPRAEGRGPSPPPRATALPCAVPLVVLEPLRRRRPPGLLLLVLLVIDAPIGTASWSLKPSSGLSPIGRRHLFRILSIRIPAAVAVWRNICFARFSCVSISFYYFPERERERERERERERERERVPSISLLRQRARGNSFSPPCRGMEWDKAKASXGEAVDDRGGGEGGLGYVKVMTDEQMEVLRKQISIYATICEQLVEMHRARDAQQDSIAGMRLGNLYCDPLMVPGGHKITSKXQAWTPTPMQLQILENIFDQGNGTPSKQKIKDITAELSQHGQISETNVCGSPGCRNRHEERKQAALPNNNAESEAEADEESPTDKKPKSXRPLHQNIAMRDHNSERIXEMHHFDTXEHEQIRRMMYASNDSSSRSSGSLGQMSFYDNVMSNPRIDHFLGKVESPGSFPHMRSGESFDMY

SEQ ID NO: 1175 - protein, 1129 aa, Avena sativa
MSSSRPASSSSSRNRQSSRARVLAQTTLDAELNAEYEESGDSFDYSKLVEAQRDGPPVQQGRSEKVIAYLQHIQKGKLIQTFGCMLALDEKSFNVIAFSENAPEMLTTVSHAVPSVDDPPRLGIGTNVRSLFSDQGATALHKALGFADVSLLNPILVQCKTSGKPFYAIVHRATGCLVVDFEPVKPTEFPATAAGALQSYKLAAKAISKIQSLPGGSMEVLCNTVVKEVFDLTGYDRVMAYKFHEDDHGEVFAEITKPGLEPYLGLHYPATDIPQAARFLFMKNKVRMICDCRARSIKVIEAEALPFDISLCGSALRAPHSCHLQYMENMNSIASLVMAVVVNENEEDDEAESEQPAQQQQKKKLWGLLVCHHESPRYVPFPLRYACEFLAQVFAVHVNREFELEKQLREKSILKMQTMLSDMLFREASPLTIVSGAPNIMDLVKCDGAALLYGGKVWRLRNAPTESQIHDIAFWLSDVHRDSTGLSTDSLHDAGYPGASALGDMICGMAVAKINSKDIIFWFRSHTAAEIRWGGAKHDSSDMDDSRRMHPRLSFKAFLEVVKMKSLPWTDYEMDAIHSLQLILRGTLNDASKPKREASLDNQIGDLKLDGLAELQAVTSEMVRLMETATVPILAVDGNGLVNGWNQKAAELTGLRVDDAIGRHILTLVEESSVPVVQRMLYLALQGKEEKEVRFEVKTHGPRRDDGPVILVVNACASRDLHDHVVGVCFVAQDMTVHKLVMDKFTRVEGDYKAIIHNPNPLIPPIFGADEFGWCSEWNAAMTKLTGWNRDEVLDKMLLGEVFDSSNASCPLKNKNAFVSLCVLINSALAGEETEKAPFGFFDRSGKYIECLLSANRKENEGGLITGVFCFIHVASHELQHALQVQQASEQTSLKRLKAFSYMRHAINNPLSGMLYSRKALKNTDLNEEQMKQIHVGDNCHHQINKILADLDQDSISEKSSCLDLEMAEFVFQDVVVAAVSQVLITCQGKGIRISCNLPERFMKQSVYGDGVRLQQILSDFLFISVKFSPVGGSVEISSKLTKNSIGENLHLIDLELRIKHQGLGVPAELMEQMFEEDNKEQSDEGLGLLVSRKLLRLMNGDVRHLREAGVSTFILTAELASAPTAIGQ

SEQ ID NO: 1176 - protein, 471 aa, Diospyros kaki
MKLLSRKAACNTHGQDSSYFLGWQEYEKNPYDESHNPTGIIQMGLAENQLSFDLLESWLASNPDAAGFKRDGQSIFRELALFQDYHGLPDFKKALVEFMSEIRGNKVSFDPKKLVLTAGATSANETLMFCLADPGEAFLLPTPYYPGFDRDLKWRTGVEIVPIKCTSSNGFRITESALEEAYQAAGKRNLKVKGVLVTNPSNPLGTTLSRHELNLLLSFVTEKGIHLISDEIYSGTVFSSPGFLSVMEILMDKKYSMNTEVWKRVHIVYSLSKDLGLPGFRVGAIYSNDDVVVEAATKMSSFGLVSSQTQYLLSAMLSDKKFRKNYISENQKRLRHRQEMLISGLESAGIRCLKSNAGLFCWVDMRHLLSSETFDAEMELWKKIVYDVGLNISPGSSCHCDEPGWFRVCFANMSAATLNLAIQRIKLFVQSTAAGSKQNQSYHQSLNNSRRKSLTKWVFRLSFDGREPDER

SEQ ID NO: 1177 - protein, 495 aa, Avena sativa
MSSSRPASSSSSRNRQSSQARVLAQTTLDAELNAEYEESGDSFDYSKLVEAQRDGPPVQQGRSEKVIAYLQHIQKGKLIQTFGCLLALDEKSFNVIAFSENAPEMLTTVSHAVPSVDDPPRLGIGTNVRSLFSDQGATALHKALGFADVSLLNPILVQCKTSGKPFYAIVHRATGCLVVDFEPVKPTEFPATAAGALQSYKLAAKAISKIQSLPGGSMEMLCNTVVKEVFDLTGYDRVMAYKFHEDDHGEVFSEITKPGLEPYLGLHYPATDIPQAARFLFMKNKVRMICDCRARSIKVIEAEALPFDISLCGSALRAPHSCHLQYMENMNSIASLVMAVVVNENEEDDEAESEQPAQQQKKKKLWGLLVCHHESPRYVPFPLRYACEFLAQVFAVHVNREFELEKQLREKNILKMQTMLSDMLFREASPLTIVSGNPNIMDLVKCDGAALLYGGKVWRLRNAPTESQIHDIAFWLSDVHRDSTGLSTDSLHDAG

SEQ ID NO: 1178 - protein, 280 aa, Arabidopsis thaliana
  misc_feature (223)..(223): Xaa can be any naturally occurring amino acid
  misc_feature (237)..(237): Xaa can be any naturally occurring amino acid
MFGLAKNANVVSRVRSSVTAQLKEELKRKTERSMASNGVTNCNANANVWRFKGNGATSDAAAVTLRKLAFGMFKNCTMNSGKTILFPTPGEPSAHSNFRTCPEAEEAVAAAARSGMANSYAPSPGVFKARRAVAEYLNGELPTKLKAEDVYITGGCNQAIEIVIDSLAGNPSANILLSRPGYPHYDARAVYSGLEIRIYDLLPESDWEIILDGLEAAADENTXVAMVIINPNIPCGXNVYTYDHSHRVAEMATKLGLMIISDQVFDHVVYGDKPLFPWGS

SEQ ID NO: 1179 - protein, 488 aa, Diospyros kaki
MMNTTGSGNHHHRLLSKIATNDEHGENSLYFHGWKAYDDNPFHLTQNPNGVIQMGLAENQLSFDLIEDWMKKNQRASICTTEGVHMFKEIANFQDYHGLPEFRNAVAKFMGKVRGGRAEFDPKRIVMGGGATGANELLMFCLADPGDAFLVPSPYYPAFDRDLRWRTGVKLLPVECKSSDSFRITREALEEAYEKASESNIRVKGLIIGNPSNPLGTIMDRNTLKSLVSFVNDKNIHFVCDEIYAATVFKQPEFISVSEIIQEMDCNLDLIHVVYSLSKDMGMPGFRVGIVYSYNDEVVTCARKMSSFGLVSSQTQHLLASMLSDDEFVERFIGESSRRLENRHRTFTEGLKEVEIKCLEGNAGLFCWMDLRPLLKEATFEAETELWKVIINQVKLNVSPGSSFHCSEPGWFRVCFANMDDETVQVALQRIRTFVDEKKGAGKAAPEKKKKQWQRNLRLSFSSGRIYEDGCLSPHVLSPHSPMLRAQT

SEQ ID NO: 1180 - protein, 371 aa, Arabidopsis thaliana
MASLLTKPKPVFLCSPSLSPRTLNTATPSLNFTRISFTHHQKLAPFKPPSLVVAFSEKGLKRDVTTAAAATEGDYRRIMLSDVLVKKKEKVVWWEREWKAMDFGAVAVVLSMHLLSLLAPFQFNWRAVSVAFGLYIVTGLLGITLSFHRNLSHKAFKLPKWLEYLFAYCGAQALQGNPIDWVSTHRYHHQFCDSDRDPHSPLDGFWFSHMNWMFDTNTITQRCGEPNNVGVLEKQPFYRFLRTTYILHPLALAVALYAMGGFPFIVWGMGVRIVWVYHITWLVNSACHVWGKQAWNTGDLSKNNWWVAALAFGEGWHNNHHAFEFSARHGLEWWQLDMTWYVVKFLQAIGLATDVKLPSEAQKQRMAFTSD

SEQ ID NO: 1181 - protein, 737 aa, Clostridium thermocellum
MNTTANIDEVYKVINAEHHDPFSVLGMHRLESENAMVVRAYLPNAKEIEVVELSKNNTYPMEKIDERGFFEVVIKDRNDFFKYNLRATDYVGNTFTFYDPYCFMPVISDYDLYLFNEGNHHKIYEKLGTHRMTIDGVEGTLFAVWAPCAKRVSVVGNFNQWDGRRHQMRVRGSSGVWELFIPGVGEGELYKYEIKTPHNEIYIKADPYAFYSELRPNTASIVYDIEGYEWHDADWMRERDSSNSFDKPISIYEVHLGSWKRVSNDENGFYSYRELADMLVEYVKYMGYTHIELLPIAEHPFDGSWGYQVTGYYAATSRYGQPKDFMYFVDKCHQNGIGVIIDWVPAHFPKDGHGLARFDGTALYEHYDPKQGEHPDWGTHIFNYGRNEVKNFLIANAMFWFDKYHIDGLRVDAVASMLYLDYGKKDGEWIPNRWGGKENVDAIEFMRQLNSTVFQYFPGVMMIAEESTAWALVTKPPYTGGLGFSYKWNMGWMNDFLRYMSMDSVYRKYHQNLITFSLMYAFSENFILVLSHDEVVHGKCSMINKMPGDYWQKFAGLRASYGYLYGHPGKKLLFMGGEFAQFIEWNYKQSLDWFLLDYDMHKKMQDYVRDLNKLYRSEKALYEVDFHYDGFEWIDCNDTEHSIISFMRKGKDWHNSLIFVCNFTPVPHEDYRIGSPFNTTYDEIFNSDWEKYGGSNVGNFEPIKAEEISMHNKPYSMRLRIPPLATIVLKPRFDRKD

SEQ ID NO: 1182 - protein, 544 aa, Sinorhizobium meliloti
MSAKQIVFSTDARDRLLRGVELLNNAVKVTLGPKGRNVVIDKSYGAPRITKDGVSVAKEIELEDKFENMGAQMVRAVASKTNDLAGDGTTTATVLAASIFREGAKLVSVGMNPMDLKRGIDLGVAAVLAEIKARATKVISSSEIAQVGTIAANGDAGVGEMIARAMEKVGNEGVITVEEARTADTELDVVEGMQFDRGYLSPYFVTNAEKMRVELEDPYILIHEKKLGSLQAMLPILEAAVQSGKPLLIISEDVEGEVLATLVVNRLRGGLKIAAVKTPGFGDRRKAMLEDIAVLTAGQMISEDLGIKLENVTLDMLGRARRVLIEKDTTTIIDGSGDKASIQARVSQIKAQIEETASDYDKEKLQERLAKLAGGVAVIRVGGATELEVKEKKDRIDDALNATRAAVEEGIVPGGGVALLRAKSALVGLTDDNADVTAGISIVRRALEAPIRQIADNAGVEGSIVVGKLVDGRDHNQGFDAQTETYVDMIKAGIVDPAKVVRTALRDAGSIASLLITAEAMIADIPERGSPQSTGNGAVDSMGY

SEQ ID NO: 1183 - protein, 513 aa, Oryza sativa
MVLSHGVSGSDESVHSTFASRYVRTSLPRHARSPLSRAPLAPIDSVIDWEFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 1184 - protein, 545 aa, Sodalis glossinidius
MAAKDVKFGNDARVKMLRGVNVLADAVKVTLGPKGRNVVLDKSFGAPVITKDGVSVAREIELEDKFENMGAQMVKEVASKANDAAGDGTTTATVLAQSIVNEGLKAVAAGMNPMDLKRGIDKAVIAAVEELKKLSVPCSDSKAIAQVGTISANADETVGTLIAEAMAKVGKEGVITVEEGSGLQDELDVVEGMQFDRGYLSPYFVNKPETGAVELESPFILLADKKISNIREMLPVLEAVAKAGKPLLIIAEDVEGEALATLVVNTMRGIVKIAAVKAPGFGDRRKAMLQDIAILTAGTVISEEIGLELEKATLEDMGQAKRVVITKDTTTIIDGEGDKALIDSRVTQINQQRDEATSDYDREKLQERVAKLAGGVAVIKVGAATEVEMKEKKARVEDALHATRAAVEEGVVAGGGVALIRVANRIAELRGDNEDQNVGIKVARRAMEAPLRQIVANAGEEPSVIANKVKAGEGNTGYNAATEEYGNMIDMGILDPTKVTRSALQYAASIAGLMITTECMVTDLPKEDKPDLGGAGGMGGMGGMM

SEQ ID NO: 1185 - protein, 157 aa, Rhodopirellula baltica
MTQVSDNELLFQSLCIGAIELPHRIVMAPLTRARSTDRVPNELMEEYYYQRSSAALIISGATAISEQGYGWHGAPGIYTAEQVEGWKRISDAVHASGGRIFLQLWHMGRVSHPDYQSGQLTVGPSPIAATGEAHTPHWQEAACRSSGHEYIGNCKRH

SEQ ID NO: 1186 - protein, 739 aa, Mangifera indica
MESCNCIEPQWPADELLMKYQYISDFFIALAYFSIPLELIYFVKKSAVFPYRWVLVQFGAFIVLCGATHLINLWTFSMHSRTVAIVMTTAKVFTAAVSCATALMLVHIIPDLLSVKTRELFLKNKAAELDREMGLIRTHEETGRHVRMLTHEIRSTLDRHTILKTTLVELGRTLALEECALWMPTQTGLELQLSYTLHQQNPVGYTVPIQLPVISQVFTSNHAVKISPNCPVARLRPLAGKYMPGEVVAVRVPLLHLLNFQINDWPELSTKRYALMVLMLPSDSARQWHVHELELVEVVADQVAVALSHAAILEESMRARDLLVVQNIALDRARREAETAICARNDFLSVMNHEMRTPMHAIIALSSLLQETELTPEQRLMVETILKSGNLLATLINDVLDLSRLEDGSLQLQLGTFNLHAVFKEVLNLIKPIASVKKLLVALNLAPDLPEYAVGDEKRFMQTLLNVVGNAVKFTKEGNILITAFVAKSESFLDSRTPEFFPVPSDNHFYLRVQVKDSGSGISPQDIPKLFTKFAQNQSIATRNSHGSGLGLAICKRFVNLMEGHIWIESEGLGKGCTAVFVVKLGIPESSNESKLSFMPKMSGPQTNFTGLKVLVLDDNGVSRSVTKGLLVHPGCDVMTVGSSEECLHVVSQEHKVVFMDVGIPGIDGYEVAVHIHQKFTRRHERPLIVALTGNTDKITKENCMSVGMDGVILKPISLEKMRSVLLGLLEHRVLFEAI

SEQ ID NO: 1187 - protein, 246 aa, Prunus dulcis
MGRGRVELKRIENKINRQVTFAKRRNGLLKKAYELSILCDAEVALIIFSNRGKLYEFCSSSSSILKTLERYQKCSYGQVEVNKPAKELEQSSYREYLKLKGRFESLQRTQRNLLGEDLGPLNTKELEQLERQLESSLKQVRSTKTQYMLDQLSDLQNKEQMLIEANRDLSLKLDDISSRNQIRQSWEGGNQGGMAYGSQHAQSQGFFQPLDCNPTLQIGYSNVGSEQMSATTHAQQVNGFIPGWML

SEQ ID NO: 1188 - protein, 441 aa, Cryptococcus neoformans
MDNTPRHLFQTPNNVYILQQPWQFVKELGQGAYGCVSSARNSSTGETCAVKKVTNVFQKKILTKRCLRELRLLHHFRGHKNITCLYDMDIVFDPPGSGQFREVYLYEELMEADLHAIIRSGQPLSDAHFQSFLYQTLCGLKYIHSANVLHRDLKPGNLLVNADCELKICDFGLARGFQPGAVQTDQGQAGFMTEYVATRWYRAPEIMLSFANYTSSIDMWSVGCILAELLGGKPIFKGEDYVDQLNKILNLLGTPTEDTLRRVGSPRAQDYIRSLPIKPRVKFGTLYPNASPLALDLLSKLLTFDPAKRYGCEEALEHPYLAVWHDPADEPLCEVPFDFSFEEEDSVSGMRDLILEEVRSFRYLVRQQTMPPVRKDSHELPPAPPAPQHPGAGVGPAFHEKRTAKAIWRNILGLHWRNSWRGRNYHRIIFVESVTVIGKHR

SEQ ID NO: 1189 - protein, 470 aa, Staphylococcus epidermidis
MTKKLPDDFIFGGATAAYQAEGATQTDGKGRVAWDTYLEENYWYTAEPASDFYNRYPVDLELSERFGVNGIRISIAWSRIFPKGYGEVNQKGVEYYHNLFKECHKRHVEPFVTLHHFDTPEVLHKDGDFLNRKTIDYFVDYAEFCFKEFPEVKYWTTFNEIGPIGDGQYLVGKFPPGIKYDFEKVFQSHHNMMVAHARAVKLFKDENYKGEIGVVHALPTKYPYDPSNPEDVRAAELEDIIHNKFILDATYLGKYSRETMEGVQHILSVNGGQLEISDEDYKILDEAKDLNDFLGINYYMSDWMRGFEGESEITHNATGDKGGSKYQLKGVGQREFDVDVPRTDWDWMIYPQGLYDQIMRVVKDYPNYHKIYITENGLGYKDVFDEKEKTVHDDARIDYIKQHLSVIADAIADGANVKGYFLWSLMDVFSWSNGYEKRYGLFYVDFETQERFPKKSAYWYKELAESKEIK

SEQ ID NO: 1190 - protein, 450 aa, Unknown
  Bartonella sp. NVH1
IAGDGTTTATVLGQAIVQEGVKAVAAGMNPMDLKRGIDAAVEEVVANLFKKAKKIQTSAEIAQVGTISANGAEEIGKMIADAMEKVGNEGVITVEEAKTAETELEVVEGMQFDRGYLSPYFVTNAEKMVADIDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKAEINARVNQIKAQIEETTSDYDREKLQERLAKLAGGVAVIRVGGATEVEVKEKKDRVDDALNATRAAVEEGIVAGGGTALLRAANALTVKGNNPDQEAGINIVRRALQAPARQIATNAGEEAAIIVGKVLENNADTFGYNTATGEFGDLIALGIVDPVKVVRSALQNAASIASLLITTDAMVASKKDTPMPPMP

SEQ ID NO: 1191 - protein, 364 aa, Chromobacterium violaceum
MNADKLLTPLTMGAVALSNRVVMAPLTRLRNIEPGDVPGPLAKEYYRQRASAGLIVAEGTHISPTAKGYAGAPGIYSEEQVRAWSEVTGAVHQDGGKIALQLWHTGRISHRSLQPNGDAPVGPSAIQADSRTNIRAADGSLVREQCDTPRALEIEEIEDIIEDYRRAADNARRAGFDMVEIHGAHGYLIDQFLSPAANVRTDQYGGSVENRARFLLEVVDAVVAEWDADHVGIRISPLGIFNGVSNTDQLDMALYLAEQLAKRKLAFLHISEPDWAGGPTLDDGFRAELRQRYPGVIIGAGGYSAEKAETLLKKGFIDAAAFGRSYIANPDLVERLKQNAPLNPPKPDTFYGGGAEGYTDYPTL

SEQ ID NO: 1192 - protein, 319 aa, Acetabularia peniculus
MDESTVDDVIERLLEVRNNRPGKQVQLTESEIRLLCLTSKEILSEQPNLLELEAPIKICGDIHGQYTDLLRLFEYGGFPPEANYLFLGDYVDRGKQSLETICLLLAFKIKYPENFFILRGNHECASINRIYGFYDECKRRYNIRLWKTFTDCFNCLPVAAIVDEKILCMHGGLSPELKTLEQIRRIPRPTDVPDTGLLCDLLWADPDKDVQGWGENDRGVSYTFGPDTVTEFLQRHDLDLVCRAHQVVEDGYEFFAKRQLVTLFSAPNYCGEFDNAGALMSVDDTLMCSFQILKPSEKKGKFMQGGNSLAGAGRGTPRR

SEQ ID NO: 1193 - protein, 121 aa, Oryza sativa
AKPLVDRIHAHNRFCRRLYRPSTVTTEYREHVKDLSCLSKDFHRIVLVDNNPYSFLLQPLNGIPCLTFSAGQPVDDQLMGVIFPLLKHLSLQNDVRPALYETFHMPEWFQRHGIPQIDQAA

SEQ ID NO: 1194 - protein, 436 aa, Bartonella weissi
IAGDGTTTATVLGQAIVQEGIKAVAAGMNPMDLKRGIDSAVAEVVESLFKKAKKIQTSAEIAQVGTISANGASEIGKIIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIFCAVKAPGFGDRRKAMLEDIAILTSGQVISEDVGIKLENVTLDMLGRAKKVHISKENTTIVDGSGQKAQISARVSQIKAQIEETTSDYDREKLQERLAKLAGGVAVIRVGGATEVEVKEKKDRVDDALNATRAAVEEGIVAGGGTALLRAANALTVKGNNADQEAGINIVRRALQAPARQIATNAGEEAAIIVGKVLENSSDTFGYNTATGQFGDLISLGIVDPVKVVRSALQNAASIASLLITTE

SEQ ID NO: 1195 - protein, 319 aa, Acetabularia peniculus
MEESAVDDVIERLLEVRNNRPGKQVNLAEGEIRQLCLTAKDVFMSQPNLLELEAPIKICGDIHGQYTDLLRLFEYGGFPPEANYLFLGDYVDRGKQSLETICLLLAFKVKYPKNFFLLRGNHECASINRIYGFYDVCKRRYNIRLWKTFTDCFNCLPACALVDEKIICMHGGLSPELKSLDAIRHIPRPTDVPDTGLLCDLLWSDPDKDVAGWGENDRGVSYTFGPDTVTGFLQKHDLDLICRAHQVVEDGYEFFAKRQLVTLFSAPNYCGEFDNAGALMSVDDTLMCSFQILKPSEKKGKLLYGSGALAGPGRGTPRR

SEQ ID NO: 1196 - protein, 274 aa, Cryptococcus neoformans
MLTPSARISAPRFSRQLSTSLISKMKVLPYKARSDNWMYLIIDSSNEAAVVDPYDANKISGAVKEQRANVTSLITTHHHADHSGGNSKFLSLHPNLKVYAGSTQSPGTNTVVKDGDTFTLGQDITVKCLHTPCHTQDSICFFLEDKKTGQRGVFTGDTLFLAGCGRFFEGTPEEMHAALTKLSNLPEDTIVYNGHEYTKGSAKFGLTIEPDNQHLKELLKKAENDSCTTGKSTIGDEKNWNVFMRLDTPQAKQATGKTEAVEIMGRLREMKNAM

SEQ ID NO: 1197 - protein, 1081 aa, Candida albicans
MNPTKKPRLSPMQPSVFEILNDPELYSQHCHSLRETLLDHFNHQATLIDTYEHELEKSKNANKAFQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRKINVHAQGEILQLQRTINTMVDQLRTFAFEVSKVARDVGVLGILGGQALIENVEGIWEELTDNVNAMALNLTTQVRNIANVTTAVAKGDLSKKVTADCKGEILDLKLTINQMVDRLQNFALAVTTLSREVGTLGIWGGQANVQDVEGAWKQVTENVNLMATNLTNQVRSIATVTTAVAHGDLSQKIDVHAQGEILQLKNTINKMVDSLQLFASEVSKVAQDVGINGKLGIQAQVSDVDGLWKEITSNVNTMASNLTSQVRAFAQITAAATDGDFTRFITVEASGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLEVCVSDTGIGIEKDKLGLIFDTFCQADGSTTRKFGGTGLGLSISKQLIHLMGGEIWVTSEYGSGSNFYFTVCVSPSNIRYTRQTEQLLPFSSHYVLFVSTEHTQEELDVLRDGIIELGLIPIIVRNIEDATLTEPVKYDIIMIDSIEIAKKLRLLSEVKYIPLVLVHHSIPQLNMRVCIDLGISSYANTPCSITDLASAIIPALESRSISQNSDESVRYKILLAEDNLVNQKLAVRILEKQGHSVEVVENGLEAYEAIKRNKYDVVLMDVQMPVMGGFEATEKIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVEDMIGDTPRQGSVEGGGTSSRPVQRRSATEGSITTISEQIDR

SEQ ID NO: 1198 - protein, 1298 aa, Neurospora crassa
MTDGPTLAAIAALVKSLAVDPATTQTSGLRPSTHVRLPGPYTREKGDLERELSALVVRIEQLETAAIAASPPAMPDTPNAPTDALFSNGTLSPSSETPDARYPAPLPRNGFIDEALEGLREHVDDQSKLLDSQRQELAGVNAQLIEQKQLQEKALAIIEQERVATLERELWKHQKANEAFQKALREIGEIVTAVARGDLSKKVRMNSVEMDPEITTFKRTINTMMDQLQVFSSEVSRVAREVGTEGILGGQAQIEGVDGTWKELTDNVNVMAQNLTDQVREIASVTTAVAHGDLTKKIERPAKGEILQLQQTINTMVDQLRTFASEVTRVARDVGTEGILGGQADVEGVQGMWNELTVNVNAMANNLTTQVRDIIKVTTAVAKGDLTQKVQAECRGEIFELKKTINSMVDQLQQFAREVTKIAREVGTEGRLGGQATVHDVQGTWRDLTENVNGMAMNLTTQVREIAKVTTAVAKGDLTKKIGVEVQGEILDLKNTINTMVDRLGTFAFEVSKVAREVGTDGTLGGQAQVDNVEGKWKDLTENVNTMASNLTSQVRGISTVTQAIANGDMSRKIEVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKKKINQMVYNLRDSIQRNTQAREAAELANKTKSEFLANMSHEIRTPMNGIIGMTQLTLDTDLTQYQREMLNIVNSLANSLLTIIDDILDLSKIEARRMVIEEIPYTLRGTVFNALKTLAVKANEKFLDLTYRVDHSVPDHVVGDSFRLRQIILNLVGNAIKFTEHGEVSLTIQKASSVQCSTEEYAIEFVVSDTGIGIPADKLDLIFDTFQQADGSMTRKFGGTGLGLSISKRLVNLMGGDVWVKSEYGKGSKFFFTCVVRLANDDISLIAKQLNPYKSHQVLFIDKGRTGHGPEIAKMLHGLGLVPIVVDSERNPALEKARAAGQAPYDVIIVDSIEDARRLRSVDDFKYLPIVLLAPVVHVSLKSCLDLGITSYMTTPCQLIDLGNGMVPALENRATPSLADNTKSFEILLAEDNTVNQRLAVKILEKYHHVVTVVGNGEEAVEAVKRKKFDVILMDVQMPIMGGFEATAKIREYERSLGSQRTPIIALTAHAMMGDREKCIQAQMDEYLSKPLQQNHLIQTILKCATLGGQLLEKNRERELTRAADAVTGGRRDNGMYSASQAAQHAALRPPLATRGLTAADSLVSGLESPSIVTADKEDPLSRARASLSEPNIHKAS

SEQ ID NO: 1199 - protein, 554 aa, Vibrio parahaemolyticus
MCSVFGILDIKSDAAALRPIALEMSKKLRHRGPDWSGIYSSERAILAHERLAIVGLNSGAQPLYSPDKKLILAVNGEIYNHKEIRARYEGKYEFQTDSDCEVILALYQDMGADLLEELNGIFAFVLYDEEKDEYLVGRDHIGIIPLYQGYDEHGNYYVASEMKALVPVCKTVSEFPPGSHYSSKDAEPQRYYIRDWNEYAAVQGNSTSKEELTEALEAAVKRQLMTDVPYGVLLSGGLDSSITSAVAKRYAAMRIEDDEKSEAWWPQLHSFAVGLEGAPDLKAAREVAEKIGTVHHEMTYTIQEGLDAIRDVIYHIETYDVTTIRASTPMFLMGRKIKAMGIKMVLSGEGADEIFGGYLYFHKAPNAKEFHEETVRKLLALNMFDCARANKSLAAWGVEGRVPFLDKEFIDVAMRLNPADKMCGNGKMEKHILRECFEHYLPDSIAWRQKEQFSDGVGYSWIDTLKAVAEEKVTDQQMETAQYRFPYNTPTTKEGYVYREIFEELFPLPSAAECVPGGPSVACSSAKAIEWDESFKNCVDPSGRAVQTVHNDAY

SEQ ID NO: 1200 - protein, 224 aa, Cycas edentata
MGRGKIEIKRIENTTNRQVTFCKRRNGLLKKAYELSVLCDAEVALIVFSSRGRLYEFANNSVKRTIERYKKTCADNTQGGAISESNSQYWQQEAGKLRQQIDILQNANRHLMGDALTSLSVKELKQLEIRLERGLSRVRSKKNEMLLEEIEIMQRREHILLAENQFLRTKIAEYESNQNTNVLIPGPEFDALPAFDSRNFLHANLIEAAAHHYTQQDQAALQLG

SEQ ID NO: 1201 - protein, 296 aa, Escherichia coli
MSYYHHHHHHLESTSLYKKAGLANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 1202 - protein, 671 aa, Gibberella zeae
MCGISAFITHPGHSRSPVLNGDAKQVVEELETSLDLIAHRGPDARGRWFSDNHHVGLGHVRLSIIDLSPSGNQPFHDEQGGIHAVVNGELYDYERYKAQLADEFKFVGNSDCEIVIALYKHYGLSFISHLRGEFAFVLWDENRQQLIAARDRYGIKSLYYTVHQNKLLVATEIKSFLAFGLEPEWCVRSLRDQSWRVDSTTFFEGVYKVRPGHYLICRPNEREEQHPYWDLEYPDKFAKDLRSEDEITEGVRERLLEAVRIRLKADVPVAVYLSGGIDSSSVAGMVSHLIKQGTKLGNETSLLPSSMKCYTVQFDEGSGADESAIARRTADFLGVDIHLVKMDEEALVSRFEDTTWYSEVPLPDLNGMGRLALAEAVHAQGIKAVITGEGSDEHFGGYDAFRADSLSEPDHSWPAMMTDTERQEAHALASKEAQYGIFGDFTPKVPISTKRMFYSNHVASSIARVGSLPFSDWTKVYGNSIPETTMIEGFDGRVRDNILKRWHPVHTAQYMFVKTFMPHFILRYNGDNIDMVHQVESRCPFLDHHLTEYVNNVPPSLKMRYNAKDKSWREKHILREAVKPFVTDEVYNMSKKAYMGPRKFWPGGPLHKKISELVTKANVENLGFVDWQATQDAMDGAFNKQEGLALRRIITVAQFVVLGQRFGVKRASGRR

SEQ ID NO: 1203 - protein, 383 aa, Triticum aestivum
HLYDPISLVRDDKIKNELLGLGISMQSFNGDLLYEPWQVYDENGLAFTTFNMYWEKCMKLHIEISSSLAPWRLVPVSGIENICSSSIDDLGLESSKDEESSNALLSRAWSPGWRNAEKTLEDFVSHGLLDYSKDGMKVAGTTTSLLSPYLHHGEVSVRKVYQLVRMQQIKWENEGKSGAGESVNLFLLSIGLREYSRYLCFNFPFTHERSLLGNLKHYPWRADEDRFKSWRQGMTGYPLVDAGMRELWATGWTHNRIRVIVSSFAVKFLQIPWTWGMKYFWDVLLDADIESDILGWQYISGSLPDGHELGRLDNPEVQGQKYDPDGEYVRTWIPELARMPGEWIHHPWDAPSSILEVAGVELGFNYPMPIVELHTARECLDDV

SEQ ID NO: 1204 - protein, 512 aa, Arabidopsis thaliana
MCGILAVLGCSDDSQAKRVRVLELSRRLRHRGPDWSGLYQNGDNYLAHQRLAVIDPASGDQPLFNEDKTIVVTVNGEIYNHEELRKRLKNHKFRTGSDCEVIAHLYEEYGVDFVDMLDGIFSFVLLDTRDNSFMVARDAIGVTSLYIGWGLDGSVWISSEMKGLNDDCEHFETFPPGHFYSSKLGGFKQWYNPPWFNESVPSTPYEPLAIRRAFENAVIKRLMTDVPFGVLLSGGLDSSLVASITARHLAGTKAAKQWGPQLHSFCVGLEGSPDLKAGKEVAEYLGTVHHEFHFSVQDGIDAIEDVIYHVETYDVTTIRASTPMFLMSRKIKSLGVKMVLSGEGADEIFGGYLYFHKAPNKKEFHQETCRKIKALHKYDCLRANKSTSAFGLEARVPFLDKDFINTAMSLDPESKMIKPEEGRIEKWVLRRAFDDEERPYLPKHILYRQKEQFSDGVGYSWIDGLKDHAAQNVNDKMMSNAGHIFPHNTPNTKEAYYYRMIFERFFPQVRVL

SEQ ID NO: 1205 - protein, 584 aa, Phaseolus vulgaris
MCGILAVLGCSDHSRAKRVRVLELSRRLKHRGPDWSGLHQHGDCFLAHQRLAIVDPASGDQPLFNEDKSVIVTVNGEIYNHEELRKQLPGHKFRTGSDCDVIAHLYEEHGEGFVDMLDGIFSFVLLDTRDNSFIVARDAIGVTSLYIGWGLDGSVWISSEMKGLNDDCEHFECFPPGHLYSSKDRGFRRWYNPPWFSEAIPSAPYDPLVLRRAFEQAVIKRLMTGVPFGVLLSGGLDSSLVASITSRYLANTKAAEQWGSKLHSFCVGLEGSPDLKAAKEVADYLGTVHHEFHFTVQDGIDAIEDVIYHVETYDVTTIRASTPMFLMSRKIKSLGVKWVISGEGSDEIFGGYLYFHKAPNKEEFHRETCRKIKALHQYDCLRANKSTFAWGLEARVPFLDKEFINAAMNIDPEHKMIKRDEGRIEKWILRRAFDDEDQPYLPKHILYRQKEQFSDGVGYSWIDGLKAHAAKHVTDKMMLNAGNIYPHNTPVTKEAYYYRMIFERFFPQNSARLTVPGGASVACSTAKAVEWDAAWSNNLDPSGRAALGVHISAYENQNNLANKGVEIEKIIPMDAAPLGVAIQS

SEQ ID NO: 1206 - protein, 211 aa, Aquifex aeolicus
MIIKVIPVGPIAVNCSVVADEKSGEAIIIDPGAEAEKILEAVKDFKVVGIVATHGHIDHVGQVGKLKELFDVPFYMNPLDKFLINDEIWSGFASYIGAVPCPEPDVEISEGDVIRVGDVEFKVLHTPGHTPGLCCLYEEKRRVLIAGDLLFKGSVGRWDLPGGNLVELKKSVKRVLTELPQDTLVICGHYDETTIGQERAFNPFAGELLNG

SEQ ID NO: 1207 - protein, 95 aa, Fagopyrum tataricum
GRLYEYANHSVKATIDRYKKACSDSAGVTSVAEANAQYYQQEAAKLRNQIRTLQNNSRNLSRHMMGEGLSSLSMKDLKNLETRLEKGISGIRAKK

SEQ ID NO: 1208 - protein, 141 aa, Brassica napus
  misc_feature (136)..(136): Xaa can be any naturally occurring amino acid
MEEKKEESKNKNVKKANLLDHNSIKHILDESVSDIVTSRGYKEDVRLSNLKLFLGAIIIVVALVAQFYNKKFPENRDYLIGCIALYVVLNGVLQLILYTKEKNAILFTYPPEGSFTSTGLVVSSKLPRFSDEYTLXIDSAD

SEQ ID NO: 1209 - protein, 492 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHGRASPETMRDIRGFAVKFYTREGNFDLVGNNTPVFFIRDGIQFPDVVHALKPNRKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEARLTHEIRGIWTSYWLKADRSLGQKLASRLNVRPSM

SEQ ID NO: 1210 - protein, 95 aa, Fagopyrum homotropicum
GRLYEYANHSVKATIDRYKKACSDSAGVTSVAEANAQYYQQEAAKLRNQIRTLQNNSRNLSRHMMGEGLSNLSMKDLKNLETRLEKGISRIRAKK

SEQ ID NO: 1211 - protein, 349 aa, Thermus thermophilus
MGLLFTPLELRGLRLKNRLAMSPMCQYSATEGGEVTDWHLLHYPTRALGGVGLVIVEATAVLPEGRISPFDLGIWSEDHLPGLRELARRIREAGAVPGIQLAHAGRKAGTARPWEGGRPLGWKVVGPSPLPFAEGYPVPEALDEAGMARVLEAFVEGAKRALRAGFLVVELHMAHGYLLSSFLSPLANRREDAYGGSRENRMRFPLEVARAVREAIPPELLLFVRVSATDWAEGGWGLEDTLAFAERLKALGVDLLDLSSGGVVPGVRVPVAPGFQVPFADAVRKRVGMPTGAVGLLTTPEQAETVLQAGSADLVLLGRVLLRDPYFPLKAAKALGAEAPVPPQYQRAF

SEQ ID NO: 1212 - protein, 493 aa, Zea mays
VRRSGSSSSLATAMDPYKHARRAPSTPVLDHNSAPRVEQRQLLTVGARGPILLEDLVVEKLANFDRERIPERVVHRCGASAKGFFEVTHDITTDVADSAGRTAGMQAVIAVSLNCVALALRYHDGSPETLGPRVASVYTGGNWTVETLPSLIRDGIKSGHVHALKPNPRTHIQDNWRILDFFSHHPESLHMFSFLFDDSGIPADVRPHGGSGVHTYTLVSRAGTVTYVKFHWRPTCGVRSLMDDEAVAVGAQPQPRTKDLTDAIAAGNFPEWTLYIQTMDPEMEDRLQHLDPLDVTKTWPEDVPLEPVGRLVLNRNIDNFFAENEQLAFSPGLIVPGIYYSDDKLLQTRIFSYSDTQRHRLGPNYLLLPANAPKCAHHNNHYDGSMNFMHRTEEVDYFPSRYDAVRNAPRYPIPTAHIAGRREKTVISKENNFKQPGERYRAMDPARQERFITNGSTLEIPGYRARIRNHGHSCFLCEIVIRSQFHTTYEPEA

SEQ ID NO: 1213 - protein, 251 aa, Arabidopsis thaliana
MVNATVARNIAGICGNVISLFLFLSPIPTFITIYKKKKVEEYKADPYLATVLNCALWVFYGLPMVQPDSLLVITINGTGLAIELVYLAIFFFFSPTSRKVKVGLWLIGEMVFVGIVATCTLLLFHTHNQRSSFVGIFCVIFVSLMYIAPLTIMSKVIKTKSVKYMPFSLSLANFLNGVVWVIYALIKFDLFILIGNGLGTVSGAVQLILYACYYKTTPKDDEDEEDEENLSKVNSQLQLSGNSGQAKRVSA

SEQ ID NO: 1214 - protein, 189 aa, Zea mays
MAITHDDYVSLCLMALAAAGGGGHAAAASARTTTTMTTQECELRFRCSVCGKAFASHQALGGHKASHRKPPPPLAQAPSSSSSVTTNTSSAGGSGAGQGRHRCSVCHRGFATGQALGGHKRCHYWDGLSVSLTASAASGSASSLRGFDLNLVPAAGAARWREEEEVQSPLPVKKRRLSSGPSTELSLTI

SEQ ID NO: 1215 - protein, 383 aa, Nicotiana sylvestris
RGSPESLRDIRGFAVKFYTREGNFDLVGNNVPVFFNRDAKSFPDTIRALKPNPKSHIQEYWRILDFFSFLPESLHTFAWFFDDVCLPTDYRHMEGYGVHAYQLINKAGKAHYVKFHWKPTCGVKCMSEEEAIRVGGTNHSHATKDLYDSIAAGNYPEWKLFIQIMDTEDVDKFDFDPLDVTKTWPEDILPLMPVGRLVLNRNIDNFFAENEQLAFNPGHIVPGLYYSEDKLLQTRIFAYADTQRHRIGPNYMQLPVNAPKCAHHNNHRDGAMNFMHRDEEVDYLPSRFDPCRHAEQYPIPSRVLTGRREMCVIEKENNFKQAGERYRSWEPDRQDRYVSKWVEHLSDPRVTYEIRSIWISYLSQADKSCGQKVASRLTLKPTM

SEQ ID NO: 1216 - protein, 451 aa, Cryptococcus neoformans
MTSLNFKVAPAVQATEAPPIPKAQAWGCQYVPSPSAPLLDLSQGVPRAAPHPNVLAALSKVASDPQAARYGPILGEPGLRQALAEEIKVQYHVSGQGVTFEDVAITTGCNMAFLSLLMTLCPPGKSSVLLPLPAYFNHTMSLSLQDVKPVYVLCEPDNMFKASLPSARSYLASLRKGNGDRREPRMIVLVSPSNPTGTVYTNEEIKQWYDLAREYKVALVLDETYRDFVEGESGQRGLPHRLFEEPDWRSTLVSLGSFSKGYRIPGHRLGSIIASPELLQHITTICDCMQICPPRPPQIALTPLLPSLRPDLFAASSQLSHRRHLFETTVNAIPGWEVISSGGFFAYVQFPEDYIYASSILGLKRKKLGSEDVARVLALRCGVVTLPGSFFMPPLADDEQWDDILNGETLRQDKWLRFAVANVEDDVILSLGPRLKLMNKIMGVDNEGVAS

SEQ ID NO: 1217 - protein, 260 aa, Prochlorococcus marinus
MEATSTAATSDKQRSSIHALPVLQDNIIWIWIKGNQAVVVDPAIAEPVKTWLRTRKLSLAAVLQTHHHADHIGGTLELLRDWPNAAVVAAAEDRDRIPFQTISVRDRDKVSLLNSSVEVLAVAGHTRAHIAYYLPTNKEDLEDPAVFCGDTLFGAGCGRLFEGTAEDMFKALQRLSCLPAKTRVYCAHEYTEANLRWASALHPEDVAISERLADVSSRRQRGALSLPSSISEEQRTNLFVRAQSSKELAELRHHKDQWRN

SEQ ID NO: 1218 - protein, 453 aa, Zea mays
MEKKPTILMNRYELGRTLGQGTFAKVYHGRNLASGESVAIKVIDKEKVMRVGMIDQIKREISVMRLVRHPNVVQLHEVMASKSKIYFAMEYVRGGELFARVARGRLKEDAARRYFHQLVGAVDFCHSRGVYHRDLKPENLLVDEHGNLKVSDFGLSALRECQKQDGLLHTTCGTPAYVAPEIINKKGYDGAKADIWSCGVILFVLLAGYLPFHDANLVEMYRKISRADVKYPQWFSPELRRLMPKLLEPNPNNRITIEKLVEHPWFKKGYRPAVMLAQPHGSSSLKDVQVAFSNADHKDSSSKVEQPADSSLKPASLNAFDIISHSRGFDLSSLFEVDQEQKASNSRFMTQKPASAIVSKLEQIAETERFMVKKQDGLVKLQGSKQGRKGQLAIDAEIFEVTPAFHVVEVKKSAGDTLEYEMFCSKGLRPSLSDICWSSRSEENMAPSVVQPS

SEQ ID NO: 1219 - protein, 673 aa, Chromobacterium violaceum
MSAYPHLLAPLDLGFTTLKNRVLMGSMHTGLEESPGGFEKMAAFYAERARGGVALIVTGGVGPNAEGCVAEGAAQLSDAHEVPKHKLVTDAVHREGGKIALQILHSGRYSFQEKCVSASPLLAPINFYTPRELSDADVWQTIADFANCAKLAQQAGYDGVEVMGSEGYLINQFIARATNKRTDDWGGSFENRIRFAIETVKAVRAAVGGDFIIIYRLSMLDLVQDGSSWDEVVHLAREIEKAGATLINTGIGWHEARVPTIATMVPRGGFAWVTKKLMGQVKIPLITTNRINTPEVAEDILAGGCADMVSMARPFLADPDFVNKAAAGRGDEINTCIGCNQACLDHIFQGKLTSCLVNPRACRETELNYEKTAVPKKLAVVGAGPAGLAFATVAAERGHSVTLFDAAAEIGGQFNVAKQIPGKEEFHETLRYFKRRIETTGVELKLGARVAADDLSGFDEVVLATGIAPRTPSIPGIGHPKVLSYLDVLKHKKPVGGKVAIIGAGGIGFDTAEYLCHEGRSTSLDAEAFMREWGVDMTGDSAGGLAPQGPQPHPSPREVYLLQRKTSKVGEGLGKTTGWIHRESLKMKRVKMLSGVSYDLIDDAGLHITVKGERQVLPVDNVVICAGQDPLRELQGPLEAAGKPVHLIGGADVAAELDAKRAIDQGSRLAAAI

SEQ ID NO: 1220 - protein, 634 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITVGSSVPMNLPVVNQVFSSNRAIIIPHTSSLARVRPLAGRYVPPEVAAVRVPLLHLSNFQINDWPELSAKSFAIMVLMLPSDSARKLHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLGVCDNTNTYQKQLVPLIWPSSADSNLSAPKVLPDGRGSVSLKSRYQRSV

SEQ ID NO: 1221 - protein, 274 aa, Listeria monocytogenes
MNLKDTVKLANGVEMPRLGFGVWKVQDGDEAVNSVKWAIEAGYISIDTAAAYKNEEGVGQAIKESGIKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELSEEEVAKISGLNKDERTGPDPDNFNF

SEQ ID NO: 1222 - protein, 716 aa, Rhodopseudomonas palustris
MTVQLSDEAYAVVEGRHADPFRYLGAHPEDGGTMVRVLLPDAVAVEVIGDNGDVAPLDQAHPAGLFVGPLPGASPRYTLRARFGDTTVELQDPYRFPPILSDFDLYLLGEGTDQRLYDKLGAHPMELEGVAGVGFVVLAPNARRVSVVGDFNFWNPLRHQMRVRGSGYWELFVPGARAGDHYKFDLAGPNGEQLPQKADPLAFAAELRPKTASIVVDATTLPRPRPAPENINALSAPMSIYEVHLGSWRRKEGDQWLTYRELAEQLPAYVRDMGFTHVEFLPVSEHPFDGSWGYQPTGLYAPTSRFGSPEDFCALVDACHAAGIGVILDWVPGHFPDDPHGLGNFDGTALYEHANPMQGRHLDWGTLIYNYGRTEVVNFLTANALFWLERYGIDGLRVDAVASMLYLDYSRPAGGWIPNKFGGRENIEAIDFIRRFNTEVYGKFPHSTTAAEESTAWPQVSRPIEFGGLGFGYKWNMGWMHDTLNYISKDPIHRKYHHGQILFGLHYAFSENFILPLSHDEVVHGKRSILGRMPGDEWQRFANLRAYYAFMFGHPGKKLLFMGSEFGQEREWSHDRSLDWHLLEYPKYSGIQALLRDLNKLYRSLPALHQLDCDPFGFEWLITEDANRNLFAWMRKGNDTRARCLVIVNFSPNVYQDYRVRVPFPGRWREVFNSDSAGYGGTNVGNGGEVRTLEGLVPELSLTIPPLAAIFLTPED

SEQ ID NO: 1223 - protein, 542 aa, Streptococcus mutans
MAKDIKFSADARSSMVRGVDILADTVKVTLGPKGRNVVLEKSFGSPLITNDGVTIAKEIELEDHFENMGAKLVSEVASKTNDIAGDGTTTATVLTQAIVREGLKNVTAGANPIGIRRGIETAVATAVDELKAIAQPVSGKEAIAQVAAVSSRSEKVGEYVSEAMEKVGNDGVITIEESRGMETELDVVEGMQFDRGYLSQYMVTDNEKMVADLENPYLLITDKKISNIQDVLPLLEEVLKTNRPLLIIADDVDGEALPTLVLNKIRGTFNVVAVKAPGFGDRRKAMLEDIAVLTGGTVITEDLGLELKDTTIDALGQAARVTVDKDSTVIVEGSGGKEAVANRVNLIKSQIETATSDFDREKLQERLAKLSGGVAVIKVGAATETELKEMKLRIEDALNATRAAVEEGIVAGGGTALINVIEKVAALDLTDDAATGRNLVLRALEEPVRQIAKNAGYEGSVIIDKLKNSSAGTGFNAANGEWVDMIDAGIIDPVKVTRSALQNAASVASLILTTEAVVADHPAPEAPAAAPAMDPSMMGGMM

SEQ ID NO: 1224 - protein, 268 aa, Arabidopsis thaliana
MMEWDNQLQPNNHHSSNLQGIDVNGGSGAGGGMYVKVMTDEQYETLRKQIAIYGTICERLVEMHKTLTAQQDLAGGRMGGLYADPMMSSLGHKMTARQRWTPTPVQLQILERIFDQGTGTPSKQKIKDITEELSQHGQIAEQNVYNWFQNRRARSKRKQHGGGSSGNNNGESEVETEVEALNEKRVVRPESLLGLPDGNSNNNGLGTTTATTTAPRPEDLCFQSPEISSDLHLLDVLSNPRDEHLVGKMGLAESYNLYDHVEDYGMSG

SEQ ID NO: 1225 - protein, 331 aa, Ustilago maydis
MADNTTLEVDLDNVIDRLLEVRGSRPGKPVHLEEYEIKYLCLKARDIFINQPILLELEAPIKICGDIHGQYYDLLRLFEYGGFPPEANYLFLGDYVDRGKQSLETICLLLAYKIKYPENFFILRGNHECASINRIYGFYDECKRRFNIKLWKTFTDCFNCLPIAAIIDEKIFTMHGGLSPDLQSMEQIRRVMRPTDVPDTGLLCDLLWSDPDKDISGWSENDRGVSFTFGPDVVSRFLQKHDMDLICRAHQVVEDGYEFFAKRQLVTLFSAPNYCGEFDNAGAMMSVDETLLCSFQILKPAEKKQKYAYGGINMGRPVTPPRKQKKKSDGK

SEQ ID NO: 1226 - protein, 588 aa, Rhodopseudomonas palustris
MTLRSFGPRLTGNGVEFRIWAPNAKRVDVVLDRPHPMRRDAMGWYTTHIDGIGAGARYRFLIDGSLDVPDPASLFQPEDLAGPSEVIDHAAYQWRAKEWHGRPWAETVLLETHVGTFTPEGSFRAMIDKLDHLVDTGITALELMPLADFPGTRNWGYDGVLWYAPDSAYGRPEDLKALIDEAHLRGLMVFLDVVYNHFGPEGNYLGQYAPGFFSDSHTPWGNGINYYVEQVRAFAIENALYWLDDYRFDGLRLDAVHAIPDQGEIPMLDELSREVGRLAAETGRYVHLVLENDDNTAAVLDPVTHPPRGQYRAQWNDDYHHAWHVALTGETHGYYSDYANAPLAHLARALGSGFVFQGEPSEHRGGQPRGEPSGDLVPLAFINFLQNHDQIGNRALGDRLESLVKPQAIEAALAVTLLAPTVPMLFMGEEWGSQAPFPFFCDFQGDLAEAVRAGRRKEFAGAYKEYGDEVPDPLSKDAFDSAVLDWHERDQGRGAARLALVKRLLAIRHREIVPRLDSSRFGDARITGDGLLKAFWRLTDGATLELVANLSDDERDGGAPPAAGTILWGGDWNRIIPPWAVSWRLEHP

SEQ ID NO: 1227 - protein, 456 aa, Arabidopsis thaliana
MCGILAVLGCSDDSQAKRVRVLELSRRLRHRGPDWSGLYQNGDNYLAHQRLAVIDPASGDQPLFNEDKTIVVTVNGEIYNHEELRKRLKNHKFRTGSDCEVIAHLYEEYGVDFVDMLDGIFSFVLLDTRDNSFMVARDAIGVTSLYIGWGLDGSVWISSEMKGLNDDCEHFETFPPGHFYSSKLGGFKQWYNPPWFNESVPSTPYEPLAIRRAFENAVIKRLMTDVPFGVLLSGGLDSSLVASITARHLAGTKAAKQWGPQLHSFCVGLEGSPDLKAGKEVAEYLGTVHHEFHFSVQDGIDAIEDVIYHVETYDVTTIRASTPMFLMSRKIKSLGVKMVLSGEGADEIFGGYLYFHKAPNKKEFHQETCRKIKALHKYDCLRANKSTSAFGLEARVPFLDKDFINTAMSLDPESKMVTTKLTSQTQYLPSQVNVEQIFYMGFSRSSQRKEGSRNGF

SEQ ID NO: 1228 - protein, 342 aa, Zea mays
MKFGATYEEYLRAERDKFLGQCSHVEYKRLKKVLKKCRVGRSLQADGTNGDEQQEGRDESSNICECNSCTLCDEMFFTELNKEASEIAGCFRSRVQRLLHLHVPSGLQRCIWRFRQCFIDDQQIMVQEGRMLLNYVTMNAIAIRKILKKYDKIHGSVSGRDFKSKMQTEHIELLQSPWLIELAAFHLNCDDSDADEPRAGEFFKNGFFKNFSCDLSGAQPLLTMTISETLKYEYSLTCPICLDTLFNPYALSCGHLFCKACACGAASVYIFQGVKSAPPEAKCPVCRAVGVFDRAVRMTELELLLKRRDKDYFLQRLREERSVMVKQAKEYWDSQAMLSMGI

SEQ ID NO: 1229 - protein, 469 aa, Clostridium acetobutylicum
MRHSKLKDFPKDFLWSASTSAYQVEGAWNEDGKGMSVQDAKTSLPEGTSDFKVASDHYHHFEEDIAFLGEMGLKAYRFSISWTRIIPDGDGKINTKGVQFYHKLIDACLSYNIEPIVTMYHFDLPFELEKKGGWNNRTTIDAFLKFSKILFEQYGSKVKYFLTINEQNMMILHGAAIGTSKGSGINIWKELYQQNHNMLVAQAKAMELCHKLCPNSKIGPAPNIASIYPASSKPEDYLAAQNFTAIRNWLYLDMAVFGRYNSTAWSYLEEIDAVPKIEEGDMEILRNAKPDFIAFNYYNTATVKANNDAKKVQDSSGDQQLAVFEAGVFEGVQNPNLEKTEFGWEIDPVGFRITLREVYDRYNLPIIVTENGLGAFDKLEDGTVHDDYRIEYYKKHLHEIKEAITDGVKVFGYSPWSAIDLVSTHQGVTKRYGFIYVNRDEFDLKDLKRYKKDSFYWYKKVIEENGNNL

SEQ ID NO: 1230 - protein, 634 aa, Passiflora edulis
MDSCDCIDTQWGHEGILVKYQYISDVLIAFAYFSIPIELVYFVQKSAFFPYRWVLMQFGAFIVLCGATHFINLWTFSTHSKAVAVVMAIAKVSCAVVSCATALMLFHIIPDILSVKTRELFLKNKAEELDREMGLILTQEETGRHVRMLTHEIRSTLDRHIILKTTLVELGRTLGLEECAIWMPSRTGSTLQLSHTLNYQAQIGSPVSINIPEVNQVFNSARATRISYTCPLARIRPLVGGYLLPEVVAVRVPLLHLSNFQIKDWPDLSAKSYAVMVLILPTNSARTWRDHELELVEVVADQVAVALSHAAILEESMRARDQLMEQNVALNMARREAEMAVHARTDFLAVMKHEMRTPMHAIIALSSLLLETELMPEQRAMIEIVLKSSNLLATLTNDVLDLSRLEDGSLGLDLAVFNLHEVFREVINLIKPIASVKRLTLTQIMTPDLPSFAVGDEKRLMQTILNVVGNGVKFTKEGSVSVIVSVANPDSLREWRLPDVYPISSDGHFYLQVQVKDSGCGILPQDIPLLFTKFFHPRSESNRGTDGAGLGLAISKRFVSLMGGHMWIDSEGLDKGTVATFIVKLGHCTDRDDSSAHHAASRGRANNESLMEGHKLPFRDNGFVSSYSRYQISV

SEQ ID NO: 1231 - protein, 95 aa, Fagopyrum esculentum
GRLYEYANHSVKATIDRYKKACSDSAGVTSVAEANAQYYQQEAAKLRNQIRTLQNNSGNLSRHMMGEGLSNLSMKDLKNLETRLEKGISRIRAKK

SEQ ID NO: 1232 - protein, 268 aa, Arabidopsis thaliana
MEVTSQSTLPPGFRFHPTDEELIVYYLRNQTMSKPCPVSIIPEVDIYKFDPWQLPEKTEFGENEWYFFSPRERKYPNGVRPNRAAVSGYWKATGTDKAIHSGSSNVGVKKALVFYKGRPPKGIKTDWIMHEYRLHDSRKASTKRSGSMRLDEWVLCRIYKKRGASKLLNEQEGFMDEVLMEDETKVVINEAERRNDEEIMMMTSMKLPRTCSLAHLLEMDYMGPVSHIDNFSQFDHLHQPDSESSWFGDLQFNQDEILNHHRQAMFKF

SEQ ID NO: 1233 - protein, 546 aa, Helicobacter pylori
MAKEIKFSDSARNLLFEGVRQLHDAVKVTMGPRGRNVLIQKSYGAPSITKDGVSVAKEIELSCPVANMGAQLVKEVASKTADAAGDGTTTATVLAYSIFKEGLRNITAGANPIEVKRGMDKAAEAIINELKKASKKVGGKEEITQVATISANSDHNIGKLIADAMEKVGKDGVITVEEAKGIEDELDVVEGMQFDRGYLSPYFVTNAEKMTAQLDNAYILLTDKKISSMKDILPLLEKTMKEGKPLLIIAEDIEGEALTTLVVNKLRGVLNIAAVKAPGFGDRRKEMLKDIAILTGGQVISEELGLSLENAEVEFLGKAGRIVIDKDNTTIVDGKGHSDDVKDRVAQIKTQIASTTSDYDKEKLQERLAKLSGGVAVIKVGAASEVEMKEKKDRVDDALSATKAAVEEGIVIGGGAALIRAAQKVHLNLHDDEKVGYEIIMRAIKAPLAQIAINAGYDGGVVVNEVEKHEGHFGFNASNGKYVDMFKEGIIDPLKVERIALQNAVSVSSLLLTTEATVHEIKEEKATPAMPDMGGMGGMGGMGGMM

SEQ ID NO: 1234 - protein, 585 aa, Saccharomyces cerevisiae
MLHRHGSKQKNFENIAGKVVHDLAGLQLLSNDVQKSAVQSGHQGSNNMRDTSSQGMANKYSVPKKGLPADLSYQLIHNELTLDGNPHLNLASFVNTFTTDQARKLIDENLTKNLADNDEYPQLIELTQRCISMLAQLWHANPDEEPIGCATTGSSEAIMLGGLAMKKRWEHRMKNAGKDASKPNIIMSSACQVALEKFTRYFEVECRLVPVSHRSHHMLDPESLWDYVDENTIGCFVILGTTYTGHLENVEKVADVLSQIEAKHPDWSNTDIPIHADGASGGFIIPFGFEKEHMKAYGMERWGFNHPRVVSMNTSGHKFGLTTPGLGWVLWRDESLLADELRFKLKYLGGVEETFGLNFSRPGFQVVHQYFNFVSLGHSGYRTQFQNSLFVARAFSFELLNSSKLPGCFEIVSSIHESIENDSAPKSVKDYWEHPQAYKPGVPLVAFKLSKKFHEEYPEVPQAILSSLLRGRGWIIPNYPLPKATDGSDEKEVLRVVFRSEMKLDLAQLLIVDIESILTKLIHSYEKVCHHIELASEQTPERKSSFIYEMLLALASPQDDIPTPDEIEKKNKLKETTTRNYRGTC

SEQ ID NO: 1235 - protein, 354 aa, Ashbya gossypii
MVYKQLYMRGTPPDLSRCITGQDIAMVMNVRTIKLNNGADMPLVGLGCWKIPNEVAAEQVYEAIKLGYRLLDGAEDYANEREVGQGIRRAIDEGLVRREELFVVSKLWNNYHRPEDVGKALQRTLSDLGLDYLDLFYIHFPLAFKFVPLEERYPAGLYTGAADEQAGRLAQEPVPLIETYRALEQLVDEGRIRAIGLSNFQGCLVQDLLRGCRIRPAALQIEHHPYLTQERLVQYAKSEGLAVVGYSSLGPQSFLELGNTAAQNAAPLLQHEVVCRIAERHTATPAEVLLRWATQRDIAVIPKSSRKERLATNLRVDEALTLADDELRELSSLNCGLRFNDPWDWSAQPLPTFI

SEQ ID NO: 1236 - protein, 519 aa, Arabidopsis thaliana
MGNSFGCSASGERLVSAARDGDFVEAKMLLDCNPCLAKYSTFGGLNSPLHFAAAKGHNEIVGLLLENGADVNSRNYCGQTALMQACRYGHWEVVQTLLLFRCNVTRADYLAGRTALHFAAVNGHARCIRLVLADFLPSDKLNSLPETGVVTAKNKSEQSALSKFVNKAADGGITALHMAALNGLFDCVQLLLDLEANVSADSFYTAPKMTILFFVNVAGAGSTPLHYAACGGNLKCCQILLARGARKMTLNCNGWLPIDIARMWSRHWLEPLLSPNSDVVIPAFPHSNYLSLPLLSILNIAREFGLQSATIGDEVDICAVCLERTCTVAAEGCEHQLCVRCALYLCSSSNVPSVTVGPPGSIPCPLCRHGITAFKRLPSSLTREMKLPMSLGFCAPCMLHTGDTTDQSSPTCPPTEQRSSKTRAASVSSDIFCPVTCSPFPSVNIPMCTCNEGTCPNFETHGTERHSEEHVESSPSRTTTEQEKIEEGQRLGKTTTCSSMFWGRRSCSRENQCNSEINA

SEQ ID NO: 1237 - protein, 434 aa, Prochlorococcus marinus
MLKSFLKISLLIAICPSPSFSFQANSSTLITNNPKEIIDQVWQIIYRDFLDYSGKYKAEDWIKLRKEILSTKYFDNDEAYIAIKDMLTELDDPYTRFLDPKEFNEMRIDTTGELMGVGIQISLDEVTNQIVVVSPIEGTPAFLAGIKPKDIIVSIDGKPIDGLSIDRTVKLIRGKKGTKVELGIIREEELLNISLIRDRIEINVVDSRINNTVSGAKIGYVRLKQFNAKSPKEMSLSINKLEKQKPFGYVLDLRSNPGGLLEASIEIARQWINTGIIVSTKTKDGITDIRKAKSRALTNRPVVVLIDEGSASASEILSGAIKDNKRGILVGKKTFGKGLVQSVRSLSDGSGLTVTVAKYLTPSGKDINKNGIAPDIRADLLLNEKNKLTNADLGTLKDSQYVAAENILIKKFKIESKKNSYNPLKSNLGYALKN

SEQ ID NO: 1238 - protein, 412 aa, Pseudomonas syringae
MLIATFFFTSHFSRAKQPMWYNGLLDLSVWQVIAVTLAMTHVTIVGVTVYLHRYSAHRSLELNAGLKHFFRFWLWLTTAQNTREWTAIHRKHHAKCETVDDPHSPVVKGLSTVLRKGAELYREEAQNQDTLRIYGKNCPEDWIERNLYSRYKMLGIVLMAVIDLALFGAIGITVWAIQMMWIPFWAAGVVNGLGHAVGYRNFECRDAATNLVPWGIVIGGEELHNNHHTYPNSAKLSVKPWEFDMGWAWIKLFSFLRLAKVQRVAPIAHRVEGKGHIDMDTAMAILNNRFQIMAQYRKLVIAPLVTQELAKADESVRHQFRRAKRLLSRETSLLDDKHHLRIQTMLEHSHALKVIYEKRLALQQIWVKTSSNGHDMLSAMKEWIHEAEASGIQSLREFADQLKTYSLRPVHA

SEQ ID NO: 1239 - protein, 254 aa, Arabidopsis thaliana
MQIELVPCLKDNYAYILHDEDTGTVGVVDPSEAEPIIDSLKRSGRNLTYILNTHHHYDHTGGNLELKDRYGAKVIGSAMDKDRIPGIDMALKDGDKWMFAGHEVHVMDTPGHTKGHISLYFPGSRAIFTGDTMFSLSCGKLFEGTPKQMLASLQKITSLPDDTSIYCGHEYTLSNSKFALSLEPNNEVLQSYAAHVAELRSKKLPTIPTTVKMEKACNPFLRSSNTDIRRALRIPEAADEAEALGIIRKAKDDF

SEQ ID NO: 1240 - protein, 456 aa, Triticum aestivum
FIRHHRTATEEGGMAAAGGGPRRTTRVGPYELGKTVGEGSFAKVKIAKDTRNAATCAIKVLDRNHVLRHKMVEQIKREIATMKLIRHPNVVQLHEVMASKSKIYMVLEFVEGGELFDKIVNSGKLGEDEARRYFHQLINAVDYCHSRGVYHRDLKPENLLLDSYGALKVSDFGLSAFSPQTKEDGLLHTACGTPNYVAPEVLADKGYDGMAADVWSCGIILFVLMAGYLPFDDPNLMTLYKLIARANVSCPPWFSTGARNLIKRILDPNPHTRITIAQILEDEWFKKDYKPPQSEHNEDVSLEDVDAAFDSSEEHLVAERREKPESMNAFALISRSEGFNLGNLFEKEMMGMVKRETSFASQRTPQEIMSKIEEACGPLGFNVRKQNYKMKLKGDKTGRKGHLSVATEVFEVAPTLHMVELRKTGGDTLEFHSFYKNFSSELKDIVWKTESNTIAK

SEQ ID NO: 1241 - protein, 763 aa, Nostoc punctiforme
MSMTTIAPEQVNSIVWNQHNDPFEILGSHPIEQDGKTVWAVRAYLPNASAVWVVLPEQRKEYPMQTVHHPHFFECTIETAELANYQLRIKEGEHERVTYDPYAFRSPNLTDFDLHLFSEGNHHRIYEKLGAHPTEIGGVKGVYFAVWAPNARNVSLLGDFNLWDGRKHQMRKGPTGVWELFIPEIGMGEHYKYEIKNFEGHIYEKSDPYGFQQEPRPKTASIVTDLDAYTWNDESWMEKRRHTDPLTQPVSVYEVHLGSWLHASSAEPAKLPNGETEPVVVVSELKPGARFLTYRELADRLIPYVKELGYTHIEMLPIAEHPFDGSWGYQVTGYYAPTSRFGSPEDFMYFVDKCHQNDIGVIVDWVPGHFPKDGHGLAFFDGSHLYEHADPRKGEHKGWGTLVFNYGRHEVSNFLAANALFWFDKYHIDGIRVDAVASMLYNDYCREPGEWLPNQYGGRENLEAADFLRQVNHIIFSYFPGILSIAEESTSWPMVSWPTYTGGLGFNLKWNMGWMHDMLDYFSMDPWFRQFHQNNITFSMWYNHSENFMLALSHDEVVHGKSNIIGKMPGDTWQKLANIRCLFTYMFAHPGKKTMFMSMEFGQWSEWNAWADLEWHLLQHEPHQQLKTFFQGLNHLYRSEPVLYTQDFAEPGFEWIDCSDNRHSVVSFIRRDKDSDDFAIVVCNFTPQPHSHYRIGVPQKGFYTELFNSDARQYGGSNMGNLGGKWTDDWSLHSRPYSLDLCLPPLGVLILKLDKKKTAEVIG

SEQ ID NO: 1242 - protein, 289 aa, Triticum aestivum
  misc_feature (273)..(273): Xaa can be any naturally occurring amino acid
  misc_feature (283)..(283): Xaa can be any naturally occurring amino acid
NKFVQKSRLVPVRNSRDIVDPRVRELGRSRAGGTFAKVKFARNVETGENVAIKILDKDKVLKHKMIAQIKREISTMKLIRHPNVIRMYEVMASRTKIYIVMELVTGGELFDKIASRGRLKEDDARKYFQQLINAVDYCHSRGVYHRDLKPENLLLDANGTLKVSDFGLSALSQQVREDGLLHTTCGTPNYVAPEVINNKGYDGAKADLWSCGVILFVLMAGYLPFEDSNLMALYKKIYKADFSCPSWFSTSAKKLIKKILDPIPNTRITIAEXINNEWVKKGXQPPRFE

SEQ ID NO: 1243 - protein, 460 aa, Gibberella zeae
MKLLQLAALVASISPFASAADANAWKSRNIYFALTDRVARSDSDSGGNACSNLGNYCGGTFKGLEAKLDYIKGMGFDAIWITPVVENTDGGYHGYWAKDLYEVNAKYGTKDDLKSLVKTAHSKNIYVMADVVANHMGKGIQDHRPEPLNQQSSYHSPCAIDYNNQNSIEQCEIADLPDLNTGSETVKKVLNDWISWLVTEYSFDGIRIDTVKHVEKSFWPDFQKAAGVYAIGEVWDGSPDYLAGYSKVMPGLLNYAIYYPMNRFYQQKGDPSAVVDMYNEISQKFDDPTVLGTFIDNHDNPRWLSQKNDKALLKNALAYVILSRGIPIVYYGTEQGYAGGNDPANREDLWRSSFKTDSDLYQTISKLGKARSAVGGLAGNDQKFLKSNDSALIWSRANNDLIVVTMNRGQGFSGQYCFNTGANNKTWERVLGQGTVKSDGSGQLCVSYTNGEPEVLVAAN

SEQ ID NO: 1244 - protein, 294 aa, Arabidopsis thaliana
  misc_feature (50)..(50): Xaa can be any naturally occurring amino acid
  misc_feature (83)..(83): Xaa can be any naturally occurring amino acid
MEKTLVGGCGGENEEVILGKELDFLGREQVSNIRRDSFVEPLGSILLQLXEAFWVFPWLVFINGICITLSYHRNLSHRSFDLXPKWLEYLFAYGGVLAFQGDPIEWVSNHRYHHKHCETQRDPHSPTQGFWFSHMAWIFDTSSILENCGGEENVDDLVRQPFYRFLQRTVLLHMMAYSFLFYFCGGMPLLVWGIGITIAVRLHLTFLVNSVCHIWGTRAWNTSDFSKNNWWVAILTLGEGWHNNHHAFEFSARHGLEWWQLDITWCLIRFLEAIGLATNVKLPTETQMKGKALV

SEQ ID NO: 1245 - protein, 480 aa, Listeria monocytogenes
MKELLTFPKDFWWGSAWSAEQAEGRGDTGKAKTVWEHWFETEPNRFYEGVGSEITTDHFNRYKEDVQWMKKTGQNSFRISISWARMFPNDGVGEVNPKAIAFYRDLLTEMNENGIKPFANLYHFDMPVALQDAGGWESREVVDAYVHFADTCFKEFGDLVYHWFTFNEPLGPILGGYLEDFHYPNQIDFKRGAQAGFNTILAHALAIKAFKKLNLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYDTSKLVGTKREETTNG

SEQ ID NO: 1246 - protein, 402 aa, Phaseolus acutifolius
MDEALGSSCSLPPFLAKTYEMVDDLSTNSIVSWSVSSKSFIVWNPPEFARDLLPRFFKHNNFSSFIRQLNTYGFKKIDPEQWEFANDDFVRGQPHLMKNIHRRKPVHSHSLQNLQAQGPLGDSERQGFTDGIEKLKRDKERLLVELQKFQHEWQTYEIQIHCSNDRLEKLEQKQHKMVSSISHVLQKPVLAVNILPLTETMDRKRRLPRSGHYYDESSIEDAIETSQMLPRENAENTTVLTLNVERLDQLESSVAFWEAIAHDIGDNFAQIQSNMDFDESTSCADSPSISCAQLDVDVRPKSSGIDMNSEPTAAAVPDPLASKDQPAGITVAATGVNDVFWEQFLTEDPGASETQEVQSERKDCDGRKNEGKPNDHSKFWWNIRNANNLSEPMGHVGQAEKT

SEQ ID NO: 1247 - protein, 95 aa, Fagopyrum rubifolium
GRLYEYANQSVKATIDRYKKACSDSAGVTSVAEANAQYYQQEAAKLRNQIRTLQNNSRNLSRHMMGEGLSSLSMKDLKNLETRLEKGISRIRAKK

SEQ ID NO: 1248 - protein, 95 aa, Fagopyrum statice
GRLYEYANHSVKATIDRYKKACSDSAGVTSVAEANAQYYQQEAAKLRSQIRTLQNNSRNLSRHMMGEGLSSLSMKDLKNLETRLEKGISRIRAKK

SEQ ID NO: 1249 - protein, 354 aa, Trichodesmium erythraeum
MVNTQAREDLHIRLEETQLLDRDCTTLSRHVLQQLHFSPDAQDISSLMNRIGLAGKLIARRLTRAGLLEDTLGFTGTVNVQGESVKKMDIYANDVFISVFKQSGLVCRLASEEMEKPYYIPENCPIGRYTLLYDPLDGSSNLDTNLNVGSIFSVRQQEGNDENGLAQDLLQNGHKQIAAGYILYGPSTMLVYSIGQGVHAFTLDPSLGEFILVNENIKIPEHGPVYSVNEGNFWQWDDSMRDYIRYVHRHEGYTARYGGALVGDFHRILYQGGVFLYPGTVKKPEGKLRLLYESAPMGYLVEQAGGRASTGTEEILDVVADQLHQRTPLIIGSKEDVALVESFIKEQKRISNQG

SEQ ID NO: 1250 - protein, 820 aa, Leptospira interrogans
MRFLLLYIIFLFHYSLMAESLSPVSGKISQLQKDSSLSFFVYYFSSDSDENFRERIFAKDSSLSFQNIPAEVFSLGFTSNTVWFYIPLKNDTEKDYRGEFEIFNSYLEEVDIFYRYGSKDSIHEILAGTSRVYEKSFPALNFYLRPGEEIQIVCKIKSGTPMRIPIVLESEENFNFTKLFRAILFGLTLGFGIAMGLYNFSLYMFFRTRSYLYYFIMILFSTVYLASWDGLISPLFKPNYGRYYLPFILVLFYTSALFLFLFSMEFLYPEKKERYVKIIIFLYVVVNLLLIPLSIFYPTHLNRISYYLGLVNNLIIVYFCIVRIRGGFKSAKNFLIIHLVFPVAGILTNLSTFGAISIDYLSLHLLKLAFISQSVLFSVMLVQRIKELEFRLKDGLQSEIHKNIVLLKKEIQQRRETEWELIQAKEVAEKASKVKSNFLANMSHEIRTPMNGVLGMVQLLGTTKLNDEQKEYVEVLSVSAKSLLQIINDILDFSKIEAGKVILEREVFSIRSVLDEIHDLLYPLAKQKEINFRLEGKLEIQEYVYGDPLRLRQILWNLAGNGIKFTSRGEVVLKVTQKNISKSSVSIEFTVMDSGIGIPLEKQKQVFEAFSQNDTSTARKFGGSGLGLSITKQLVELQGGVLKLESKDGEGSKFTFTIDYDIPSALEIEKILEAEKTKDLEKSFQDVVAKSTRILVAEDNETNCLLIERALKKLGYDPTVVHNGREVIERMQLEAFDIILMDIHMPEVDGIEATKWIRSKNQNSEFPIIIALTADAIESSKEKYISKGMNDCLTKPLDLPILKSTLDLWSNRVDVSHWKL

SEQ ID NO: 1251 - protein, 302 aa, Gonyaulax polyedra
MEALDLDRIIVQLLEVRGCRPGKLVQLTEGEICALCIRSRDIFMDQPILLELECPLKVCGDVHGQYSDLLRLFECGGLPPEANYLFLGDYVDRGKQSLETICLLLAYKVKYPENFFLLRGNHECASINRIYGFYDECKRRYSIRLWKTFTDCFNCLPVSAVIDDKILCMHGGLSPELSNLEQIKRVVRPTDVPDTGLLCDLLWSDPEKEISGWGENDRGVSFTFGPDVVQRFLRQHGLDLVCRAHQVVEDGYEFFARRALVTIFSAPNYCGEFDNAGAIMTVDESFCCAFQILRPLTRMGVP

SEQ ID NO: 1252 - protein, 311 aa, Zea mays
MAATEVYSPTTAAAAQQQRGKAASQAWRAVVGWIGFFLQVLLQILRGTPSCAQLLSFVGFRYPLLSGPAASEPLPEVAFMPLHSEIPADAAPAPKPASEPLGRLTVVLDLDETLVSAYESSSLPAIVRTQAVEAGLHCFDMECISSDKDVEGKQKVNHVTVFERPGLHEFLRKTSEFADLILFTAGLEGYARPLVDRIDVHNRFRIRLYRPSTVTTEYREHVKDLTRVSKDFGRIVIVDNNPFSFILQPLNGIPCVPFSAGQHSDDQLMTVIFPLLKHLSLQKDVRPVLRERFHMPEWFQNHGIPQISQAV

SEQ ID NO: 1253 - protein, 210 aa, Zea mays
  misc_feature (58)..(58): Xaa can be any naturally occurring amino acid
AINGGATSRWRCVEACYNYGFLPADRGRHQPPPAPHATLPHAAEDAGELWEYFPCPFXICNHLQEEHCFDTRNAVCPICANNLGKDMAAHFRLQHTHLLKRRKPYRPSSCPAAATSPATYQVNSYYEEAEPQQHYSRPYKDPAPDPLLSQFICSVDAIPGDANAQKDDQRLKLNNKGATASDDDASSKLGLEERLQRIDFLTEILMSPIL

SEQ ID NO: 1254 - protein, 279 aa, Thermosynechococcus vulcanus
MTSSLELQPQTSRLNWGFVFFLGAVHILAAVALFFFSWSALAVTIFLHWLFGSIGICLGYHRLLSHRSFQVPQWLEYVIAVVGALAMQGGPIFWVAGHRLHHAHTEDEIKDPYSARRGFWWSHMLWLVYPQSQFFNAEEYARFAPDLTRDPFYRWLDRYFLLLQLPLALLLYGLGGWSWLLWGMFMRAVFLWHSTWLINSATHKWGYRRFETEDNSRNLWWAALLTYGEGWHNNHHAYPHVAKAGWYWWEVDPTWWVIRTLQGLGLAAKVQLPPPKALS

SEQ ID NO: 1255 - protein, 525 aa, Buchnera aphidicola
NEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMDLEKSTLEDLGQAKRVVINKDTTTIIGGSGEKHTIQSRISQIRQEIQEATSDYDKEKLNERLAKLSGGVAVLKVGAAPEVEMKEKKARVEDALHATRAAVEEGVVAGGGVALVRVAGKISNLRGQNEDQNVGIRVALRAMEAPLRQIVSNSGEEPSVVTNNVKDGKGNYGYNAATDEYGDMIDFGILDPTKVTRSALQYAASVAGLMITTECMVTDLPKEEKSSDSS

SEQ ID NO: 1256 - protein, 115 aa, Brassica napus
EISKYDHICEDISQNIEVQEQLLRQIQAQNEEFATVFSLEDYKASREKCYIQIQAAISKYREIKENVNEGLKFYVTLQDAITNVKQQCSDFVMTRSIQCREMIEDVQRQMSGLSF

SEQ ID NO: 1257 - protein, 567 aa, Vibrio cholerae
  misc_feature (520)..(520): Xaa can be any naturally occurring amino acid
  misc_feature (522)..(522): Xaa can be any naturally occurring amino acid
MISKNMRSHLKLSFKSIFSIKFIVISHLVKRVIYPYILAGQKRAFDFFILRNVGQNGRSHWRATMHMSKSFLIISMGFVAVSVQAQTLTRDNGAPVGDNQNSITAGEHGSVLLQDVHLIQKLQRFARERIPERVVHARGTGAHGEFVASGDFSDLTLSAPFTSKGKITPVFVRFSTVIHSKGSPETLRDPRGFATKFYTEQGNWDLVGNNLPVFFIRDSIKFPDMVHSLKPSPVTNLQDPNRFFDFFSHEPGSTHMLTWVYTNLGTPASYRTMDGFGVHAYKWINQKGDVNYVKFHWKSLQGIESLRPDEVVKVQGQDFNHLTNDLYTQINAGNHPKWDLYVQVLTPEQLSKLDYNGLDATKVWLDVPEKKVGTMTLNKVPDNFFLETEQSAFAPSNLIPGIEPSEDRLLQGRLFAYADTQLYRLGANLFQLPINRPLVEVNSHNQEGASNSAQTASDINYQPSRKLELKEDPQFKAVQTQLVGSVQQKAISNPRNFYQAGVLYRSLNEQDKQDLITNLXGXLNKVTDKEIKATMVSHFYRADKDYGTRLARATNTDLKQVAKLAAM

SEQ ID NO: 1258 - protein, 525 aa, Buchnera aphidicola
NEARVKMLRGVNVLADAVKVTLGPKGRNVVLDKSFGAPSITKDGVSVAREIELEDKFENMGAQMVKEVASKANDAAGDGTTTATLLAQAIVNEGLKAVAAGMNPMDLKRGIDKAVIAAVEELKRLSVPCSDSKAITQVGTISANADEKVGMLIADAMEKVGKDGVITVEEGTGLQDELEVVKGMQFDRGYLSPYFINKADTGIVELDNPYILMADKKISNVRELLPILEAVAKSGKPLLIISEDLEGEALATLVVNSIRGIVKVAAVKAPGFGDRRKAMLQDISILTAGSVISEELAMELEKATLEDLGQAKRVVISKDTTTIIGGIGEKFNIQNRISQIRQQIQEATSDYDKEKLNERLAKLSGGVAVLKVGAAPEVEMKEKKARVEDALHATRAAVEEGVVPGGGVALVRVAAKISSLLGQNEDQNVGIRVALRAMEAPLRQIVSNSGEEPSVVTNNVKDGKGNYGYNAATDEYGDMIQFGILDPTKVTRSALQYASSVAGLMITTECMVTDLPKEEKSDLSS

SEQ ID NO: 1259 - protein, 525 aa, Buchnera aphidicola
NEARVKMLRGVNVLADAVKVTLGPKGRNVVLDKSFGAPSITKDGVSVAREIELEDKFENMGAQMVKEVASKANDAAGDGTTTATLLAQAIVNEGLKAVAAGMNPMDLKRGIDKAVIAAVEELKCLSVPCSDSRAITQVGTISANADEKVGMLIADAMEKVGKDGVITVEEGTGLQDELEVVKGMQFDRGYLSPYFINKTETGIVELDNPYILMADKKISNVRELLPILESVAKSGKPLLIISEDLEGEALATLVVNSIRGIVKVAAVKAPGFGDRRKAMLQDISILTAGSVISEELAMELEKSTLEDLGQAKRVVISKDPTTIIGGIGQKFDIQNRISQIRQQINEATSDYDKEKLNERLAKLSGGVAVLKVGAAPEVEMKEKKARVEDALHATRAAVEEGVVPGGGVALVRVAAKISNLLGQNEDQNVGIRVALRAMEAPLRQIVSNSGEEPSVVTNNVKDGKGNYGYNAATDEYGDMIRFGILDPTKVTRSALQYASSVAGLMITTECMVTDLPKEEKSDLSN

SEQ ID NO: 1260 - protein, 628 aa, Bordetella bronchiseptica
MCGVLGAWWRHHDEHEDARFAAGLRKLAHRGPDDRGSEHFAAPHGRLSLGHTRLAVIDLSAAGHQPMHADADRLAVVFNGEIYNYRELRSELRQIGASFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGQAGEPMAWDDPASQECRPIGFQEAAEELRARFLDNVRLHLRSDVPIGAALSGGIDSSAIVCAMRWLEPDLPIQTFSFISDDTHRSEERWVDLVNQHCGATGHKIHIAPHELLDDLDDLIRVQGEPVGSTSIYAQYRVFKLAREHGVVVTLDGQGADELLGGYGGYPTERLASLLETGRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALSLPERYLVSDSGQTKHIFRKAMRGIVPDSILDRDDKIGFATPEQQWMQATAPQMRQWLVDAADIPFLRNAEVTAQFDAMIAGATPFSWQAWRWVNFQRWMQHATVLP

SEQ ID NO: 1261 - protein, 241 aa, Sinapis alba
MGRGRVQLKRIENKINRQVTFSKRRSGLLKKAHEISVLCDAEVALVIFSSKGKLFEYSTDSCMEKILERYDRYLYSDKQLVGRDISQSENWVLEHAKLKARVEVLEKNKRNFMGEDLDSLSLKELQSLEHQLHAAIKSIRSRKNQAMFESISALQKKDKVLQDHNNALLKKIKEREKNTVHQEVQLIQCSNNSSILQPQYCLTSSRDGFVGRVEGENEGASSLAEPNSLLPAWMLRPTTNE

SEQ ID NO: 1262 - protein, 121 aa, Arabidopsis thaliana
  misc_feature (71)..(71): Xaa can be any naturally occurring amino acid
  misc_feature (99)..(99): Xaa can be any naturally occurring amino acid
  misc_feature (114)..(114): Xaa can be any naturally occurring amino acid
GQLAATPADVIEHPNAYAFVVDMPGIKGDEIKVQVENDNVLVVSGERQRENKENEGVKYVRMERRMGKFNXRKFQLPENADFGQDLLLFCHDGVLKGYXVQKLPSLPEPKKPKXNSKFKLP

SEQ ID NO: 1263 - protein, 617 aa, Desulfitobacterium hafniense
MCSILGLVNFKRKISPQEIQCLSTMGKTLIHRGPDQNGLEYGEHFAFQHNRLAIIDIEKGRQPMTATHQGYDYTIVYNGELYNTADLRQELLEHGVKFKTYCDTEVVLYAYIIWGEQCSSKLNGIYAFVIYDSKEKKTYLSRDRFGVKPFFYTFVEGALLFASEIKALLKHPQVKPRLDYQGLWQLLYMMPVKEEGTAIFKDIFELPTASHAFYSLAPGASEAELKIAKYWTMEAYENQDSEAAIVATTRDLLVDAIERQLVSDVPLCTFLSGGLDSSIITAVAAQKYQAEGRQLATYSFEHEGNKDHFKQTLFQPQSDDEFAVYLAQHLHTQHQILTAKKEHLVDYLDEAVRYRDYPGMADIDSSLLFYCRQVKEHHTVALSGECSDEVFGGYPWFYRPEMLTRGFFPWIHEPHARISLFKPELVRPQEGFAYTSEIYRRSVEACPLLPDESETMQNSRIASWLSINYFMTSLLERKDRMSMASGLEVRVPFSDHRLVQYVYNVPWEIKFKDGVEKALLRAAMQDYLPPKILYRKKSPFPKTHDPHYEELVFHLFRKRLDSGSGMLAELLQKDVLNRLISPGNNTWFGQLMGLPQLLAWLVQLDYWFEAYQVQLVG

SEQ ID NO: 1264 - protein, 527 aa, Lycopersicon peruvianum
MEPNSSGSGKAAVGDGGGGGAPMLQPAPAPAPMPSANAPPPFLVKTYDMVDDPSTDKIVSWSPTNNSFVVWDPPEFAKDLLPKYFKHNNFSSFVRQLNTYGFRKVDPDRWEFANEGFLRGQKHLLKSISRRKPAHGHAQQQQQPHGHAQQQMQPPGHSASVGACVEVGKFGLEEEVERLKRDKNVLMQELVRLRQQQQSTDNQLQGMVQRLQGMELRQQQMMSFLAKAVNSPGFLAQFVQQQNESNKRIAEGSKKRRIKQDIESQDPSVTPADGQIVKYQPGINEAAKAMLRELSKLDSSPRLENFSNSPESFLIGDGSPQSNASSGRVSGVTLQEVPPTSGKPLLNTASAIAGQSLLPATSEMQSSHLGTCSEIINNQLSNIIPLVGGEDLHPGSLSASDMIMPELSQLQGILPENNTDVIGCDSFMDTIAVEGKMGLDIGSLSPGADIDWQSGLLDEIQEFPSVGDPFWEKFLQSPSSPDAAMDDDISNTSETKPQINGWDKTQNMEHLTEQMGATNIKQQKHMI

SEQ ID NO: 1265 - protein, 236 aa, Photobacterium profundum
MPISTNTYQEWYQFRKRGRMSLQFEIVPVTPFQQNCSIVWCDETKEAAIVDPGGDIHLLKAKVQQLGLNVTQLLLTHGHLDHVGGTAPLAAELDVPIIGPHKDDAFWLEGLPRQSEMFGFPLTEAFAPTQWLSEGDEITIGNQKLQVIHTPGHTPGHVILFNDDAKVAFVGDVLFKGGVGRTDFDQGDYQTLIDSIKGKLWPLGNDVTFVPGHGPLSTFGHERVSNPFVADEMPLY

SEQ ID NO: 1266 - protein, 248 aa, Lycopersicon esculentum
MDFQSDLTREISPQRKLGRGKIEIKRIENTTNRQVTFCKRRNGLLKKAYELSVLCDAEVALVVFSNRGRLYEYANNSVKATIERYKKACSDSSNTGSVSEANAQYYQQEASKLRAQIGNLMNQNRNMMGEALAGMKLKELKNLEQRIEKGISKIRSKKNELLFAEIEYMQKREVDLHNNNQYLRAKIAETERAQHQHQQMNLMPGSSSNYHELVPPPQQFDTRNYLQVNGLQTNNHYPRQDQPPIQLV

SEQ ID NO: 1267 - protein, 238 aa, Oryza sativa
ENTMNRQVTFFKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 1268 - protein, 514 aa, Oryza sativa
MMLKDLAEIQQQQLLAAAEENMSNLTSASGDQASVSSHPAPPPAKKKRSLPGNPDPEAEVIALSPRTLMATNRYVCEICGKGFQRDQNLQLHRRGHNLPWKLKQRNPKEVVRKKVYVCPEAGCVHHDPARALGDLTGIKKHFSRKHGEKKWKCDKCSKRYAVHSDWKAHSKVCGTREYRCDCGTLFSRRLSWPPPPPPPWPSSEVLMIGLRCGCRRDSFITHRAFCDALAEESARAVTAAAAVAGQQQHGGGMLFSQVADVLDHQAAMAMGGHGLMQELCLKREQQQQQQQFAPSWLTAQQQQQQLEAMAGAGNPAAMYGSARLDQEFIGSSTPESGGAQQAGLSFGFSSTSSAPPHPAASSAHMSATALLQKAAQMGATLSRPSSHAHMAAAAAASTHNSSSSAATTNAPPPPPTSNVSSTCVGAGGYGLAFEASHFIAADESSRGARSDRDTGNGVAGAGNDGLTRDFLGLRAFSHGNIMSMAGFDPCMSTTSASSAAPYDHHHHSNKPWHS

SEQ ID NO: 1269 - protein, 193 aa, Arabidopsis thaliana
MEEKKTESATKNVKKVNLLDHIAIKHLLDESVSDIVTSRGYKEDVRLSNVKFLLGGIIIVVALVAQFYNKKFPENRDFLICCIGLYVVLTAVMQLILYIKEKNAILFTYPLEGSFTSTGLVVSSKLPRFSDQYTLTIDSADPQSISAGKSVQFTKSVTQWLTKDGVLVEGLFWKDVEALVKEYTEAGEPKKKR

SEQ ID NO: 1270 - protein, 248 aa, Nicotiana tabacum
MDFQSDLTREISPQRKLGRGKIEIKRIENTTNRQVTFCKRRNGLLKKAYELSVLCDAEVALIVFSSRGRLYEYANNSVKATIERYKKACSDSSNTGSISEANAQYYQQEASKLRAQIGNLQNQNRNMLGESLAALSLRDLKNLEQKIEKGISKIRSKKNELLFAEIEYMQKREIDLHNNNQYLRAKIAETERAQQQQQQQQMNLMPGSSSYELVPPPHQFDTRNYLQVNGLQTNNHYTRQDQPSLQLV

SEQ ID NO: 1271 - protein, 464 aa, Listeria monocytogenes
MTYKFPENFWWGSAASGPQTEGAANVDGRKPSIWDHWYKIEPGRFFNDVGPTNTSNFYYQYKEDIALMKQTGHNSFRTSIQWSRLIPDGIGEVNPKAVDFYNRVIDEMLANDVEPFMNLYHFDMPMSMQEKGGFESREVVDAYATFAKTCFELFGDRVKHWFTFNEPIVPVEAGYLYDMHYPNVVDFKRATQVAYHTTLAHALAVKEFHALEIPEGQIGIILNLTPSYPRSQNPADLKAAHIADLIFNRSFLDPVTKGEFPADLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGSNCHGYHLWTFMDCWSWANAYKNRYGLVEVDLDNNFKRTIKASGHWYKELSENNGFED

SEQ ID NO: 1272 - protein, 310 aa, Ashbya gossypii
MVRVMQKEDCHFRRLSDGTQIPSVGLGVYQVSEQTVQDLVYEALEVGYRLFDSAQAYHNEDGVARGIAAWLKHAPGRRREDVYFTTKINTQNHGYEATKKSLEKSLHAAGPLGYIDLVLVHAPMSDRTRRLGTWQALEEAVVEGQVRSIGVSNYGQQHLSELLGWEGLKIRPVVNQVEINPWLCRQELVQYCRENNIAVQAFSPLMRGKRLDDPILQKVAHQYDKGVAQILVRWSIQMGFIVLPKAAKKERLAPNFDIWDFELSAETMSELTHSDDYFVTVPGGIPRLMKAEVISTITDLQHETLVDMEA

SEQ ID NO: 1273 - protein, 95 aa, Unknown
  Fagopyrum sp. C97106
GRLYEYANHSVKATIDRYKKACSDSAGVTSVAEANAQYYQQEAAKLRNQIRTLQNNSRNLSRHMMGEGLSSLSMKDLKNLEARLEKGISRIRAKK

SEQ ID NO: 1274 - protein, 95 aa, Unknown
  Fagopyrum sp. C97107
GRLYEYANHSVKATIDRYKKACSDSAGVTSVAEANAQYYQQEAAKLRNQIRTLQNNSRNLSRHMMGEGLSSLSMKDLKNLETRLEKGISRIRAKK

SEQ ID NO: 1275 - protein, 491 aa, Nicotiana tabacum
MVLSKTSSESDVSVHSTFASRYVRTSLPRFEMAENSIPKEAAFQIINDELMLDGNPRLNLASFVTTWMEPECDKLMMDSINKNYVDMDEYPVTTELQNRCVNMIARLFNAPLEEKETAVGVGTVGSSEAIMLAGLAFKRNWQNKRKAEGKPYNKPNIVTGANVQVCWEKFANYFEVELKEVKLREGYYVMDPVQAVEMVDENTICVAAILGSTLNGEFEDVKLLNDLLIEKNKQTGWNTPIHVDAASGGFIAPFLYPELEWDFRLPLVKSINVSGHKYGLVYAGIGWVIWRTKQDLPEELIFHINYLGADQPTFTLNFSKGSSQVIAQYYQLIRLGYEGYRNVMENCRENAIVLREGLEKTGRFNIVSKDEGVPLVAFSLKDNSRHNEFEVSETLRRFGWIVPAYTMPADAQHVTVLRVVIREDFSRTLAERLVLDIVKVLHELDTLPARLSAKLEEVKLVKNGKKFELEVQREVTNYWKKFVLARKAPVC

SEQ ID NO: 1276 - protein, 371 aa, Brucella melitensis
MASLFDPITIGDLKLANRIVMAPLTRNRSPHAVPNDLNVIYYEQRASAGLIITEATPISQQGQGYADVPGLYSAEQLAGWRRVSDAVHNAGGKIVAQMWHVGRISHNSLQPNGEKPVAPSAITAKSKTYLVHPDGAGEFVPTSEPRALEKSELPGIVADYARAAKDAVETAGFDGVEIHSANGYLIDQFLRGGSNQRTDEYGGSIENRARFLFEVVDAVTKAIGAGKVGIRLSPVTPANDASDPDPQPLFDYVIGKLAACGLAYIHIIEGATGGPRDFQQGPQPFDYARFKQVYRDAGGKAAWMVNNGYDRKMAEEEVEAGRADLVAFGKPFIANPDLVRRLKENAPLNELDQKHMYGGGAKGYTDYPVLA

SEQ ID NO: 1277 - protein, 1123 aa, Stellaria longipes
MASPAQSQSSTNSGRSKHSARIIAQTIQDAKLHAEFEESSNEFDYSSSVRGSTSGVNQLPQSDKVTSSYLLQIQKGKFIQPFGCLLALDDKTFRVIAFSENAPEMLTMVSHAVPSVGDLPVIGIGTDIRTIFTDPSASALQKALGFTDVSLLNPILVHCKNSGKPFYAIVHRVTRSLVIDFEPVKPYEVPMTAAGALQSYKLAAKAITRLQSLPSGNMDRLVDTMVQEVFELTGYDRVMAYKFHDDDHGEVVSEVTKPNLDSYLGLHYPATDIPQAARFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELESQFLEKKILRTQTLLCDMLMRDAPLGIVTQNPNVMDLVKCDGAALLYNNKIWKLGISPTDYQLRDIAGWLSRDHTDSTGLSTDSLHDAGYPGARSLGDTVCGMAAVRITLNNMLFWFRSHTAAEVKWGGAKHETGEKDDGSKMHPRTSFKAFLEVVKRRSVPWKDYEMDAIHSLQLILRNAFKDVEASDLNTSVIHSKISDLQINGLRELEAVTSEMVRLIETATVPILAVDADGLVNGWNTKIFELTGVPVAEAVGKHIASLAEESSIDNVKRMLQLALQGEEKKNVQFEIKRHQSNPDSSPISLVVNACASKDVNGNVVGVCLITQDITGQKTVMDKFTRIEGDYKAIIQSPNPLIPPIFGTDEFGWCSEWNPAMAKLTGWSREEVIDKMLLGEVFGTQKSCCRLKNQEAFVNFGIILNGAMSGQNTDKLPIEFFTRFGKYIECLLCVNKKLDGDGAVTGVFCFLQLASHDLQHALHIQRLAEQAATKRAKALAYMKRQIKNPLSGIMFSGKILDGTEMGEDQRQVLQTSIRCQGQLNKILDDSDLDSIIDGYCELEMVEFTVQDILVASTCQVMAKSNEKGIQIANDSTTEHGLKETLYGDSLRLQQILADFLWISVNFTPAGGNVGIKVRLTKDKIGESIQHANLEFRISHTGGGISEELLSQMFENQGEVSEEGISLLVSRKIVKLMNGDVQYLRSAGSSTFIISVELAIAGNSL

SEQ ID NO: 1278 - protein, 178 aa, Brassica napus
VDPRVRNNPGGLVKVGLDVAQLWLDGDETLVYTIDREGVTSPINMIDGHAVTHDPLVVLVNEGSASASEILAGALHDNGRAVLVGRRTYGKGKIQSVTELDDGSALFVTVAKYLSPSLHEIDQVGITPDVQCTTDKIDSLTGEILMKMNSSVPLLEADSCVMVAEHELETKQSSGAAS

SEQ ID NO: 1279 - protein, 1122 aa, Stellaria longipes
MASPAQSQSSTNSGRSKHSARIIAQTIQDAKLHAEFEESSNEFDYSSSVRGSTSGVNQLPKSDKVTSSYLLQIQKGKFIQLFGCLLALDDKTFRVIAFSENAPEMLTMVSHAVPSVGDLPVIGIGTNIRTIFTGPSASALQKALGFTDVSLLNPILVHCKNSGKPFYAIVHRVTRSLVIDFEPVKPYEVPMTAAGALQSYKLAAKAITRLQSLPSGNMDRLVDTMVQEVFELTGYDRVMAYKFHDDDHGEVVSEVTKPNLDSYLGLHYPATDIPQAARFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELENQFLEKKILRTQTLLCDMLMRDAPLGIVTQNPNVMDLVKCDGAALLYNNKIWKLGITPTDYQLRDIAGWLSRDHTDSTGLSTDSLHDAGYPGARSLGDTVCGMAAVRITPNDMLFWFRSHTAAEVKWGGAKHETGEKDDGSKMHPRTSFKAFLEVVKRRSVPWKDYEMDAIHSLQLILRNAFKDVEASDLNTSVIHSKISDLQINGLRELEAVTSEMVRLIETATVPILAVDADGLVNGWNTKISELTGVPVAEAVGKHIASLAEESSIDNVKRMLQLALQGEEKKNVQFEIKRHQSNPDSGPISLVVNACASKDVNGNVVGVCLIAQDITGQKTVMDKFTRIEGDYKAIIQSPNPLIPPIFGTDEFGWCSEWNPAMAKLTGWSREEVIDKMLLGEVFGTHKSCCRLKNQEAFVNFGIILNGAMSGQNTDKLPIEFFTRFGKYIECLLCVNKKLDGDGAVTGVFCFLQLASHDLQHALHIQRLAEQAATKRAKALAYMKRQIKNPLSGIMFSGKILDGTEMGEDQRQVLQTSIRCQGQLNKILDDSDLDSIIDGYCELEMVEFTVQDILVASISQVMAKSSEKGIQMSNNCTEHGFKETLYGDSLRLQQILADFLSISVNFTSPGGHIGVTVRLTKDKIGESVQLANLEFRIMHTGGGISEELLSEMFESRGNASEDGISLLISRKLVKLMNGDIQYLRSAGTCTFIIYVELAVADNSS

SEQ ID NO: 1280 - protein, 671 aa, Thermobifida fusca
MRSTPNQQENSVPTGDGTRFPHLFSPFQIGPMRLRNRVMAPPHSSAIGNLWGTDEKEVERTFAYWRSRVSGDGPAWVGGVTGRVRNILIPGFEPHGYGAETTGYFRQPFYVERIGRFVEEMHALGAVVTTQLTLLGGVPHAPSPRRSSTLYNHRPHVLSTHEIAEFVEEYRFSASQARKAGLDGIELHLNHDDLLEWFLSPLTNQRTDAYGGSLENRARFAVEVLTAVREEIGSDMALGVRFNLREEEPGGYTLADGIEIAQYLESTGLLDFLHAVIGSPWGDPSYIQPYFYQPAQWADLAGQLRRSVSLPVIYTGRINSVEVAEKVLADGNADVVGMARAFIADGDILRKAREGRLADIRPCVGGNECITRRYVDKLPFGCAVNPHTSNEIDGPWKQAANPRRILVVGGGPAGMELAALTAESGHTVELWEATDKLGGQLRTILNAPFQEQMARYLEWQERRLEKAGVTVRRNTRATADTVAEAGFDVVAVATGARPRRPAEIEGVDQDYFVYDIRDVLLGNVAVGQEVLVVAQDDHLPPLIVADYLSDRGHDVTIVYPTAGPAPMLGRYILGGMLARLTSRGVQFRFMEDVIGIEEERIRIRHTYSHQESELGAFDSVVLACGGDADSSLYEELRGRVPELHILGDAFAPTRLVAVTRQAYALAKELQK

SEQ ID NO: 1281 - protein, 504 aa, Glomerella cingulata
MGSDEKSPSTYRYDETPTYTTSNGAPVANPQHWQRPGPSGPLLLQDFHLIDLLAHFDRERIPERVVHAKGAGAYGEFEVTHDISDIASIDMLKEVGKKTKAVVRFSTVGGEKGSADSARDPRGFASKFYTDEGNWDWVYNNTPIFFIRDPSLFPVFIHTQKRHPRTNLKDATMMWDYWSTHQECVHQLMHLFSDRGTPYSYRHMNGYSGHTHKWTKPDGSFVYVQIHLKTDQGNKTFTNEEAAKLASENPDWHTQDLFESIQRGEHPSWTVYVQTLTPEQAEAFRWNVFDLTKVWPQSEVPLRPFGRLTLNRNPDNYFAEIEQVAFSPSHLVPGVEPSADPVLQSRLFSYPDTHRHRLGVNYQQIPVNRPLNAFNPHQRDGAMSVDGNYGANPNYPSSFRPLNYKPVKAAGAHKQWAGKVVEDLFGPVTAQDYEQAAGLWAVLGRQDGQQRNFVLNVSGALAGARADVRARVYDMFSKVDAGLGAAIETETEAVAKPADVRSKL

SEQ ID NO: 1282 - protein, 461 aa, Burkholderia fungorum
MTFLKSPPPTPEDVADEYAATISGSSLPKYRIPEASSDRRAVFDLVRDELFMDGNSRQNVATFCTTYADDEVRHLMDLSIDKNMIDKDEYPQTAEIEMRCVHMLADLWHASKAWKTTGCSTTGSSEACMLGGLALKWQWKKRREAQGKPTDKPNFVCGPVQVCWAKFARYFDVEMRQVPLRGEATGLTPEDLAEYCDENTIGVVATLGITFTCVYEPVKALAGALDALQANVGLDIPIHVDAASGGFVAPFIQPDLEWDFSVPRVKSINASGHKYGLAPLGVGWVVWRSTQDLPDELIFRVDYLGGDMPTFALNFSRPAGQIIAQYYMLLRLGREGYRRIQQECADTAQALADGLAKIDQLEMIYDGRGALPAVCYKLKHPETAGFTLFDLSDQVRMRGWQIASYELPAGREDTIVQRVLIRRGVTRDMAAMLLEDIRHAIGHLTKNPVLHSSAGPTFHHN

SEQ ID NO: 1283 - protein, 492 aa, Zea mays
MLVQHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVAVGGANHSHATKDLTDAIAAGNFPEWTLYIQTMDPEMEDRLDDLDPLDVTKTWPEDAFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 1284 - protein, 153 aa, Chorispora bungeana
MNSVSAFSEMFGSDYEPQGGDYCPTLATSCPKEPAGRKKFRETRHPIYRGVRQRNSGKWVSEVREPNKKTRIWLGTFRTAEMAARAHDVAALALRGRSACLNFADSAWRLRIPESTCAKDIQKAAAEAALAFQDETCDTTTTNHGLDMEGRCG

SEQ ID NO: 1285 - protein, 142 aa, Unknown
  uncultured bacterium 582
MGLKYLHTMVRVKNLETSLAFYTLLGLKETRRKESENGRFTLIFMAPDGQEDRPIELTYNWDGDDGLPNDSRHFGHLAFGVDNIYETCAHLQANGVTINRPPRDGHMAFIRSPDNISIELLQNGPPLEGAEPWLSMGNTGHW

SEQ ID NO: 1286 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVTAGDIMSYHLEEYDILHQRSLFNEARIAVTLIRGNHYFKASKTMNQQGEPYKVFTSFYKKWRPYLRHRDVYHYDLKSFEDFVIASPDDLVFDDIAFGSSQIIEQNKWQHFLDQDIQNYESGRDYLPEVLTSQLSVALAYGLLDIIEIFNDLLARYDEDEANYEAFIRELIFREFYYVLMTQYPETSYQAFKPKYRQIKWSQNEADFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDAKALYIKTYLPIFNQIDAKYLHDTQRNESNLFEQGIELGSHYPRQIVDHQEKRTQVLATFKALD

SEQ ID NO: 1287 - protein, 482 aa, Geobacillus kaustophilus
MKKSTTAALMAISMLIGAGGTYAGLQLADRPMEGSLSTIVSNEPSKSTNDSEEMKKIRQAYELIKNRYVEKVDEEKLTEGAIQGMINTLHDPYSVYMDAETTEQFNESLDSSFEGIGAEVSMIDGKVTIVAPIKNSPAEKAGLKPNDQILRVNGESLEGLDLYEAVLKIRGKKGTTVELDILRPGVKNVMKVKVVRDEIPIQTVYDSIKTYNGKKAGYLQITSFSENTAADFKKKLAKLEAEHIDGLIIDVRGNPGGYLQSVEEILKQLIPKGKPYVQIEERDGDRQKFYSDLTAKKPYPIVVLIDKGSASASEILAGAMKEAGGYKLVGETTFGKGTVQQAIPMGDGSNIKLTLYKWLTPDGHWIHKKGIKPDVAVVQPDYFHVAPLHVEKPLRYDMNDEQIANAQKMLKGLGFNPGRTDGYFSKETEQAVQAFQKANQLPVTGRIDEATADALQTKIMEAVRDPNHDVQLKKALGVLFPS

SEQ ID NO: 1288 - protein, 544 aa, Bartonella bacilliformis
MAAKEVKFGRDARERLLRGVDILADAVKVTLGPKGRNVVIDKSFGAPRITKDGVSVAKEIELENKFENMGAQMLREVASKTNDIAGDGTTTATVLGQAIVQEGVKAVAASMNPMDLKRGIDAAVEAVVADLFKKAKKIQTSEEIAQVATISANGAEDIGKMIADAMEKVGNEGVITVEEAKTAETELEVVEGMQFDRGYLSPYFVTNSEKMMVDLDDPYILIHEKKLSNLQSLLPVLEAVVQSGKPLLIIAEDVEGEALATLVVNKLRGGLKIAAVKAPGFGDRRKAMLEDIAVLTSGQVISEDVGIKLENVTLEMLGRAKKVHVSKETTTIVDGAGQKSEINARVSQIKAQIEETTSDYDREKLQERLAKLAGGVAVIRVGGSTEVEVKEKKDRVDDALNATRAAVEEGIVPGGGTALLRAAKALSIKGKNPDQEAGIGIIRRALQAPARQIAHNAGEEAAVIVGKVLENCSDTFGYNTATAQFGDLISFGIVDPVKVVRSALQNAASIASLLITTEAMVAEVPKKEAAAPAMPGGGMGGMDF

SEQ ID NO: 1289 - protein, 687 aa, Sinorhizobium meliloti
MAKKPSAPNNTKPATIHDQKATRGNGGELHQIAEGDTPVLTTAQGGPVADDQNSLRAGERGPTLIEDFHFREKIFHFDHERIPERVVHARGYGVHGFFETYESLAAYTRADLCQHPGERTPAFVRFSTVAGSKGSFDLARHVRGFAVKIYTKEGNWDLVGNNIPVFFIQDAIKFPDVIHSVKPEPHREFPQAQSAHDNFWDFISLTPESMHMIMWVMSDRGIPRSFRFMEGFGVHTFRFVNAKDESTFVKFHWKPKLGLQSLVWNEAVKINGRDPDFHRRDMWQAIQSGNFPEWDLHVQLFDQDFADKFDFDILDPTKVIPEEVLPTKPVGRLVLDRMPENFFAETEQVAFMTQNVPPGIDFSDDPLLQGRNFSYLDTQLKRLGSPNFTHLPINAPKCPFQHFQQDGHMAMRNPVGRVNYQPNSWSEGPKLRIRAESFADHYSQARQFFISQTPPEQRHIADALTFELSKVETPVIRERMVAHLLNIDETLGKKVGHALGLETMPKPADAAVATRQDLDPSPALSIIQRGPKRFEGRKLGILATDGADGALLDALIGAVENEKAAFELIAPKVGGFTASDGKRIAAHQMLDGGPSVLYDAVVLLPSAEAVADLIDVATARDFVADAFAHCKYIGYAGAAVPLLERAGIAELLDEGTIELTDAASAAAFLTEIGKLRVWGREPSVKLK

SEQ ID NO: 1290 - protein, 163 aa, Zea mays
MSLIRRGSAFDPFSLDLWDPFQGLFPFGSGSSSSSSLFPSFGGTTTSSETAAFAGARVDWKETPEAHVFKTDVPGLKKEEVKVELEDGNVLQISGERCKEQEEKTDTWHRVERSSGKFLRRFRLTENARTEQISASMENGVLTVTVPKEEAKKADVKSIQISG

SEQ ID NO: 1291 - protein, 306 aa, Cryptococcus neoformans
MLGRVGGAKEDETWTKTVSMRMFLPLLLEDGGGRRPPRRSGARKVNDVAFANGVPIYTSRRTRSKKYLMVIPSSHCATATQPLSHTTMSLIHALIARGTTVLAEHATGTAELKPAAQITILSKIPPNNSKLTYVWQDRLIHYVSSNGVIYLVMADDSVGRRMPFAFLADLERRFTAQYESDDIVSAGAHSLEEFEPELAKLMHQYTSSPPADPLRQAQSDLNNVKDIMVQNIDSILQRGERLDLLVDKTDTLAGQAYAFRRGARSVRRQQWWKNMRIMALSGVVGLLLLYLFIAQFCGASLGHCRS

SEQ ID NO: 1292 - protein, 263 aa, Oryza sativa
MLHVVYRVGDLDKTIKFYTECLGMKLLRKRDIPEERYTNAFLGYGPEDSHFVVELTYNYGVESYDIGTAFGHFGIAVEDVAKTVDLIKAKGGTVTREPGPVKGGKSVIAFIEDPDGYKFELIERGPTPEPLCQVMLRVGDLDHAINFYEKAFGMELLRKRDNPQYKYTIAMMGYGPEDKNAVLELTYNYGVKEYDKGNAYAQIAISTDDVYKTAEVIRQNGGQITREPGPLPGINTKITACTDPDGWKTVFVDNVDFLKELEE

SEQ ID NO: 1293 - protein, 152 aa, Picea glauca
MAMDPSLITVQHLLGVPDDLEKLLNAPTHSYMRDTKAMASTPVDVKEYPNSYVFIIDMPGLKSNDIKVQVEDENVLNISGERKRNEKDEEGEVKYIRMERRVGKFMRKFTLPADCNLEAISAACQDGVLTVTVPKLPPPEPKKPKTIEVKIG

SEQ ID NO: 1294 - protein, 314 aa, Arabidopsis thaliana
MAEEIRFFELNTGAKIPSVGLGTWQADPGLVGNAVDAAVKIGYRHIDCAQIYGNEKEIGLVLKKLFDGGVVKREEMFITSKLWCTYHDPQEVPEALNRTLQDLQLDYVDLYLIHWPVSLKKGSTGFKPENILPTDIPSTWKAMESLFDSGKARAIGVSNFSSKKLADLLVVARVPPAVNQVECHPSWQQNVLRDFCKSKGVHLSGYSPLGSPGTTWLTSDVLKNPILGGVAEKLGKTPAQVALRWGLQMGQSVLPKSTHEDRIKQNFDVFNWSIPEDMLSKFSEIGQGRLVRGMSFVHETSPYKSLEELWDGEI

SEQ ID NO: 1295 - protein, 281 aa, Lactococcus lactis
MQRKLTLNDGNVIPQFGLGLYQLPEGTETQNIVKTALELGYRHLDTSHAYQNETSVGQAIQDSEISNSEIWITSKLWPSDYEQAPEAIERMLKRLKVKQIDLLLLHQQVGNYRKAWIALENAVKEGKVKSIGISNFDGERLVDLFNFADIKPSVIQVETHPYHQQVELQEFLKPYGTKIESWYPLGHGDKNLLEEKIFKKMAKKYNKTVAQIILRWHIQEGIIVFPRSTQKEHLAENINIFDFELSCSEIKEIRKLNKKQPYFTMTYEEQEKNFLSWKLED

SEQ ID NO: 1296 - protein, 572 aa, Magnaporthe grisea
MVLSRHVNPDDIVQHLHNSSLKEQDGDNDTRTQAAISHLTPYSSRYASNVSLPKYKLPKEGAEADTVYSMIRDELDLDGKPNLNLASFVGTYLEDNAQKLMVENIAKNLSDADEYPAMISMQQRCVSILAHLWNVQKGEKAIGSATTGSSEAIQLGGLAMKRRWQEARRAAGKDDSKPNIIMGANAQVALEKFARYFDVEARILPVSEKSRYRLDADMVRDNIDENTIGIFIILGSTYTGHYEPIEEISEILDKYQAETGHDIPIHVDGASGAFIAPFTHAQAGGPKWDFSLPRVKSINTSGHKYGLVTAGVGWIVWRDESFLPKHLIFELHYLGGTEESYTLNFSRPGAQVITQYFNLVHLGFSGYRAIMENCLANARLLSKSLEATGWYTCVSDIHRRVETAGSNGSNGKQKEPEVTPEHAKETSADYVAGLPVVAFCFSDEFRRQFPHVKQETVSVLLRARQWIIPNYALPPNEEKTEILRVVVRESMSLDLLDRLLSDICEVTQKLMDEDELDLNVLQGSRHKGPCTKADVSKEGRAQAKKERDDRHKKHQATGRTGRMETGVHRSTC

SEQ ID NO: 1297 - protein, 551 aa, Unknown
  Magnetococcus sp. MC-1
MAAKEVKFGEAARAKMLNGVNILANAVKVTLGPKGRNVVLDKSWGAPRMTKDGVSVAKEIELEDKFENMGAQMVREVSSKTADVAGDGTTTATVLAQAIIREGMKAVAAGMNPMDLKRGIDLAVEAVVVGLKGISREVANSQEIAQVGAISANSDKVVGDMIAEAMDKVGKEGVITVEEAKGLETTLDVVEGMQFDRGYLSPYFVTNADKMLVQMENPLILLVEKKISNLQQILQILEGAVQSSRPLMIIAEDVEGEALATLVVNKLRGGLKVCAVKAPGFGDRRKAMMEDIATLTGGVLVSEDVGVKLENVTMDMLGMAKSIVVTKEDTTIIDGAGDHEAIKARVNQIRAQIEETSSDYDREKLQERLAKLAGGVAVIKVGGATEVEVKERKDRVDDALHATRAAVEEGIVPGGGVALLRAREASLTNLQGANHDQQVGINIVTRALEEPLRIIASNAGAEGSVVVNRVVETKETNFGFNAATGVYEDLVASGVIDPAKVVRHALQAAASVAGLMITTEAMVAELPKDEPAMPGGDMGGMGGMGGMGGMM

SEQ ID NO: 1298 - protein, 531 aa, Burkholderia fungorum
MVEGVNILANAVKVTLGPKGRNVVLERSFGGPTVTKDGVSVAKEIELKDKLQNMGAQMVKEVASKTSDNAGDGTTTATVLAQSIVREGMKYVASGMNPMDLKRGIDKAVFAAIEELRKISKPCTTNKEIAQVGAISANSDSSIGDRIAEAMDKVGKEGVITVEDGKSLQDELDVVEGMQFDRGYLSPYFINNPDKQVAVLENPFVLLHDKKVSNIRDLLPILEQVAKAGRPLLIIAEDVEGEALATLVVNNIRGILKTVAVKAPGFGDRRKAMLEDIAILTGGQVIAEETGLTLEKATLAELGQAKRIEVAKENTTIIDGAGEAANIEARVKQVRTQIEEATSDYDREKLQERVAKLAGGVAVIKVGAATEVEMKEKKARVEDALHATRAAVEEGIVAGGGVALIRARTAIAGLKGANADQDAGIKIVLRAMEEPLRQIVTNGGEEASVVVAAVAAGTGNYGYNAATGEYVDLVDAGVVDPTKVTRTALQNAASVAGLLLTTDAAVCELPKEDAPMAGGMPGGMGGMGMDM

SEQ ID NO: 1299 - protein, 349 aa, Unknown
  Nostoc sp. PCC 7120
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPIGRYTLLYDPIDGSSNTDTNLSLGSIFSIRQQEGDDSDGQAKDLLTNGRKQIAAGYILYGPSTMLVYTMGTGVHSFTLDPSLGEFILSEENIRIPDHGAVYSVNEGNFWQWEESMREYIRYVHRTEGYTARYSGAMVSDIHRILVQGGVFLYPGTIQNPEGKLRLLYESAPLAFLIQQAGGRATTGLVDILDVVPKKLHQRTPLIIGSKEDVAKVESFIQNGH

SEQ ID NO: 1300 - protein, 169 aa, Triticum aestivum
SLYQNSSEELSAVHASDYDHFHANPQNSSHEKFISSHSNSVHALDQLRTIKNKASSSSQFVKKMMASLPYTCQSQSPSPYFDLSIFRYDEKLFSAIDRHRHCTEHPIKFISVRQPNVVKFKIKPGSDSGASDSRGKRISSFLFHPFFPLALSIQQTNMQPTVVNVHFRR

SEQ ID NO: 1301 - protein, 404 aa, Haemophilus influenzae
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEEANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIRSDEKMVLDLLRQEKVLLVHGKGFNWHSPDHFRVVTLPYVNQLEEAITKLARFLSDYRQ

SEQ ID NO: 1302 - protein, 151 aa, Picea glauca
MAMDPLLNTVQQLLVVPDDLERILHAPTRSYMRDTEATASTPVDVKEYPNSYVFIVDMPGLKSNDIKVQVEDENILNISGERKRNEKEEGEVKYIRMERRVGKFMRKFSLPADCNLEAISAACQDGVLTVTVPKLPPPEPKKPKTIAVQIG

SEQ ID NO: 1303 - protein, 317 aa, Arabidopsis thaliana
MANIIFLDQPVGSGFSYSRTPLVDKISDTGEVKRIYEFLQKWLSKHQQFFSNPFYVGGDSYSGMIVPPLVQEIGKGNYQINLQGYILGNPITDTESEQNYQIPYAHGMALISDELYKSMERICKGNYVKVDSLNTKCYKLIKDYQKCIHKLNKYHILLPDCDITSPDCFLYRYTLITFWANNKSVREALQVNKGSIGKWVQCNYKNISYNYDIKSSVAYHMKNSIDGYRSLIYNGDHDMMVPFLATQAWIRSLNYSITDDWKPWMINDQIAGYTRSYSNKMTFATIKASLLGSGHTAEYKPKETSIMFKRWISAQPL

SEQ ID NO: 1304 - protein, 467 aa, Listeria monocytogenes
MTSVMWFRRDLRVNDNKALYHACKENDLLLLFQVNPAQFITGSPSHQAFFASVAHFKQEIDKTAHLQIMFGEPIECFQQLKDSLPSWDKVYFNRDETGYGAKRDEAAQAFFDEQKIEVQAFHDSYLHSAEEVKKSPTEYYKIFTPYYKKWREEIKETPFKVTLKHENIRKESLFLKYEEQFAEMTSDLPILDIGERAANTRLANFIKHDVADYDKARDFPELDKTSHLSRYLRTGEISIRTIWQSLQETEATEGRATFEKELCWRDFYNMIYVSFPNQKNEPIQENYRFIEWENNREYFKAWQEGKTGFPLVDAAMRQLKETGWMHNRLRMITASFLTKDLLIDWRFGEKYFQQMLIDYDPASNIGGWQWAASTGTDAVPYFRIFNPTTQSQKFDSTGKFIRKYVKELANLPDKYIHQPEKMSETEQKEHGLLLGKDYPFPIVDHKERRKLAIARYEFSKEHSRGNI

SEQ ID NO: 1305 - protein, 618 aa, Desulfovibrio desulfuricans
MCGIFGIISQLVPPSKRELETSCELLAHRGPDGYGYFIKGPVGFAHRRLSIIDIAQGSQPMSTQEGELTITYNGEIYNFRHIKASLVAKGYSFQTNSDTEVILAAYKEWGTECVQHLRGMFAFAIADHIRQTVFLARDPFGIKPLVYRESSLGFAFSSELPALVRLKKWPSVTVSPKAVSLFFRHQYIPAPYTIYNETQKLPPAHAMLVDFNGCIQQKWRYWTPAFHPSVTYSLQDAIKDAHNSVTESIDAHTLSDVPIGVFLSGGIDSTLVAARLAQRHSRSIPAFTIGYKESDFSELPYAQHAADKLGLKLYAQTLDEKALKFAPEILSHYGEPFGDSSVIPTWHVCKLASEHVPVCLSGDGADELFGGYQKYQIWSESTPWRQLQLAGSAIAKRKLRTAWWMLRRASRSFCDDKAFWLDHVQYYPPQGIRQLTHPDMHPYANAFAPAFDEPFLNIDKLGRFEYAQRMDLLSYLPDCLLAKVDLASMAHGLEVRPALLDKYVFQLAATLPTDVKLHPQKGGKVVLKELLLRQGFSEEFVYRPKQGFALPLRHWFISGQPANNMLCELVSSYKRELSEHLTVSDIERMLTAHSPACDYSGPLWLAFAFTCWVANTSK

SEQ ID NO: 1306 - protein, 749 aa, Ajellomyces capsulatus
MTSKVEEGLQRVKELVENMQPGEQKVADLARDTTDVNGCLPFTTDHGVKVSNTDFWLRLASENQTGPLLLEDQIAREKIHRFDHERIPERVVHARGTGAFGHFKLFESAADVTSAGVLTDTSRTTPVFVRFSTVQGSKGSFDTVRDVRGFATKFYTEEGNWDLVGNNIPVFFIQDAVKFPDFVHAVKPEPHNEVPQGQTAHNNFWDFVYMHPEATHMFMWAMSDRAIPRSYRMMQGFGVNTFVLVNKQGKRHFVKFHWMPELGVHSLVPDESFKLGGQDPDFHRKDLMEAIDNKVYPKWKFGIQVLPEEKEHDFDFDILDPTKIWPESLIPVRYIGEMELNRNVDEFFPQTEQVAFCTAHIVPGIEFSGDPLLQGRNFSYFDTQITRLGVNWEELPINRPVCPVMNHNRDGAMRHKITQGTVNYWPNRFEACPPTKPEDGGFVTYPQKVEQSIKARMLSSKFREHINQAQLFYNSLSEYEKLHVNNAFCFELDHCDDPIVYNRLVSRISEIDHALAQAVAVKVGAPTPPRPGRDNPGQTTINLSQKYINDRQLSSPTIKGRRIAILIGDGYDSVAFGTVIAAVSAMGALPFIIGTKRQPIFADDEDRNHSKGVTPNHNYTSQRSTCFDATFIPGGSHIKELSQLGLIQHWVAEQFGHCKAIGATGEAINLIVQALSNLPDLEVASASSGHPVDWYGVVTSSKLHEPHSLTEGIKLFPEASDFLGKLFYQISQHRNYEREMAGLTDKVPF

SEQ ID NO: 1307 - protein, 444 aa, Thermotoga neapolitana
MKKFPEGFLWGVATASYQIEGSPLADGAGMSIWHTFSHTPGNVKNGDTGDVACDHYNRWKEDIEIIEKIGAKAYRFSISWPRILPEGTGKVNQKGLDFYNRIIDTLLEKNITPFITIYHWDLPFSLQLKGGWANRDIADWFAEYSRVLFENFGDRVKHWITLNEPWVVAIVGHLYGVHAPGMKDIYVAFHTVHNLLRAHAKSVKVFRETVKDGKIGIVFNNGYFEPASEREEDIRAARFMHQFNNYPLFLNPIYRGEYPDLVLEFAREYLPRNYEDDMEEIKQEIDFVGLNYYSGHMVKYDPNSPARVSFVERNLPKTAMGWEIVPEGIYWILKGVKEEYNPQEVYITENGAAFDDVVSEGGKVHDQNRIDYLRAHIEQVWRAIQDGVPLKGYFVWSLLDNFEWAEGYSKRFGIVYVDYNTQKRIIKDSGYWYSNGIKNNGLTD

SEQ ID NO: 1308 - protein, 728 aa, Ajellomyces capsulatus
MRSLKLILASASVVSATCPYMSGEMPNSQNGPLDRRHDTLSDPTDQFLSKFYIDDEQSVLTTDVGGPIEDQHSLKAGNRGPTLLEDFIFRQKIQHFDHERVPERAVHARGAGAHGVFTSYNNWSNITAASFLNAAGKQTPVFVRFSTVAGSRGSVDSARDIHGFATRLYTDEGNFDIVGNNVPVFFIQDAIQFPDLIHAVKPQPDSEIPQAATAHDTAWDFFSQQPSSLHALFWAMSGHGIPRSMRHVDGWGVHTFRLVTDEGNSTLVKFRWKTLQGRAGLVWEEAQALGGKNPDFHRQDLWDAIESGRYPEWELGFQLVNEADQSKFDFDLLDPTKIIPEELVPFTPIGKMVLNRNPKNYFAETEQIMFQPGHVVRGIDFTDDPLLQGRLYSYLDTQLNRHGGPNFEQLPINRPRIPFHNNNRDGAGQMFIPLNTAAYTPNSMSNGFPQQANRTHNRGFFTAPGRMVNGPLVRELSPSFNDVWSQPRLFYNSLTVFEKQFLVNAMRFENSHVRSETVRKNVIIQLNRVDNDLARRVALAIGVEPPSPDPTFYHNKTTVPIGTFGTNLLRLDGLKIALLTRDDGSFTIAEQLRAAFNSANNKVDIVLVGSSLDPQRGVNMTYSGADGSIFDAVIVVGGLLTSASTQYPRGRPLRIITDAYAYGKPVGAVGDGSNEALRDVLMAAGGDASNGLDQPGVYISNDVSEAYVRSVLDGLTAYRFLNRFPLDR

SEQ ID NO: 1309 - protein, 449 aa, Rickettsia rickettsii
MLLRLIITLFFIINSICAFAEGEKETENKISNQEAYKQFQEIFERIEKAYVQVPDRQKMIDEAINGMLNSLDPHSSYYTDEDLEDIFTFTKGEFGGIGVEIMYDSGAIKIISPIDDLPAFKAGLKGGDYIVGVNDELVSTLGPNKAIKEMRGTPGTKVKLLIIKEEEAKPQELELTREIVKIKPIKAHLEKNNIAYIRITTFNESTISELKAAVKKLKTEGKDDLKGIILDLRNNAGGILDQAIAVSDYFIDSGVIVTTKGRTKSSNSEIKANEFSLKAPKVPMIVLINGNSASASEIVAGALQDHKRAIILGTKSFGKGSVQALTQINSRAAVKLTISKYYTPSGRSIQAEGIEPDILIEPAKVEYPEVKKIDKRFSESSLKNYLKNDNEKNKDSQKATKAKNNKQEENELSELYKKDYQFARAYDVITGLIINKKLETNERVKQEDK

SEQ ID NO: 1310 - protein, 217 aa, Candida albicans
MSSSSRKKTLLKVIILGDSGVGKTSLMQQFVNSKFSHQYKATIGADFLTKEITVDNNKSVTLQIWDTAGQERFQSLGVAFYRGADCCVLCFDVTNEKSLNNLTSWKDEFLVQSNVSNPQDFPFIIIGNKIDVDDSKKIPSLSKKLNNITNNQMGGLNYPVFETSAKDGVNVEAAFEVIAKMALQQEELNASNGNDVNDDYNDAINIHLDSEASACGC

SEQ ID NO: 1311 - protein, 477 aa, Enterococcus faecalis
MKNKRTVPFYQYIISLLCVAFLAGGSSYIYFDHRVKKMSQEGAITNADLSKVQDLYNEISTNYVGEVDKNELVEGALKGMSEAIGDPYSTYLNESAANDLNESLSGDFEGIGATMTMKDGEPVVAEAPVADSPAEKAGIKEGDIIEKVDGTATKGMKLAEVVSKVRGKKGTSVELTIQREGETKNISIKRGKIPVKTVTGELDKNDAQIGSIKITSFGKKTYQELKETITNLRDKGAKSFVIDVRQNPGGLLDQAERMASMFLKNGETIVQFEDKKGRTMKEVASKELDGGFKVKEPVAVIIDGNSASASEIFAAALHESANVPLIGTKTFGKGTVQTVKDLNDQTEIKLTVLKWLTPKGEWINEKGIEPTIKADYPEYAYLKLIPRDKTLKEGDQSEDIQNLNAILAVLAYPVDENNANYTAETKAAVSDLQQKNGLPVTGEIDNETATKIEATLGKLILENDAAYDTAVKEIQKN

SEQ ID NO: 1312 - protein, 138 aa, Magnaporthe grisea
MSDNEFGANDDLSLPKATVQKIVSEILPQSDGITYSKEARDLLIECCVEFITLISSEANEISDKEAKKTIACDHITKALEVLGFSEYVPAVLEAAAEHKEVQKGREKKANKFEQSGLSLEELERIQAEEFAKAASRHH

SEQ ID NO: 1313 - protein, 283 aa, Solibacter usitatus
MEIEFAPVVKREGINWITVTAFAVFHLGAVAALFFFSWPAFFAAVFLYWASLSLGIGMGYHRLLTHRSYQVPKWLEHSLAVCGALALEGGPIFWVATHRVHHQFSDKHGDPHTPRDGKWWSHITWMMVGDVTHCDSVACAKYAPDMAADPFYVWLSNYHWIPLTVVGIALLAIGGLPFLLWGVFFRVTLGLHATWMVNSLTHLWGARRFDTRDDSRNNWFVAALSFGEGWHNNHHAHPTSARHGLAWYEVDISWMTIRLLQALGFAKGVKVAKIGPVRERKVA

SEQ ID NO: 1314 - protein, 589 aa, Saccharomyces cerevisiae
MSGVSNKTVSINGWYGMPIHLLREEGDFAQFMILTINELKIAIHGYLRNTPWYNMLKDYLFVIFCYKLISNFFYLLKVYGPVRLAVRTYEHSSRRLFRWLLDSPFLRGTVEKEVTKVKQSIEDELIRSDSQLMNFPQLPSNGIPQDDVIEELNKLNDLIPHTQWKEGKVSGAVYHGGDDLIHLQTIAYEKYCVANQLHPDVFPAVRKMESEVVSMVLRMFNAPSDTGCGTTTSGGTESLLLACLSAKMYALHHRGITEPEIIAPVTAHAGFDKAAYYFGMKLRHVELDPTTYQVDLGKVKKFINKNTILLVGSAPNFPHGIADDIEGLGKIAQKYKLPLHVDSCLGSFIVSFMEKAGYKNLPLLDFRVPGVTSISCDTHKYGFAPKGSSVIMYRNSDLRMHQYYVNPAWTGGLYGSPTLAGSRPGAIVVGCWATMVNMGENGYIESCQEIVGAAMKFKKYIQENIPDLNIMGNPRYSVISFSSKTLNIHELSDRLSKKGWHFNALQKPVALHMAFTRLSAHVVDEICDILRTTVQELKSESNSKPSPDGTSALYGVAGSVKTAGVADKLIVGFLDALYKLGPGEDTATK

SEQ ID NO: 1315 - protein, 444 aa, Saccharophagus degradans
MNRLTLPPSSRLRSKEFTFGVATSSYQIEGGIDSRLPCNWDTFCEQPNTIIDNTNGAIACDHINRWQDDIELIANLGVDAYRFSIAWGRVINLDGSLNNEGVTFYKNILTKLREKNLKAYITLYHWDLPQHLEDAGGWLNRDTAYKFRDYVNLITQALDDDVFCYTTLNEPFCSAYLGYEIGVHAPGIKDLASGRKAAHHLLLAHGLAMQVLRKNCPNSLSGIVLNMSPCYAGSNAQADIDAAKRADDLLFQWYAQPLLTGCYPDAINSLPDNAKPPICEGDMALISQPLDYLGLNYYTRAVFFADGNGGFTEQVPEGVELTDMGWEVYPQGLTDLLIDLNQRYTLPPLLITENGAAMVDELVNGEVNDIARINYFQTHLQAVHNAIEQGVDVRGYFAWSLMDNFEWALGYSKRFGITYVDYQTQKRTLKASGHAFAEFVSSRS

SEQ ID NO: 1316 - protein, 389 aa, Mannheimia succiniciproducens
MNKKFERLFETVTFPNGATISSRFAMGPMVIVGSESNGEIGADDLAYWQRRNDAGSLLITGATAVSDYSDAYGNGLKLHKDELLDGWKQLAAVMKAKGNRAVVQLFHAGYRAAFTYKDKGVAYSASSKEYGFLDYPVTGMTEAQIEDTLNEFAAAAKRAIDAGFDGIEIHGANRYLIHQFFSAVSNVRDDQWGGSLENRARFALEVVKRIQEVIKQYAKADFILGYRISPEEIHREGNGFTFDEALYLIDEVAKLGVDYFNVSQSGVRGFAAEPKAGAYMGQAISKVIKTRLVGRALLLASGDLTSPDKILEAVTEYADITSNATMVLLDPDTKNKIQSGREDEVSLAVDETTIDDLKLPKAFYKIAPMIVTSQFVPQHTKDLIYKEPK

SEQ ID NO: 1317 - protein, 673 aa, Bdellovibrio bacteriovorus
MSSFSKGVRGFIIAGSLAVSSLASAQLKEGLECRYLTVIEQGFLANHVKYSNRDTDLQNRVIEQYLKRLDPSKIYLTQGDVDAIRKSAGNVFDKTKNRDCSFLDAAQKIVLERVKDRSEFAKKYLGKDFKFESSTEFTFDPEKKTWPKDSADANEYLKKYIQFQIGNYMATDMKMDEAKKNVIKNYERAVKRTADTTQDDLFSGYLDSFARALDPHSSFFSRDVLEDFEIQMRLSLEGIGATLSSQDGFTVVEQLVPGGAAAKSGLIEPQDKIVAVGQEKGAMENVIDMDLKDVVKKIRGNKGTKVRLTILRKSGEGKKRFDVTLTREKVNLEDEAASIIYQDREINGQKKKIGVINFPSFYADSRRGGRSSAADMKKLIKEANEKKVDGLVLDLSNNGGGSLEDAVKIAGLFFQTGNVVKQSSKNEGRAESALRDTDPMVDWSGPLVVLTSRISASASEIVSGTLQDYKRAVVVGGDHTYGKGSVQSVLPIPNNLGAIKVTVGMFFVPGGKSTQHRGVDADIVLPGPFSADDIGEKYMDYSLPPKTIESFLSPDAYVKEGPGAWKEIKPEWLKSLRERSGERVAKNDEFKKIVEELNKAKARGKVIRVSEVLKDKNEKEKKDKAKKTASKAKKNEEYLKRPDIMEAENVLLDLIQLEDGKSLVPQQKQANAK

SEQ ID NO: 1318 - protein, 497 aa, Lactobacillus johnsonii
MYHKQLDEFPTDFLWGASSAAYQIEGGAKEDGKGLSIWDKYAHQAGNTFKGTNGDVAVDHYHRYKEDVELMAKQGLKAYRFSVSWSRILPAGEGKVNQAGINFYRDLINELRKNKIEPILTIYHWDLPLALQEKYGGWESRKTIEAFVNYAKILFSEFGEKVKYWITINEQNVFTSMGYRWGTHPPKKQNIKTMFQANHYINLANALAITEFHKMVPAGKIGPSFGYGPVYPKTNSPEDVLAALNADDFNNNWWLDVYCRGKYPFFIRKQLENLNLMLEITKKDKAILENDAAHPDFLGINYYHGGTVQENRLQKPATNDKEKQFNKVDPYLMQPKGDQAKNPEVPMFNGVENDYVNKTNWGWEIDPTGLRIALRQVYEKYQLPIMITENGLGAKDIVENGKINDQYRIDYLADHVLAMKEAISDGVDLIGYCAWSFTDLLSWLNGYSKRYGFVYIDQNDEQKGTLKRIPKKSYTWYKSIIATNGNDLSLLKHGEQK

SEQ ID NO: 1319 - protein, 281 aa, Mannheimia succiniciproducens
MSRTYQQITQSRSFQMAKFRYLTEPFQIKNLQLKNRVVMPPMCMYVAKEDGIANNWHFVHYVSRAVGGVGLIIVEMTNVADNARISPDCLGLWNDEQAQALKKIVDECHAQGAKIAVQIGHAGRKALGWDDVVAPSAIICDESVTSDKSRWSYKMPRALTTEEAEQVVLQFQSAVRRAVAIGFDAVEIHAAHGYLIHQFYSPKMNIRTDKYGQDKCLFGIEVIQAAKAVMPAEMPLLVRISAQEYSDNGFPAEYGVSVAKRFAEAGADVLHVSGGGDGNFI

SEQ ID NO: 1320 - protein, 222 aa, Glycine max
MGRGKIEIKRIENTTNRQVTFCKRRNGLLKKAYELSVLCDAEVSLIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNVIQALASRNFFNPNMLDGGTVYPQTDKKILHLG

SEQ ID NO: 1321 - protein, 217 aa, Ophioglossum pedunculosum
RSGLLKKAYELSVLCDAEVALIIFSGTGKLFEFASSSMKKILERYRKYGGGLHDNSIATRDAEYWRNEVMRMKEHIACLEESQRHLLGENLVSLSVKNLQKLEHQLEIGANRIRTRKTQILLEQIQELQKKEHFLHGENNILKTKLEQLSTRQVPSLGTLIYTSTVTTTSTTSAGAGVEDNAGGHDSMNAMQKMTLHSNFQPATSAQNTLQLGYYPD

SEQ ID NO: 1322 - protein, 268 aa, Ustilago maydis
MKIHPVAVREDNYAYILQSSVDGRAVFVDVFDVEAVSGAAEKLGIPNENVVGLLTTHHHFDHSGGNEAFAHAYPGRPIYGGSDKIPALTKLVHDADRISELLGGVSIECVATPCHTQDHICYHVTDTTTAQSGVFTGDTLFISGCGRFFEGHPQQMLSAMDRLSSLPDHTLVYCGHEYTKSNVAFSAAILPPSEHPITKLINDLKTTHSTTGMYTIADERNHNPFMRCRDQLVKDKLAHLVGHDVHDEVEVMRLLRELKNGGHVKANI

SEQ ID NO: 1323 - protein, 666 aa, Bacillus caldolyticus
MIAANPTDLEVYLFHEGRLYQSYELFGAHVIRGGGAVGTRFCVWAPHAREVRLVGSFNDWNGTNSPLTKVNDEGVWTIVVPENLEGHLYKYEIITPDGRVLLKADPYAFYSELRPHTASIVYDLKGYEWNDSPWQRKKRRKRIYDQPMVIYELHFGSWKKKPDGRFYTYREMADELIPYVLERGFTHIELLPLVEHPLDRSWGYQGTGYYSVTSRYGTPHDFMYFVDRCHQAGLGVIIDWVPGHFCKDAHGLYMFDGAPTYEYANEKDRENYVWGTANFDLGKPEVRSFLISNALFWLEYYHVDGFRVDAVANMLYWPNNDRLYENPYAVEFLRQLNEAVFAYDPNVWMIAEDSTDWPRVTAPTYDGGLGFNYKWNMGWMNDMLKYMETPPHERKYAHNQVSFSLLYAYSENFILPFSHDEVVHGKKSLLNKMPGSYEEKFAQLRLLYGYMMAHPGKKLLFMGSEFAQFDEWKFAEELDWVLFDFELHRKMDEYVKQLIACYKRYKPFYELDHDPRGFEWIDVHNAEQSIFSFIRRGKKEGDVLVIVCNFTNQAYDDYKVSVPLLAPYREVLNSDAAEFGGSGHVNGKRLPAFSEPFHGKPYHVRMTIPPFGISILRPVQKRGERKQNEEEVHRHVIGRRARKPASLADEKHRETSRAVWGEVPDH

SEQ ID NO: 1324 - protein, 448 aa, Arabidopsis thaliana
  misc_feature (107)..(107): Xaa can be any naturally occurring amino acid
  misc_feature (224)..(224): Xaa can be any naturally occurring amino acid
  misc_feature (382)..(382): Xaa can be any naturally occurring amino acid
MSQHMNLLLPSFETDKEEYDERKTTDHGGIGGSVWRFKGNKAAKEAASVSMKGTLARLFDCCSKDVKKTILPLGHGDPSVYPCFQTSVDAEEAVVESLRSGAANSYXPGVGILPARRAVANYLNRDLPHKIHSDDIFMTVGCCQGIETMIHALAGPKANILLPTLIYPLYNSHAIHSLVEIRKYNLLPDLDWEIDLQGVEAMADENTIAVVIMNPHNPCGNVYXYEHLKKVAEVARKLGIMVISDEVYNQTIYGENKFVPMGIFSSITPVVTLGSISKGWLVPGWRIGWIAMNDPKNVFKTTRVVESIKEHLDISPDPSTILQFALPNILEKTKKEFFEKNNSILSQNVDFAFDALKDIPCLTCPKKPESCTYLVLRKLDLXVLEDITNDFDFCMKLAQEENLVFLPGEVLGLKNWVRFSIGVERSMLEDAFMRLKGFFARHTKTQLT

SEQ ID NO: 1325 - protein, 450 aa, Salmonella typhimurium
MPTHLVWFRRDLRLQDNLAAAACRDASARVLALYISTPQWQAHDMAPRQAAFISAQLALQTALAEKGIPLLFHEVAFNASIETVKNVCRQHDVSHFYNYQYEFNERQRDRAVEKLPSVICEGFDDSVILAPGAMTGNHEMYKVFTPFKNAWLRLKEDIPPCVPAPKIRVSGLSTPLTPVSLNYPQQEFDALFPVEENAVIAQLRQFCAQADEYALRRDFPAVDGTSRLASLATGGLSPRQCLHRLLAQPQALDGGPGSVWLNELIWEFYRHLMTWYPALCKHQPFRWTKRVAWQENPHYFQAWQGETGYPIVDAAMRQLNATGMHNRLRMITASFLVKDLLIWRLGERYFMSQLIDGDLAANGGWQWAASTGTDAAPYFRFNPTTQGERFDRDGEFIRQLPALRDIPGKAIHEPWRWAKAGVVLDYPRPIVEHKQARATLSAYEAARKGA

SEQ ID NO: 1326 - protein, 536 aa, Deinococcus radiodurans
MSDENNKGVGTAVQGVGGPRDGRTAPGEQGTTLTTRQGHPVHDNQNSRTVGSRGPMTLENYQFIEKLSHFDRERIPERVVHARGVGAHGVFRATGKVGDEPVSKYTRAKLFQEDGKETPVFVRFSTVGHGTHSPETLRDPRGFAVKFYTEDANWDFVVNNLKIFFIRDALKFPDLIHSQKPSPTTNIQSQERIFDFFAGSPEATHMITLLYSPWGIPASYRFMQGSGVNTYKWVNDQGEGVLVKYHWEPVQGVRNLTQMQADEVQATNFNHATQDLRDAIERGDFPQWDLFVKIMEDGEHPELDFDPLDDTKIWPREQFPWRHVGQMTLNRNPENVFAETEQAAFGTGVLVDGLDFSDDKMLQGRTFSYSDTQRYRVGPNYLQLPINAPKKHVATNQRDGQMAYRVDTFEGQDQRVNYEPSLLSGPKEAPRRAPEHTPRVEGNLVRAAIERPNPFGQAGMQYRNFADWERDELVSNLSGALAGVDKRIQDKMLEYFTAADADYGQRVREGIQAKEAEMKGQKQEAPVYGTEASSLY

SEQ ID NO: 1327 - protein, 427 aa, Ralstonia eutropha
MFAAADAAVFASADIAVKPIQKSNKLNNVCYDIRGPVLEKAKQMEEEGHKIIKLNIGNLAVFGFDAPEEIQQDMMRNLPNSAGYSDSKGIFAARKAIMHYTQQKNIQGVGLEDIYVGNGASELIVMAVNALLNSGDEVLVPAPDYPLWTAAVSLSGGTPVHYICDESNEWMPDPADIRARITPHTKAIVIINPNNPTGALYSDELLLEIVAIAREHGLIIFADEIYDKVLYDGNVHTSIASLSTDVLTVTFNGLSKNYRSCGYRAGWMVVSGDKRPALDYIEGLNMLSSMRLCANVPGQWAIQTALGGYQSINDLVAEGGRLRRQRDLAYELITAIPGVSCVKPKAALYLFPKLDLSMYPVQDDQEFIYELLQESKVLLVQGSGFNWDKPDHFRIVFLPHEEDLREAINRIARFLEAYRKRHGKVAA

SEQ ID NO: 1328 - protein, 656 aa, Unknown
  Polaromonas sp. JS666
MCGLAGYFSGQWPADGEQASARLKAMTDAIAHRGPDSDGYWLDAATCMALGHRRLAILELSAAGAQPMHAASGRYVIAYNGEIYNHLDLRADLQKSGQSPAWRGHSDTETLLAGFDAWGIQGAVERTVGMFAFAVWDRQERMLTLGRDRLGEKPLYYGWQGSGSSAVFLFGSELKALRAHPAFGAQINRDALCLYMRHNNVGGSHSIYQGIHKLPPGTLLTVSRQTPEPVIRPYWSGAEVARCGVAQPFGGTSGEAVDALEALLKDAVRQQMMADVPLGAFLSGGVDSSAVVALMQTQSLRPVKTFSIGFHEAAYNEAEHAKAVAQHLGTEHTELYVTPEQAMAVIPRLPTLYDEPFADSSQIPTFLVSQLARQHVTVSLSGDAGDELFGGYNRYQLTASLWRKLSAAPLPLRRAAAWGLTRFSPQSLNSLAALMPASARWAHMGDKLHKGAGVMAGRTVEDLYLGMVSDWHDPAAVVIGGREPATLLRGRRPDLPGLTDVERMMALDMLSYLPDDILTKVDRAAMGVSLETRVPFLDHRVVEFAWRLPLHYKLRQEGGRYTTKWALRQVLYRHVPQALIDRPKMGFGVPIDRWLRGPLRDWAEDLLSETRLKREGYFKPAPIRQKWAEHLGGQRNWAPHLWTALMFQAWLQANHA

SEQ ID NO: 1329 - protein, 158 aa, Lycopersicon esculentum
MDLRLLGIDNTPLFHTLHHMMEAAGEDSDKSVNAPSRNYVRDAKAMAATPADVKEYPNSYVFVVDMPGLKSGDIKVQVEEDNVLLISGERKREEEKEGAKFIRMERRVGKFMRKFSLPENANTDAISAVCQDGVLTVTVQKLPPPEPKKPKTIEVKVA

SEQ ID NO: 1330 - protein, 119 aa, Phaseolus vulgaris
NIDNFFTEDEQLAFCPAIVVPGVYYSDDKMLQTRIFSYADSQRHRLGPNYLQLPANAPKCAHHNNHHEGFMNFMHRDEEVNYFPSRYDSVRHAESFPIPPAICSGRREKCGIEKENNIK

SEQ ID NO: 1331 - protein, 1353 aa, Thermosynechococcus elongatus
MPAAPLPANEPERQRALEQYQVLDTPPEPIFDEITNLAAAICETPIALISLVDRQRQWFKSKVGIDACETPRNVAFCAHVILQDQLVIVPDARLDPRFADNPFVTGPPYIRFYAGMPLVTPQGYGIGTLCVVDYQPRQLNPVQQQTLRTLARQVINELEIRHHLEVTQQQLAYIQQMSSLQEAVFNSSNHAIIATRTDGIITLMNRAAQQWLGYPASELVGKATPERFHDPQEMERYAQILSAQLGEPIPAGFETLVARARRGLADEQEWTFVRRDGSCFPVSLSVTPMHDRQGQLIGFLESAVDITDKKQIEAALRLRERAIIASTNGIVITDYRQPDNPVIYVNPAFERMTGYRATEVIGKNCRFLQGSDRHQPGATAIRNAIKKGQSCRVVLRNYRKNGQLFWNELAISPIYNEFGEITHYIGIQSDVTERQRAQLFLQQQVKRTLLLNRITEEIRQQIEREHICRTAVQQVGVTLNVSRCLLFVYQENAPTPMELVAEYCGPGVPSVNECDLDLTQMRAPFLASVFASDEVFSCDDVQNDDRLAPLHAYCEALRVKSALIVRTAYRNQANGLLILHQCDRQRRWTDAIQSLLKSVAAQVGIGLAQVQLLEQETRQRQQLQQQMQRALLLNQITEQIRQSLDTETVFATTVTQIGQAFGVNRCLIHRYDPGPPPHIPDVAEYLQPGYASMRGISIPVENNPHALAVLSGDTAVVSNDVTQDPLLANAMHLCHQFQIQSMLAIRTSYKGVPNGIIGLHQCDRQRQWTPEEIELLEAVAAQVGIAIAQAELLRHEQQQRQLLAQQNQELEQARLQAELANRAKSEFLATMSHEIRTPMNAVLGFTNLLLDTPLNEQQRDFLQTLHQAGEALLTIINDILDFSKIESGKLVLEQQPFDVRECVEDVLSLLASKAQEKELELLYTCTPETPAQIKGDVTRLRQILVNLVGNGIKFTHEGQVAVHVGVLKREGKDFLQFQVQDTGIGIPRDRLDRLFKPFSQVDASTTREYGGTGLGLVISKRLCELMGGDMSVESTEGQGTTFTFTILAEGQKPYVPPKVHPALEGKRVLVIDDNAASRENLCTLLHNWGMVPIGYSDPRLVLEAAPPWDLAVIDLNMPQMTGLQLAERLQSEPNFNQQPMILLTPLSWLETASRKELITAHVPKPIRPLTLRQTLIRTLSSESATQPALTKTGIDLNLGNRFPLRILLAEDNAVNQKVALHILKRMGYRADVAANGLEVLEALQQRPYDVILMDVQMPKMDGLETTERICAQWPPSQRPWIIAMTANALAGDRERCFAAGMDDYISKPIKIEALAAALNRCRCLNPKSTYPQLCDQINIDSDQGHQSATESMT

SEQ ID NO: 1332 - protein, 212 aa, Arabidopsis thaliana
KALHKYDCLRANKSTSAFGLEARVPFLDKDFINTAMSLDPESKMIKPEEGRIEKWVLRRAFDDEERPYLPKHILYRQKEQFSDGVGYSWIDGLKDHAAQNVNDKMMSNAGHIFPHNTPNTKEAYYYRMIFERFFPQNSARLTVPGGATVACSTAKAVEWDASWSNNMDPSGRAAIGVHLSAYDGKNVALTIPPLKAIDNMPMMMGQGVVIQS

SEQ ID NO: 1333 - protein, 581 aa, Hordeum vulgare
MCGILAVLGCGDESQGKRVHVLELSRRLKHRGPDWSGLHQVADNYLCHQRLAIIDPASGDQPLYNEDKSVAVAVNGEIYNHEELRERLSGHRFRTGSDCEVIAHLYEEHGESFIDMLDGVFSFVLLDARDHSFIAARDAIGVTSLYIGWGIDGSVWISSEMKGLNDDCEHFEIFPPGNLYSSKEKCFKRWYNPPWFSEVIPSVPYDPLRLRSAFEKAVIKRLMTDVPFGVLLSGGLDSSLVAAVAARHFAGTKAAKRWGTRLHSFCVGLEGSPDLKAAKEVADHLGTVHHEFNFTVQVRIDAIEDVIYHIETYDVTTIRASTLMFQMSRKIKALGVKMVISGEGADEIFGGYLYFHKAPNKEEFHQETCRKIKALHQYDCLRANKATSAWGLEVRVPFLDKEFIDEAMSIDPEWKMIRPDLGRIEKWILRKAFDDEEKPFLPKHILYRQKEQFSDGVGYSWIDGLKDHAASNVSDKMMSNAKFIYPHNTPTTKEAYYYRMIFERYFPQSSAILTVPGGPSVACSTAKAIEWDAQWSGNLDPSGRAALGVHLSAYEQDTIAVGGSNKPGPMETVVNGVAIES

SEQ ID NO: 1334 - protein, 409 aa, Xylella fastidiosa
HSAVRGLLSDLDPHSTYFDKEDADAFDEQTSGVYDGIGVELQEQSDNTLKVIAPIDDTPAARAGLRPGDLIVAINGKPLANVDAMKPLRGAPGSQVTLTIVRDKNGKPFDMTIKRETIHIASVRSRMLEPGYGYIRISVFQADTGNDFHKHLGQLKQQAGGKLRGLLLDLRSNPGGLLTAAVQVADALLDKGNIVSTRGRISASDTRFDATQGDLLDGLPLVVLVDAGSASASEVLVGALSDNHRARVIGSCTFGKGSVQTLLPLDNGDSVKLTTARYYTPSGRSIQARGIVPDLLLKPDGVGAADLSGSGIDRSEAGLPGHLRGTDEGGPGCTSSDPLPGDTPIMTALLELKQPGSAVQAKKAIPVKVVSDVKSATKSPLSVFGKDRAVKRVPVVSPTSEQVDGQPSK

SEQ ID NO: 1335 - protein, 542 aa, Unknown
  Mesorhizobium sp. BNC1
MAAKDVKFHSDARERMLRGVDVLANAVKVTLGPKGRNVVIDKSFGAPRITKDGVTVAKEIELEDKFENMGAQMVREVASKTNDAAGDGTTTATVLTQAIVKEGAKAVASGMNPMDLKRGIDKAVEAIVEELKKNARKVTKNDEIAQVGTISANGDQEIGRFLAQAMEKVGNEGVITVEEAKTAETELEVVEGMQFDRGYLSPYFITNQEKMRVELDEPYLLIHEKKLASLQPLLPVLEAVVQSGKPLLIIAEDVEGEALATLVVNKLRGGLKVAAVKAPGFGDRRKAMLQDIAILTGGTAISEDLGIKLENVTLEMLGRAKKVVIEKENTTIVDGAGSKDEIQGRVNQIKAQIEETTSDYDREKLQERLAKLAGGVAVIRVGGATEVEVKERKDRVDDAMHATRAAVEEGLLPGGGVALLRAAKALDNVTGENEDQKVGISIVRRAIEAPIRQIAENAGAEGSIIVGRVREKPDFGYGWNAQTGEYGDLYQMGVIDPVKVVRAALQDAASVAGLLITTEAMVADRPKKETAPAMPAGAGMDF

SEQ ID NO: 1336 - protein, 272 aa, Zea mays
  misc_feature (192)..(192): Xaa can be any naturally occurring amino acid
MPSHQPTAGMMAVDPDYVKQPSSMASTSEPNRNPKYDPKKPHITDTPITKSNWYKHVNWLNVTFIIGIPLAGCIAAFWTPLKWQTALWAVIYYFWTGLGITAGYHRLWAHKSYNASLPLSVFLALVGGGAVEGSIRWWSRDHRAHHRYTDTNKDPYSVRKGLLYSHLGWMVMKQNPKRIGRTDITDLNEDPXVVVWQHKNYIKVVIFMGLIFPSAVAGLLWNDWKGGFIYAGILRIFFVQQATFCVNSLAHWLGDQPFDDRNSPRGHVITAL

SEQ ID NO: 1337 - protein, 462 aa, Brassica napus
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPSCGPTRPCLLDEEAIKVGGSNHSHATKDLYDSIAAGNYPEWHLFVQVMDPAHEDKFDFDPLDVTKIWPEDVLPLQPVGRLVLNKNIDNFFNENEQIAFCPAIVVPGVHYSDDKLLQTRIFSYADSQRHRLGPNYLQLPVNAPKCAHHNNHHEGFMNFMHRDEEVNYFPSRLNPVRHADKYPTTPVFCSGNREKCMIEKENNFQQPGERYRSWDADRQERFVKRFVEALAEPRVT

SEQ ID NO: 1338 - protein, 391 aa, Acalypha californica
REFTSDSADVPITAAGALKSYKLAAKAISRLQSLPSGNMSLLCDVLVKEVSDLTGYDRVMVYKFHEDEHGEVIAECHRPDMEPYLGLHYPATDIPQASRFLFIKNKVRMICDCLAPPVKVIQDSSLTQPVSLCGSTLRSPHGCHAQYMTNMGTLASLVMSATINEDADEIDDDQQKGRKLWGLVVCHHNSSRFVPFPLRYACEFLIQVFGVQINKELELAAQMREKNMLQTQTVLCDMLLRDAPEAIITQSPNVMNLVKCDGAALYYRKKFWLLGVTPTEAQIKDIADWLLEYHGESTGLSTDSLMEAGYPGASILGDAVCGMAAIRISSKDFLFWFRSHTAKEIKWSGAKHDPEDKDDGRKMHPRSSFKAFLEVVKWRGLPWEDMEMDAI

SEQ ID NO: 1339 - protein, 522 aa, Zea mays
MNTLRRNKVRSQSEFSEDELVSSVLMKNGKKVVCGTPSGALLLYSWGYFNGCWYTMEGAGRDANPLSGYRIGKTLGIGSFGKVKIAEHILTGHKVAIKILNRKKIRSMDMEEKVKREIKILRLFMHPHIIRLYEVIDTPADIYVVMEYVKSGELFDYIVEKGRLHEEEARHFFQQVAFLHITMFIPKIAQCIAITVLKNCSMIISGVEYCHRNIVAHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPSARDLIPRMLVVDPMKRITIREIREHVWFKIRLPRYLAVPPPDTAQQVKKVDEETLNDVIKMGFDKNQLIESLQNRLQNEATVAYYLLLDDRLCTTSGYLGSDFQESMDSSFSQVITETPTSATELQQHVFTEGTFGCLPLPCFAWLSIKIHRLVGLLPVSVLALSRIFIASPSDLKPLSAAGKPGLAERGEASWPHKPTKRA

SEQ ID NO: 1340 - protein, 764 aa, Streptomyces aureofaciens
MSAARQPSPTVRDKAAPEPAAPAAPKGARAPRARRAAPPHGVRPAPALAAEERARLLEGRHHDPHAVLGARTQRGGVAFRVLRPYAKAVTVVAKGLRTELVDEGDGLFSGLLPLTGVPDYRLLVTYDSDEIEVHDPYRFLPALGELDLHLIGEGRHEELWTALGSQPMEHQGVAGTRFTVWAPNALGVRVTGDFSYWDAVAYPMRSLGASGVWELFLPGVAEGALYKYEITRPDGGRTLRADPMARYAEVPPANASIVTASRYEWQDAEWMARRGALAPHQAPMSVYELHLASWRPGLSYRQLAEQLPAYVKELGFTHVELMPVAEHPFGGSWGYQVTGFYAPTSRMGTPDDFRFLVDALHRAGIGVIVDWVPAHFPRDDWALAEFDGRPLYEHQDPRRAAHPDWGTLEFDYGRKEVRNFLVANAVYWCQEFHVDGLRADAVASMLYLDYSRDEGDWSPNAHGGREDLDAVALLQEMNATVYRRFPGVVTIAEESTAWDGVTRPTDSGGLGFGLKWNMGWMHDTLRYVSKEPVHRKYHHHDMTFGMVYAFSENFVLPISHDEVVHGKRSLVSKMPGDWWQQRATHRAYLGFMWAHPGKQLLFMGQEFAQGSEWSETYGPDWWVLDSSYPAAGDHLGVRSLVRDLNRTYTASPALWERDSVPEGFAWVEADAADDNVFAFLRFARDGSPLLCVSNFSPVVRHGYRIGVPQEVGQWREVLNTDLEPYGGSGVHHARALRPEPVPAQGRAVSLRMTLPPMATVWLRP

SEQ ID NO: 1341 - protein, 391 aa, Atuna racemosa
DLEPVNPADVPVTAAGALKSYKLAAKAISRLQSLPSGNISLLCDVLVKEVSDLTGYDRVMVYRFHEDEHGEVVAECCRPDLEPYLGLHYPATDIPQASRFLFMKNKVRMICDCLAPPVKVIQDKRLAQPLSLCGSTLRAPHGCHSQYMANMGAIASLVMSVTINDDEEEMEADQRKARKLWGLVVCHHTSPRFVPFPLRYACEFLIQVFGIQINKEVELAAQTREKHILRTQTVLCDMLLRDAPVAIITQSPNVMDLVKCDGAALYYRKKFWLLGITPTEAQIKDIVEWLLHYHGESTGLSTDSLMEAGYPGASVLGGAVCGMAAVKITSKDFLFWFRSHTAKEIKWGGAKHDPNDKDDGRKMHPRSSFKAFLEVVKRRSLPWEDVEMDAI

SEQ ID NO: 1342 - protein, 375 aa, Bacillus anthracis
MTSSNKKSASIYEGTNVNAWGSFENVAETKLFNSIQIGSWPLRNRIAMAPMTRCFADNETGAVGADVVEYYRKRAADGVGLIITEGIVISPRAKGNPGVPGIYTQEQIDSWKPVTEAVHKEGGTIIAQIWHVGRMSHHEIIGGQMPQAPSAIAAEGNVPRFRKPFDTPEAMTLEEIQEVIGQYAQAAKNAIEAGFDGVEIHGAHGYLIDQFTYEFVNKRTDKYGGDLKQRLTFMKEVTEAVIEAIGADKTLLRFSAFKGDNPTYMWENPELAIETFVNMFKEVGLTMIHPSTMSYTQVIADGKNFHQLVRKYWDGAIVGVGNLNPKEAEEALQEGTIDVAAFGRPLIANPDFVHRIKSAESLVEYDAKEHLATLI

SEQ ID NO: 1343 - protein, 229 aa, Triticum aestivum
MCCVSYSDPPPPLPAEEKSKEEEQRCSAAMEVDAEASYSYGFLPPGRHQPYYAPPPPPPEDGELWEYFPCPFCYIEVEMPFICSHLQEEHCFDTRNAVCPICAENLGKDMSAHFRFQHSHLLKRRKPSRPSSSPWPAAASPPAYEVNPYMMSSRPCQDPEPDPLLSQFICGSGDQTETEPGSRDKKSQRHRPSSGHPAAGVQRPVSQLELEERLQRIEFLREIITSTIL

SEQ ID NO: 1344 - protein, 214 aa, Rubrobacter xylanophilus
MILQKLTVGTFQENCYILGDEASGSGALVDPGDEAVRIALAVEQTGLEIEKILLTHAHIDHVGAVASLVEEYGCPVLAHRESEPLLEQLPTQALMMGLRFGKVPRLDGYIEDRERVEVGGLTLEALYTPGHAPGHLAFYLESEGALLSGDALFAGSVGRTDLPGGDAGLLMRSIKERMLVLPDETVVHPGHGPQTTIGNERAYNPFLQQGGGIL

SEQ ID NO: 1345 - protein, 339 aa, Glycine max
MEERYETLKELGSGNFGVARLAKDKETGELVAIKYIERGKKIDANVQREIVNHRSLRHPNIIRFKEVFLTPTHLAIVLEYAAGGELFERICNAGRLSEDEARFFFQQLISGVSYCHSMQICHRDLKLENTLLDGNPAPRLKICDFGFSKSALLHSQPKSTVGTPAYIAPEVLSRKEYDGKVADVWSCGVTLYVMLVGAYPFEDPEDPKNFRKSIGRIMSVQYAIPDYVRVSKECRHLISCIFVANPAKRISISEIKQHLWFRKNLPREIIEPERRGYVDHKRTQPSQSVEETMRIIQEARTKIHTGEQAGTGTSDAVHGDEANEEVDINDHYAKYLALN

SEQ ID NO: 1346 - protein, 205 aa, Arabidopsis thaliana
IQKIDDSTSRQVTFSKRRKGLIKKAKELAILCDAEVCLIIFSNTDKLYDFASSSVKSTIERFNTAKMEEQELMNPASEVKFWQREAETLRQELHSLQENYRQLTGVELNGLSVKELQNIESQLEMSLRGIRMKREQILTNEIKELTRKRNLVHHENLELSRKVQRIHQENVELYKKAYGTSNTNGLGHHELVDQFMNPMHRLGCS

SEQ ID NO: 1347 - protein, 372 aa, Zea mays
MDSSGGGGGAQIKGMATHGGRYVLYNVYGNLFEVSSKYAPPIRPIGRGAYGIVCAAVNSQSGEEVAIKKVGNAFDNHIDAKRTLREIKLLRHMDHENILALKDVIRPPTRENFNDVYIVTELMDTDLHQIVRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRKPLFPGRDYIQQLKLITELIGSPDDASLGFLRSDNAKRYMKQLPQFPRQDFRLRFCNMSPGAVDLLERMLVFDPSRRITVDEALHHPYLASLHEINDEPTCPAPFSFDFEQPSFTEAHIKELIWRESLAFNPDPPY

SEQ ID NO: 1348 - protein, 880 aa, Cochliobolus carbonum
MSAAIDNEDLEELSISMPSQRRGAAQTSTTKAQDPAPPPPTALGTAVHETKSKDTKASQRLGQYTIVRTLGEGSFGKVKLATHQVSGQKVALKIINRKRLVTRDMAGRIEREIQYLQLLRHPHIIKLYTVITTPTEIIMVLEYAGGELFDYIVNHGKLQEAQARKFFQQIVCAVEYCHRHKIVHRDLKPENLLLDHDSNVKIADFGLSNIMTDGNFLKTSCGSPNYAAPEVISGKLYAGPEVDVWSCGVILYVLLVGRLPFDDEYIPTLFKKIAAGQYSTPSYLSPGATSLIRKMLMVNPVHRITIPELRQDPWFTTDLPAYLEPPAQEFFDSGADPNKAIDPKALAPLADAPRVQALHENVVTKLGKTMGYAKHDVQDALARDEPSAIKDAYLIVRENEMMRENPLLTNQDGVPVWNHQSPPAHDSYMEKFRPQSLNAVSRPQFIPPAPSDHERARQGSNASSQLASIRSPVSTIAILPSSLTEYHKAYMKGHPRPTNKISESEALPPTPEQTEEQRQISARRLKPNFRTMPEAGRTKPEPMTSLPTKKPRATKWQFGIRSRNQPAEAMLAIFKALKAMGADWEVPKIRRAGGRSGSRSRSTSQAPEDRKSKSRNHSQDSISSHSSDEDQGSRKGSPRREPLSVRNNGTSEQEARGRQKKHYNHTNDWGYHVPEDPWVIHARFLKEGMFPPGVAHPSSTHSSRVDLANDSSGARRRSSTNTSTSSAGHGVEGMTPSERAGSVSEDHVNPDEAVYIYMSIQLYSIDRDFFVVDFKCAGYERLVTNLVREIKASIPLSGSHQPPPHHQDGWDDEQGVWRRLDENEPLPEDLAKKLNEGGTEILRERTELVGAGRQEGEKIVTSPFPFLDVASTLILQLSGE

SEQ ID NO: 1349 - protein, 255 aa, Unknown
  Mesorhizobium sp. BNC1
MTLEIEQFMCRSDNFGILARDSETGITALVDAPEEQAILEAIKRTGWTPSLLLITHHHADHVEANLALKERFGLTIIGPAKEASKIPGIDRQVNEGDVVRVGNQEARVIETPGHTAGHITFYFAKAGIAFTADTLFALGCGRLFECKPPVMYESLKKLVELPLETVIYCGHEYTESNARFALSVDPTNSALKERAKKIEALRREGRPTLPTTLGEEMATNPFLRCHDPVLRNNLGMKNAADVEVFAEIRKRKDVF

SEQ ID NO: 1350 - protein, 326 aa, Triticum aestivum
  misc_feature (230)..(230): Xaa can be any naturally occurring amino acid
  misc_feature (245)..(245): Xaa can be any naturally occurring amino acid
  misc_feature (249)..(249): Xaa can be any naturally occurring amino acid
  misc_feature (258)..(260): Xaa can be any naturally occurring amino acid
  misc_feature (262)..(262): Xaa can be any naturally occurring amino acid
  misc_feature (271)..(271): Xaa can be any naturally occurring amino acid
  misc_feature (302)..(303): Xaa can be any naturally occurring amino acid
  misc_feature (306)..(307): Xaa can be any naturally occurring amino acid
  misc_feature (310)..(311): Xaa can be any naturally occurring amino acid
  misc_feature (314)..(315): Xaa can be any naturally occurring amino acid
  misc_feature (317)..(317): Xaa can be any naturally occurring amino acid
MDPYKYRPSSSFNAPMWSTNSGAPVWNNDNSLTVGSRGPILLEDYHLVEKIADFDRERIPERVVHARGASAKGFFEVTHDVSHLTCADFLRAPGVQTPVIVRFSTVIHERGSPETLRDPRGFAIKFYTREGNWDLVGNNFPVFFIRDGMKFPDMVHALKPNPKTHIQENWRILDFFSHHPESLHMFTFLFDDVGVPADYRHMDGSGVNTYTLVNRAGKAHYVKFHWKPTXGVKSLLEEEAVTVGXTNHXHATKDLTDXXXGXNYPEWTFYXQTIDPDHEDRFDFDPLDVTKTWPEDLVPALXXWGXXVLXXNIXXFXRNAFGGVLQ

SEQ ID NO: 1351 - protein, 391 aa, Austrobuxus megacarpus
DLEPVNPADVPVTAAGALKSYKLAAKAISRLQSLPSGNISLLCDVLVKEVSDLTGYDRVMVYRFHEDEHGEVVAECCRPDLEPYLGLHYPATDIPQASRFLFMKNKVRMICDCMALPVEVVQDERLSQPLSLCGSTLRSPHGCHAQYMANMGSVASLVMSVTINEDDDEMDSGQQTGRKLWGLVVCHHTCSRFVPFPLRYACEFLIQVFGVQISKEVELAAQMREKHILRTQTVLCDMLLRDAPVAIISQSPNVMDLVKCDGAALYYRKKFWSLGVTPTEAEIRDIAEWLLECHNGSTGLSTDSLMEAGYPGASILGDAVCGMAAVRITSKDFLFWFRSHTAKEIKWGGAKHDPDDKDDGRKMHPRSSFKAFLEVVKRRSLPWEDVEMDAI

SEQ ID NO: 1352 - protein, 391 aa, Balanops vieillardii
DLEPVNPADVPVTAAGALKSYKLATKAISRLQSLPSGNISVLCDVLVKEVSDLTGYDRVMVYRFHEDEHGEVVAECRRPDLEPYLGLHYPATDIPQASRFLFMKNKIRMICDCLAPPVKVIQDKRLAQPLSLCGSTMRAPHRCHVQYMANMGSIASLVMSVTINEDDDETESDQQNGRKLWGLVVCHHSSPRFVPFPLRYACEFLIQVFSIQINKEVELAAQMREKHILQTQTVLCDMLLRDAPEAIITQSPNVMDLVKCDGAALYYRKKVWLIGVTPTEAQIRDIAEWLLEYHRESTGLSTDNLVEAGYPGASVLGVAVCGMAAVRITSKDFLFWFRSHTAKEIKWGGAKHDPDDKDDGRKMHPRSSFKAFLEMVKRRSLPWEDVEMDAI

SEQ ID NO: 1353 - protein, 390 aa, Bergia texana
DLEPVNPADVPVTAAGALKSYKLAAKAISRLQSLPSGNISLCDVLVKEVSDLTGYDRVMVYKFHEDEHGEVIAECHRPDLEPYLGLHYPATDIPQASRFLFMKNKVRMICDCMAPPVKVIQDKRLTQPLSLCRSTLRSPHGCHAEYMANMGSIASLVLSVTINDEVDKIEGDKLLGRKLWGLVVCHHASPRFIPFPLRYACEFLIQVFGVQINKEVALAAQTREKHILRTQSVLCDMLLRDAPVAIITQSPNVMDLVKCDGAALYYRKKFWLLGVTPSEAQIRDIADWLLECHSGSTGLSTDSLMEAGFPGASVLGDAVCGMAAVKITSKDFLFWFRSHTAKEIKWGGAKHDPDDKDDGRKMHPRSSLRAFLEVVRWRSLPWEDVEMDAI

SEQ ID NO: 1354 - protein, 349 aa, Triticum aestivum
  misc_feature (106)..(106): Xaa can be any naturally occurring amino acid
  misc_feature (254)..(254): Xaa can be any naturally occurring amino acid
SKEVSDFAAKYMYHNPLHLDTYKEVSKMEAEILRMTASLVSKNPAYGVITSGGSESLIMSLYAYRKYFNKAKPNIVVPNTIHAAIDKGAMYLNIEVRKARLNERFXVDVAHMKSLIDHNTIALYASYPNFPHGIIDPIADIAPIAKKHKIGFHVDGCLGGFVAAFLKEHEGKFSLDIDGVTSISLDNHKFGLAPKGVAVLLFKEKKLRASMYFIYTEWVGGIYATPSFPGSRSGFASAGAWYALTHVGRKQYLXNSMRVVEATKKAAKELAKIEGVRVLGNPELCVLAFQTDIVDCFSVSSFLTKEKGWKISAIHLPKGLHISVTLANCNNVGQNLAKDVKEAIEKVKL

SEQ ID NO: 1355 - protein, 161 aa, Zea mays
MDGRMFGLETPLMVALQHLLDVPDGDAGAGGDKAGGGGPTRTYVRDARAMAVTPADVKELPGAYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 1356 - protein, 390 aa, Bergia texana
DLEPVNPADVPVTAAGALKSYKLAAKAISRLQSLPSGNISLCDVLVKEVSDLTGYDRVMVYKFHEDEHGEVIAECHRPDLEPYLGLHYPATDIPQASRFLFMKNKVRMICDCMAPPVKVIQDKRLTQPLSLCGSTLRSPHGCHAEYMANMGSIASLVLSVTINDEDDKIEGDQLLGRKLWGLVVCHHASPRFIPFPLRYACEFLIQVFGVQISKEVALAAQTREKHILRTQSVLCDMLLRDAPVAIITQSPNVMDLVKCDGAALYYRKKFWLLGVTPSEAQIRGIADWLLECHSGSTGLSTDSLMEAGFPGASVLGDAVCGMAAVKITSKDFLFWFRSHTAKEIKWGGAKHDPDDKDDGRKMHPRSSLRAFLEVVKWRSLPWEDVEMDAI

SEQ ID NO: 1357 - protein, 423 aa, Zea mays
  misc_feature (185)..(185): Xaa can be any naturally occurring amino acid
RPGGPNQLESSSSQLSRRAQPIPLPPAYTAHNSLLHLSLSLSPVSPPVCVQPHGDPRRRERQRARERRRARGKFNCYPAGVGLPEARRALAEHLSSDLPYKLTTDDIFVTAGGTQAIEVVVSVLAQPGTNILLPRPGYPNYEARAGLHNLEVRRFNLIPERGWEIDIDGLESIADKNTTAMVIIXPHNPCGSVYTREHLAKVAEVARKLGILVIADEVYGNLVFGDTPYVPMGVFGHIAPVLSLGSLSKRWIVPGWRLGWVAVCDPNKILQETKIIASITNFLNVSTDPATFVQGALPHILENTKEDFFRRIIGLLAETSEICYREIKDIKCITCPHKPEGSMFVMVKLNLYLLEGIHDDIDFCCKLAKEESVILCPGEMDLICWKKSYLTKTHFGSSSCLFRVTGIPGLNCMFALRNALRKQ

SEQ ID NO: 1358 - protein, 391 aa, Calophyllum soulattri
DLEPVNPADVPVTAAGALKSYKLAAKAISKLQSLPSGNISLLCDVLVKEVCELTGYDRVMVYKFHEDDHGEVVAECHRPDLEPYLGLHYPATDIPQASRFLFMKNKVRMICDCLAPPVKVIQDNGLSQALKSRWIYLESSPWLHSQYMANMGSIASLVMSVIINEDGDEMESDQQKGRKLWGLVVCHHTGPRFVPFPLRYACEFLIQVFGIQINKEVELAAQMREKHILETQTVLCDMLLRDAPMAIVTQSPNVMDLVKCDGAALYFKEKFWLLGITPTEAQIRDIAEWLLDYHNGSTGLSTDSLMEAGYPGASILGDAVCGMAAIRINSKDFLFWFRSDTAKEIKWGGAKHDPGDKDESRKMHPRSSFKAFLEVVKWRSLQWEDVEMDAI

SEQ ID NO: 1359 - protein, 464 aa, Enterococcus faecalis
MKYQFPENFWWGSAASGPQTEGVFEGDGKGQNIWDFWYQEAPEKFFQQVGPDKTSQFYKKYQEDIQLMKETGHNSFRTSIQWSRLIPDPTTGKVNQTAVDFYNQVIDDLLEHGIEPFMNLYHFDMPMVLQEKGGWESREVVDLYVDFAKTCFELFGDRVKKWFTHNEPIVPVEGGYLYGWHYPDKVNLKEGIQVLYHEALASAKAIAVYHSMNLSGEIGIILNLTPTYPRDEHNEADVNAAKFVDGFFNRSFLDPAVKGHFPEDMVAWAKANDLLPETTPEDLAIIAENTVDLLGVNYYQPRRAKAKETPVETRPEGLLPEDFYDVYDMPGKKMNPYRGWEIYEKGIYDTLMNLKENYGNIRCYISENGMGVEGEERFVNEQGVIEDDYRIEFVQDHLKWVHQAIQEGSNVQGYHMWTCMDNWSWLNAYKNRYGFIAVDLDDDAKRTIKKSGRWFKEMTANNGF

SEQ ID NO: 1360 - protein, 99 aa, Unknown
  Citrus x paradisi
YVFIVDMPGLKSGDIKVQVEDDNVLLISGERKREEEKDGAKYVRMERRVGKFMRKFVLPENANVEAISAVCQDGVLTVTVDKLPPPEPKKPKTIEVKIA

SEQ ID NO: 1361 - protein, 213 aa, Methanosarcina mazei
MEVRYICPTAYDSSVYLVNGKVLIDAGMNSDLIIKQLEKYIKLTELKLIILTHCHYDHTAAAAAIAEKSGAEVGIHKADLEGVNDEYLSVSVLFGERAPAVKPTITYEEGDKIDIGDGEYLKVIHTPGHSKGSICLYEPVSKSLFSGDTVFPRGGFGRMDFEGSEPNKMLGSVEKLTKLDVKNLYSGHGAPTDRDGNKQITASYTMLKMIMGA

SEQ ID NO: 1362 - protein, 917 aa, Pseudomonas fluorescens
MLRKMGIKGRVLLLTLLPTSLMALLLGGYFTWMQLSELQTQLLQRGEMIAEQLAPLVAPPLSSKNTDLLERIATQSLEQPDVRTVSFLAPDRSSLAHAGPTMLNQPPIGNSSYLLQRTGNDATRYLLPVFGRHRNLAGELIPDESDRLLGWVEVELSHNGMLLRGYRSLFASLLLIAIGLICNAALALRISRTINLPISQIKLAVAQLKDGNLETRLPPLGSQELDQLASGINRMAETLQNAQEELQHSIDQATEDVRQNLETIEIQNIELDLARKEALEASRIKSEFLANMSHEIRTPLNGILGFTHLLQKSEMSPRQLDYLGTIEKSADNLLGIINEILDFSKIEAGKLVLDSVPFNLRDLLQDTLTILAPAAHAKQLELVSLVYRDTPLALVGDPLRLKQILTNLVSNAIKFTREGTIVARAMIEDEQEDSVQLRISVQDTGIGLSNQDVRALFQAFSQADNSLSRQPVGTGLGLVISKRLIEQMGGEIGVDSTPGEGSEFWISLNLPKTRDDVEDLPAAPLLGRRVAVLENHELARQALQHQLEDCGLEVTPFNSLENLTNGITSAHQTEQAIDLAVLGVTANDIPPERLNQHLWDLEHLGCKVLVLCPTTEQMLFNQSVPNPNSQLQAKPACTRQLRRALADLISPRPSRSEPGEPLSSRAPRVLCVDDNPANLLLVQTLLEDMGAKVLAVESGYAAIDAVKQETFDLVLMDVQMPGMDGRQSTEAIRQWESERHGTPLPVVALTAHAMANEKRALLQSGMDDYLTKPISERQLAQVVLKWTGLALRNQGPERAPDGLAPGVRLQVLDHEEGLRLAANKADLAADMLAMLLASLEADRQAITAAREANDNNALIERVHRLHGATRYCGVPQLRAACQRAETLLKQDDAKAMTALDELDMAIARLASEARVSA

SEQ ID NO: 1363 - protein, 56 aa, Unknown
  Citrus x paradisi
WHRVERSSGKFLRRFRLPDNAKVEQVKASMENGVLTVTVPKQEEKKPEVKAIEISG

SEQ ID NO: 1364 - protein, 459 aa, Zea mays
MMEAEKNGNILMQKYEVGKLLGQGTFAKVYHARNIETSQSVAIKVIDKDKIFKVGLMEQIKREISVMKLVRHPNIVQLYEVMATKSKIYFVLEYVKGGELFNKIAKGKLREDASRKYFQQLVSAVDFCHSRGVYHRDLKPENLLVDENGNLKISDFGLSALAESRRQDGLLHTTCGTPAYVAPEVISRKGYDGAKVDTWSCGVILFVLMAGYLPFQDSNLMEMYRKIGKADFKCPPWFPSDVRKLVSRILDPNPRTRMPITKIVECFWFKKGIDNKLIRKNIEMKGKVSALTDVNVVFSSTGIGSNNNKLVDVEQDVAKITNLNAFDIISLSEGFNLSGLFEESEKRKEARFTSSQSASTIISKLEDAATCSKMTIKKKEGGVLKMEGANEGRKGVLSIDAEIFEVTPAFHLVEIKKNNGDTLEYENLFKQDMKPALKDIVWAWQGESKDQQAKDHNQS

SEQ ID NO: 1365 - protein, 540 aa, Streptomyces coelicolor
MAKILKFDEDARRALERGVNKLADTVKVTIGPKANVVIDKKFGAPTITNDGVTIAREVEVEDPYENLGAQLVKEVATKTNDIAGDGTTTATVLAQALVREGLKNVAAGASPALLKKGIDAAVAAVSEDLLATARPIDEKSDIAAVAALSAQDQQVGELIAEAMDKVGKDGVITVEESNTFGLELDFTEGMAFDKGYLSPYFVTDQERMEAVLDDPYILINQGKISSIADLLPLLEKVIQANASKPLLIIAEDLEGEALSTLVVNKIRGTFNAVAVKAPGFGDRRKAMLQDMAVLTGATVISEEVGLKLDQVGLEVLGTARRITVTKDDTTIVDGAGKRDEVQGRIAQIKAEIENTDSDWDREKLQERLAKLAGGVCVIKVGAATEVELKERKHRLEDAISATRAAVEEGIVSGGGSALVHAVKVLEGNLGKTGDEATGVAVVRRAAVEPLRWIAENAGLEGYVITSKVADLDKGQGFNAATGEYGDLVKAGVIDPVKVTRSALENAASIASLLLTTETLVVEKKEEEEPAAGGHSHGHSH

SEQ ID NO: 1366 - protein, 60 aa, Unknown
  Citrus x paradisi
PGVKRDELKIEVEENRVLRVSGERKREEEKKGDHWHRVERSHGKFWRQFKLPDNADLDSV

SEQ ID NO: 1367 - protein, 441 aa, Brassica napus
MVGAKPIENGSDGGASTGLLHGRYELGRLLGHGTFAKVYHARNVTTGKSVAMKVVGKEKVVKVGMVDQIKREISVMRMVKHPNIVELHEVMASKTKIYFAMELVRGGELFAKVAKGRLREDVARVYFQQLISAVDFCHSRGVYHRDLKPENLLLDEEGNLKVTDFGLSAFTEHLKQDGLLHTTCGTPAYVAPEVILKKGYDGAKADLWSCGVILFVLLAGYLPFQDDNLVNMYRKIYRGDFKCPGWLSSDARRLVTKLLDPNPNTRITIDKVMDSHWFKKSSTRSRNEPVAATPEAEEDVDVSVHKSKEETETLNAFHIIALSEGFDLSPLFEEKKKEEKMEMRFATSRPASSVISSLEEAAKVGNKFDVRKSECRVRIEGKQNGRKGKLAVEAEIFAVAPSFVVVEVKKDHGDTLEYNNFCSTALRPALKDIFWTSTTPA

SEQ ID NO: 1368 - protein, 255 aa, Zea mays
LQLGLAGKVGSHGEGPGGAEADREQDQPPVTFAKRRNGLLKKAYELSVLCDAEVALIVFSNRGKLYEFCSGPSITRTLERYEKNSYAGPDTAVQNKENELVQNSRNEYLKLKAKVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLP

SEQ ID NO: 1369 - protein, 545 aa, Mycoplasma penetrans
MAKEIKFSDSARNKLFNGVQQLFDAVKVTMGPRGRNVLIQKSYGAPVITKDGVSVAKEVDLTNPIENMGAQLVKDVASKTADEAGDGTTTATVLAYGVFKEGLRNVISGANPIEIKRGMDKTVNAIVNELNKSSKKIARKDEIIQVATISANSDKKIGELIANAMEKVGSDGVITVEEAKGINDELTVVEGMQFDRGYISPYFVTDTNKMIAKLENPYILITDKKVSSIKDILPILEEIMKTGRPLLIIADDVDGEALTTLVVNKMRGVFNVVAVKAPEFGDKRKQVLEDIAILTGGSFVTDDLGISFDKVTLQDLGQAESVVIDKDNSTIVKGKGLESQIKERISKIKTAIEMTDSDYDKDSLRNRLAKLNKGVAVIKVGAVSEVELKEKKDRVDDALSATKAAIEEGIVIGGGAALVHVSKRINVNTLNLIGDEKIGYQIVMSAIMSPISQIVSNAGFDKGVVINEILKATNPHLGFNAATGKYVDMFQTGIIDPVKVTRIALQNAVSVSSMLLTTEAVIYDVKDDKEDSVPAMPNMGMGGMM

SEQ ID NO: 1370 - protein, 727 aa, Xylella fastidiosa
MSLRILNSLKVALLTLAITTAPALMAKSDSASPQVATPDQTTATKLVYGLLSDSRYAYRLRPLDEAMSKDIFKRYLEALDSNKQFFTQADIDNFSAFKAEIPDSICNGNLKPAFSIFAMYKKRVAERVTYANQLLKQNFDFSGQEKYEYDRSKAPWPASPQDLDDIWRRSTMNDWLRLKLAGKKPEDIRKTLKKRYANLLKTVNELKGEDVFQLYLNAYTNSIDPHTDYFTPRTADAFNQQMSLSLEGIGAQLQKQEDMVIIREVIPGGPTALDGTLKPGDRIVGVGQGKGGPIEDVIGLRIDDVVSKIRGKKDTQVRLEYIPAESGIDGAHRIVTLTRQKVRLAEQAAKGETITIEGSNGDAQRRIGIIKLPTFYEDFEGRRRNVANYTSATRDVAKLLINFKTDKVDGVVLDLRNNGGGSLDEAIQLTGLFIEQGPVVQVRESGGRVTVNGDRDDKVTWDGPLAVLINRGSASASEIFAGAIQDYGRGLVIGETSFGKGTVQNIVDLDRWPANESRRFGQVKLTIAQFFRISGSSTQHKGVLPDIAFPASVGATEFGESTYENALPWTRIASLQHTQYGNFSPILSKLKKIHISRTANDIEFKWWQEDVHNFSLEKEKKYVILNEAERLAERRKQETQHRERQTIRKNLGLQLDPLSEESDDGLIGNERDIAKDTAREKLADKRPDPLLHESAAILTDTINLLEKDQILSAQVLLQSTTPGHWAN

SEQ ID NO: 1371 - protein, 455 aa, Aspergillus nidulans
MSAPTADIRARAPEAKKVHIADTAINRHNWYKHVNWLNVFLIIGIPLYGCIQAFWVPLQLKTAIWAVIYYFFTGLGITAGYHRLWAHCSYSATLPLRIWLAAVGGGAVEGSIRWWARDHRAHHRYTDTDKDPYSVRKGLLYSHLGWMVMKQNPKRIGRTDISDLNEDPVVVWQHRNYLKVVFTMGLAVPMLVAGLGWGDWLGGFVYAGILRIFFVQQATFCVNSLAHWLGDQPFDDRNSPRDHVITALVTLGEGYHNFHHEFPSDYRNAIEWHQYDPTKWSIWAWKQLGLAYDLKKFRANEIEKGRVQQLQKKLDRKRATLDWGTPLDQLPVMEWDDYVEQAKNGRGLVAIAGVVHDVTDFIKDHPGGKAMISSGIGKDATAMFNGGVYYHSNAAHNLLSTMRVGVIRGGCEVEIWKRAQKENVEYVRDGSGQRVIRAGEQPTKIPEPIPTADAA

SEQ ID NO: 1372 - protein, 265 aa, Arabidopsis thaliana
MVAYPTKKTAIKQFLHCNSQATFKLKLERQEILRIFNLMALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 1373 - protein, 392 aa, Cespedesia bonplandii
DLEPVNPADVPVTAAVALKSYKLAAKAISGLQSLSSGNISMLCNVLVKEVCDLTGYDRVMVYKFHEDEHGEVIAEYHRPDLEPYIGLHYPATDIPQASRFLFMKNKVRMICDCMAPAVKVVQEKKLAQPLSLGGSTLRAPHGCHSQYMANMGSIASLVMSVMINDDDYNEMESDRQKPRKLWGLVVCHHTSPRLVPFPLRYACEFLIQVFGVQINKEVELTAQMKEKQILQTQTVLCDMLLRDTPVAIVTQSPNVMDLVKCDGAALFYKNKFWLIGITPPEDQIRDIACWLNEYHDGSTGLSTDSLMEAGYHGASILSGAVCGMAAIRVSLKDFLFWFRSQAAKEIKWGGAKHDPNEKDNGRNMHPRSSFNAFLEVVKWRSLPWEDMEMDAI

SEQ ID NO: 1374 - protein, 287 aa, Brassica napus
  misc_feature (118)..(118): Xaa can be any naturally occurring amino acid
MVKFERVPLLLGLVLVLTLVVAKASEPVCRQAEKFSRASFPEGFLWGTATAAFQVEGAVDEGCRGPSMWDTFTKKYPHRCQNHNADVAVDFYHRYKEDIKLMIDLNTDAFRLSIAWPXIFPHGRMSKGISKQGVQFYHDLIDELLKNKITPLVTVFHWDTPQDLEDEYAGFLSGNIVKDFTEYANFTFHEYGHKVKNWITFNEPWVFSRAGYDVGKKAPGRCSPYIQEWGKHCEDGRSGFEAYQVSHNLLLAHAYSVEAFRACKQCAGGKIGIAHSPAWFEPADLES

SEQ ID NO: 1375 - protein, 392 aa, Clusia gundlachii
DLEPVNPADVPVTAAGALKSYKLAGKAISKLQSLPSGNILLLCDVLVKEVRELTSYDRVMMYKFHEDDHGEVIAECRRPDLEPYLGLHYPATDIPQASRFLFMKNKVRMICDCMAPPVNVIQDNGLSQPLSLGGSTLRAPHGCHAQYMANMGSIASLVMAVTINEDDDGDREGDQRKQRRLWGLVVCHHTGPRFVPYPLRYACEFLIQVFGIQINKEVELGAQMREKHILETQTVLCDMLLRDSPVAIVTQSPSVMDLVKCDEAALYYKKKFWLLGITPTETQIRDIAEWLLEYHSGSTGLSTDSLMEAGYADASLLGDAVCGMAAIKINSRDFIFWFRSHTAKEIKWGGAKHDPDDKDEGMKMHPRSSFKAFLEVVKWRSLPWEDIEMDAI

SEQ ID NO: 1376 - protein, 391 aa, Croton alabamensis
DLEPVNPADVPITAAGAMKSYKLAAKAISKLQSLPSGNMSLLHDILVKEISDLTGYDRVMVYKFHEDDHGEVVAECRRNDLEPYLGLHFPATDIPQASRFLFMQNKVRMICDCSAPPVKVIQDKSLAQPLSLCGSILRSPHGCHAQYMGNMGTIASLVMSVTINEDDDEMETDRQKGKKLWGLVVCHHTSPSFVPFPLRYACEFLIQVFGVQIIKEVKLAAQKREKHILQTQPLLCDMLLRDDPVAIVTQTPNIMDLVNCDGAALYYKKKIWLLGAAPSEERVRDIAEWPLEYHSESTGLSTDSLMEAGYPGASILGDATCGMAAIRISSRDFIFWFRSHTAKEIKWGGAKHDPGAKDDVRKMHPRSSFKAFLEVVKWRSLPWEDVEMDAI

SEQ ID NO: 1377 - protein, 251 aa, Arabidopsis thaliana
MGRGRVELKRIENKINRQVTFAKRRNGLLKKAYELSVLCDAEVALIIFSNRGKLYEFCSSSSMLRTLERYQKCNYGAPEPNVPSREALAVELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 1378 - protein, 396 aa, Denhamia celastroides
  misc_feature (75)..(78): Xaa can be any naturally occurring amino acid
  misc_feature (170)..(173): Xaa can be any naturally occurring amino acid
YLEPVNPADVPITAAGALKSYKPAAKAISRLQSLPSGNMSLLCDVLVKEVNELTGYNRVMVYRFHDDDHGEVVAXXXXELIWNLIQACNYPATDIPQASRFLFMKSKVRMICDCLAPPVRVLQDKRLAQPFSLGGSTLRSPYGCHAQYMANMGSIASLVMSVTINEDDDXXXXETNSDQQKARRLWGLVVCHHTTPRFVPFPLRYACEFLIQVFGVQINKEVELATQLKEKHILQTQTVLCDMLLRDSPVGILIQSPNVMDLVKCDGAALYYRDKFWLLGLTPTETQIKYIAEWLLEYHSESTGFSTDSLMEAGYPNASILSEAVCGMAAVKITSKDFLFWFQSHTAKEMKWGGAKYDPDYKDDGKRMHPRSSFKAFLELVKQHSLPTEDVEMDAI

SEQ ID NO: 1379 - protein, 391 aa, Dichapetalum macrocarpum
DLEPVNPADVPVTAAGALKSYKLAAKAISKLQSLPSGNISLLCDVLVKEVRDLTGYDRVMVYKFHDDEHGEVVSECHRPHLEPYLGLHYPATDIPRASRFLFMKNKVRMICDCLAAPVKVIQDNRLTQPLSLCGSTLRAPHGCHAQYMENMGSIASLVMSVMINEDDDEDRNCQQKGRKLWGLVVCHHTSPRFVPFPLRYACEFLIQVFGIQINKEVELSAQMREKHVLRIQTVLCDMLLRDAPVAIITQSPNVMDLVRCDGAALYYRKKFWLLGITPTEGQISDIAEWLLEYHRESTGLSTDSLMEAGYPGASDLGDAVCGMAAVRIASKDFLFWFRSHTAKEIKWGGAKHDPDVKDDGRKMHPRSSFKAFLEVVKWRSLPWEDIEMDAI

SEQ ID NO: 1380 - protein, 474 aa, Campylobacter jejuni
MKKLTNDFGNIIADNQNSLSAGAKGPLLMQDYLLLEKLAHQNRERIPERTVHAKGSGAYGEIKITADLSAYTKAKIFQKGEITPLFLRFSTVAGEAGAADAERDVRGFAIKFYTKEGNWDLVGNNTPTFFIRDAYKFPDFIHTQKRDPRTHLRSNNAAWDFWSLCPESLHQVTILMSDRGIPASYRHMHGFGSHTYSFINDKNERFWVKFHFKTQQGIKNLTNQEAAELIAKDRESHQRDLYNAIENKDFPKWKVQVQILAEKDIEKLGFNPFDLTKIWPHSLVPLMDIGEMILNKNPQNYFNEVEQAAFSPSNIVPGIGFSPDKMLQARIFSYPDAQRYRIGTNYHLLPVNRAKSEVNTYNVAGAMNFDSYKNDAAYYEPNSYDNSPKEDKSYLEPDLVLEGVAQRYTPLDNDFYTQPRALFNLMNDDQKTQLFHNIAASMEGVDEKIITRALEHFEKISPDYAKGIKKALEK

SEQ ID NO: 1381 - protein, 352 aa, Methanosarcina mazei
MIEIDGSYGEGGGQLVRTAVALSAVTGEEIKVTNIRENRPNPGLKQQHLKALETAAKICGARVSGLSQGSSELFFAPVEIKGGKYNIDIGTAGSITLLLQCIMPALPFVEEKVELTIRGGTDVAWSPTIDYLKHVTLRALEQFGYAGSVTLKERGYYPRGGGSVSAVFEPCKLHGFHFRKTEGNKKTESNPVGEGLKGEKSMMEEIIGVSHASNLPAHVPARQAESARSLFLEAGYDARIDVSSSEFFSTGSGITLWKGYCGGSALGKKGLPAEKVGRQAAEEVIKELRAGAAVDIHLADQLIPYMALAGNSSFTVRELTLHAATNIWVTEQFLDVKFKIKEKEGLFEVSVG

SEQ ID NO: 1382 - protein, 255 aa, Unknown
  Bradyrhizobium sp. BTAi1
MAADIRVFTCLSDNFGYLIHDPATGATASVDAPEAGPIIRQLEAAGWTLTDILITHHHHDHVGAVAELKQKYGCRVVAPHDKTTAIADVDLRVGHGDVIKVGELLARVLETPGHTLDHVSYVFDADKAVFAADTLFSVGCGRVFEGTYPMMWDSLLKLRALPDDFRLYCGHEYTASNVKFALTVDGDNEALKARAAEVTRLRAANESTIPSLLGDEKQTNVFLRADDPAVAIKLRMKGATAEQVFGELRERKNKS

SEQ ID NO: 1383 - protein, 625 aa, Bradyrhizobium japonicum
MCGIFGWVLAAAKHQNRDTLIGLTDLMSHRGPDASGYWLHQTSDERYQIGFGHRRLSIIDIGGGAQPMATEDGRFNLVFNGEIYNYLELRKELVALGHHFRTDSDTEVLIEAYRAWQLDAVRRLRGMFAFALWDDAEQRLVLARDAFGKKPLFLAEAQGAVLFGSEIEPLVQFPGFSRALDSDAIGHYLLNRYVPGPSTFFQSVKKLQPGHCAVWQNGMLKSTRYYTPPFATTVPDVKDFNSAIRLFEGAFDEAVRIRMRSDAPYGAYLSGGIDSSAVVATMVKHSTEPVRTFSVGFRETGYSELDHARVIAGQFGTIHNDLIVEPSAFMDHWSTAALRRGAPVSEASDIPIFMLSEMASRSVKMVLTGEGADELMGGYPKYRAERWIGLYQWLIPHLLHERLIHPLVRSLPYGMRRAKIVALAAGERDLANRMRVWFGGLSVGESEAMLGRLLSATPPDLFPYSSQIGSSLRRTLFFDQTSWLPDNLLERGDRMMMAGSIEGRMPFMDTVLAGVVARFPDDFLTGGKGGKRVLRAAMDKILPSEIIRRKKIGFRVPIGEWFRGPYREFLRDMLVSETSAVAQMVRGDRLRQLVTEHLDARQNHERLLWSFVNLEIFVRAFRVAS

SEQ ID NO: 1384 - protein, 401 aa, Oryza sativa
MSSGGGRPPAAQHIVRSVRQRFVPLPPPLARAPFAAAPGDYHRFAAASRGGEIEEGIVIRRTPSCGIDAKVEGFVKCLSSGSPGNPSTPASSRYDNSLGLLTRKFINLLKQTQDGILDLNDAAKILDVWVRKRRIYDITNVLEGTGLIEKKLKNRIRWRGSDDSGTNLDSDISCLKTEVENLYIQEQALDRSISEIREKMEELTEDESNHRWLFVTEDDIKGLPCFQNEALIAIKGPRGTTVEVPDPDELLPQKKLSDEHPYYIISQYKKMEELGETATPPRHASVVEPPSIATEAGHSSKQTMPLNVQQDIQETPELNASRAFGRMKKITPSDVDTDADYWLLTDDDISITHMWTTASEMQWDQIDTNDFLAEEISDTPCALNQPSAAASEPTGVGFNHG

SEQ ID NO: 1385 - protein, 466 aa, Glycine max
ILQLSLNSSEAGDSVPSSAFFGTSLKKVTASRVPNVKISSGSFKIVAAEKEIDEQQQTNKDRWKGLAYDISDDQQDITRGKGMVDSLFQAPQETGTHYAVMSSFEYLSTGLKQYNLDNNMDGFYIAPAFMDKLVVHITKNFMTLPNIKVPLILGIWGGKGQGKSFQCELVFAKMGINPIMMSAGELESGNAGEPAKLIRQRYREAADIISKGKMCCLFINDLDAGAGRLGGTTQYTVNNQMVNATLMNIADNPTNVQLPGMYNKQENPRVPIIVTGNDFSTLYAPLIRDGRMEKFYWAPTRDDRVGVCKGIFRTDNVPEDEIVKLVDTFPGQSIDFFGALRARVYDDEVRKWISGVGVDLIGKKLVNSKEGPPTFDQPKMTLSKLLEYGNMLVQEQENVKRVQLADKYLNEAALGDANQDAIKRGTFYGKAAQQVKIPVPEGCTDPNASNFDPTARSDDGTCLYTP

SEQ ID NO: 1386 - protein, 154 aa, Oryza sativa
MSMIRRSNVFDPFSLDLWDPFDGFPFGSGSGSLFPRANSDAAAFAGARIDWKETPEAHVFKADVPGLKKEEVKVEVEDGNVSRSAGERIKEQEEKTDKWHRVERSSGKFLRRFRLPENTKPEQIKASMENGVLTVTVPKEEPKKPDVKSIQITG

SEQ ID NO: 1387 - protein, 465 aa, Akebia quinata
SGKPFYAIVHRVTGSLIIDFEPVKPYEVPMNAAGALQSYKLAAKAIARLQSLPNASMDRLCDTVVQEVFELTGYDRVMAYKFHDDDHGEVVSEITKPGLEPYLGLHYPATDIPQAARFLFMKNKIRMICDCNATHVKVFQDEKLPLDLTLCGSTLRAPHSCHSQYMENMGSIASLGMAVVINEGDEEDNGSGSAQPQRRKRLWGLVVCHNTTPRFVPFPLRYACEFLIQVFAIHINKELELGNQVLEKSVLRTQTLLCDMLMRNAPLGIVSQSPNIMDLVKCDGATLLYKNKIWRLGLSPSEFHIRDIASWLYEYHMDSTGLSTDSLHDAGFPGALSLGDGICGMAAVRITSKDMIFWFRSHTAAEVRWGGAKHDPCEEDDGRKMHPRSSFKAFLEVAKTRSLAWKDYEMDAIHSLQLILRNAFKDGDTADLNPSVIHSRLDNLKIEGMEELEAVTNEMVRLMET

SEQ ID NO: 1388 - protein, 549 aa, Colwellia maris
MAAKDVLFGNDARVKMLRGVNILADAVKVTLGPKGRNVVIDKSFGGPIITKDGVTVAKEIELEDKFENMGAQMVKEVASKANDEAGDGTTTATVLAQAIVNEGLKSIAAGMNPMDLKRGIDKAVIAAVEALKESSTPVTDNKAIEQVGTISANSDETVGKIIATAMEKVGTEGVITVEEGQALTDELDVVEGMQFDRGYLSPYFINKQENGTVELENPFILLVDKKISNIRELLTTLEGVAKAGKPLLIIAEDVEGEALATLVVNNMRGIVKVAAVKAPGFGDRRKAMLQDVATLTAGTVISEEIGMELEKVTLEDLGQAKRVVISKDTTIIIDGIGVEADIQARVSQIRGQIEDSSSDYDKEKLQERLAKLAGGVAVIKIGAATEMEMKEKKSRVEDALHATRAAVEEGVVAGGGVALIRAADAIKDLEGANEDQTHGINVAIRAMEAPLRQIVANCGDEPSVVLNEVRNGKGNYGYNAGNSTYGDMIEMGILDPTKVTRSALQFAASVAGLMLTTEAMITDAPVKDAGGMPDMSGMGGGMGGMGGMM

SEQ ID NO: 1389 - protein, 392 aa, Akebia quinata
DLEPVNPAEDPVTAAGALKSYKLAAKAISRLQSLPSGDISLLCDVLVHEVSDMTGYDRVMVYKFHEDEHGEAVAECLRSDLEPYLGLHYPATDIPQASRFLFLKNKVRMICDCSARSVEIVQDKRLTQPLSLGGSTLRAPHGCHAQYMENMGSVASLVMSVTINEDDDEMETNQQKGRKLWGLVVCHHSSPRFVPFPLRYACEFLIQVFGIQLNKEVELAAQLREKHILRIQTVLCDMLLRDAPVGIFTQSPNVMDLVKCDGAALYYKNKLWLLGVTPTEAQIREIAAWILEYHDRSTGLSTDSLMEAGYPGASVLGDAVCGMAAINITSKDFIFWFRSHTAKEIKWGGAKHDTVDKDDGRKMHPRSSFKAFLEVVQWRSLPWEDMEMVAIQ

SEQ ID NO: 1390 - protein, 979 aa, Debaryomyces hansenii
MSSQVVTNLEETTNQHKAINNPNVVKRIHREVRFGLYILGSTLGEGEFGKVKLGWRKDGKHPSQVAIKLIKRDTIMKDSESEIKIHREINSLKMLNHPNIVNLVEVMKSGKYIGIVLEYASGGELFDYILQHKYLKENVAKKLFAQLVSGVDYMHSKGLIHRDLKLENLLLDKHKNVIISDFGFVNSYNKDKNDLMKTSCGSPCYAAPELVLTQAPYEGRKVDTWSLGVILYAMLAGYLPFDDDPENEDGSDIVRLYHYICKTPLTFPEYISPLARDLLRKIIVPDPKKRITIKNIKNHPWLTPYVNLLSVTQPEWDKVHKDNKTVNPKSAATANNSYTNLIHSNTNKRFSMINEKTNSSSLMMPAGRSYSSTNVVNQLYSNPSAPTTSSSLANAVALSKPKDPASDRSRTPSPTKQLPNGNNYSSTNYQRGHAKSTSISNPYSSASNALKAMVTENDSKRNSLVSLDSTTSSMISLTSSTKPAQHNHLPSPHLPRSTTYTGSAISTIAESPSKPSPATHLAVDNESNVTHHNTASSSNITNLKPNSSSRESAKLPHANKKPRPTSYHPSSMSASLMSSNGSSLQDYIKIPTPLLPIPQLLSTSPTKASPSSETSSPVFTDTNNSSPTMRSNASINSRRNSVVTHVHVNGVLTSESNANHNENKRNSVLSYLEDKMDALELTELHSPLKSNKPGFTDNASDTNITPQINQLPMFDGQTESPIIHTSKAEESQVKDQSEEGNKIETDEHPFVNVANQVDENKVVDLALEKESISEAPEEPNVSHSQDRTNQQENITLEFEEPKYTLEAQPAEPVSQTFKDEPVVSLDEQLIKRDHVNIIDEQEKENLDRKTTNTKKETSREINKSSAKEIKDNKKRNRFSLLSFYSNYNGSSSSNVVLQQAPTSNVSHSGKRILEPSLEQNVPTQPQDQKRNVSNSSGKSSTSKKSNNSGTAHISSNNGKEASAARKVMDFFKRRSVKIG

SEQ ID NO: 1391 - protein, 466 aa, Aristolochia grandiflora
SGKPVYAIIHRVTGSLIIDFEPVKPYEAPMTAAGALQSYKLAAKAISRLQSLPSGSMERLVDTVVQEVYELTGYDRVMAYKFHDDDHGEVISEVTKPDLEPYLGLHYPATDIPQAARFLFMKNKVRMICDCYAKPVKVFQDEKLSFDLTLCGSTLRAPHSCHLQHMKNMSSIASLVMAVVVNEGEEDDNPDPNQQQQVPKRKRLWGLVVCHNTTPRFVPFPLRYACEFFMQVFAIHVNNEIELENQIREKNILRTQTLLCDMLLRDSPLSIVTRSPNIMDLVKCDGAALMYQNKVYTLGLSPTESQISEINRWLLEYHMDSTGLSTDSLHDAGYPNAPSLGDIVCGMAAVRITSTDMLFWFRSHTAGEVRWGGAKHDPSDKDDGRRMHPRSSFKAFLEVVKNRSLPWKDYEMDAIHSLQLILRGSTKETAAIDTKTVISSQLNNLKLDGLHELQAVTNEMVRLMET

SEQ ID NO: 1392 - protein, 240 aa, Triticum aestivum
  misc_feature (140)..(140): Xaa can be any naturally occurring amino acid
  misc_feature (182)..(182): Xaa can be any naturally occurring amino acid
  misc_feature (184)..(184): Xaa can be any naturally occurring amino acid
MSFARAVQRIKSIQNFLTRPTVPHISAAAAGQSRLINMASTTETNNYKFNHSMIRVKDPKASTKFYEFLGMSLVKKLEFPDNKFDLYFFGYDSPNALSHNKSTFDRQGLIELTHNYGTENDPEYKVNNGNQDPHRGFGHXCIAVDNIQAACQRIEDAGYKFQKKLTDGRMRNIAFVLDPDGXWXVEVVARNDYKETENVKETDVSTYTMNHTMLRVKDAEKSPEYYPRSLGMSRLRTLRN

SEQ ID NO: 1393 - protein, 652 aa, Geobacillus stearothermophilus
MIAANPTDLEVYLFHEGSLYKSYELFGAHVINEGGKVGTRFCVWAPHAREVRLVGSFNDWDGTDFRLEKVNDEGVWTIVVPENLEGHLYKYEIVTPDGQVLFKADPYAFYSELRPHTASIAYDLKGYQWNDQSWKRKKRRKRIYDQPMVIYELHFGSWKKKDGRFYTYREMADELISYVLDHGFTHIELLPLVEHPLDRSWGYQGTGYYAVTSRYGTPHDFMYFVDRCHQAGIGVIMDWVPGHFCKDAHGLYMFDGAPTYEYANEKDRENYVWGTANFDLGKPEVRSFLISNALFWLEYYHIDGFRVDAVANMLYWPNNDRLYENPYAVEFLRKLNEAVFAYDPNALMIAEDSTDWPKVTAPTYEGGLGFNYKWNMGWMNDMLKYMETPPYERRHVHNQVTFSLLYAYSENFILPFSHDEVVHGKKSLLNKMPGSYEEKFAQLRLLYGYMMAHPGKKLLFMGNEFAQFDEWKFEDELDWVLFDFELHRKMNDYMKELIACYKRYKPFYELDHDPQGFEWIDVHNAEQSIFSFIRRGKKEDDVLVIVCNFTNQAYDDYKVGVPLLVPYREVLNSDAVTFGGSGHVNGKRLSAFNEPFHGKPYHVRMTIPPFGISILRPVQKRGERKRNEKEMHRHVIGRRARKSASLADDKHR

SEQ ID NO: 1394 - protein, 349 aa, Pseudomonas syringae
MTTIFDPITLGDLQLPNRIILAPLTRCRADEGRVPNALMSEYYVQRASAGLILTEATSVTPMGVGYPDTPGIWSNDQVRGWSNITQAVHNAGGRIVLQLWHVGRISHPSYLNGETPVAPSAIAAQGHVSLMRPITPLPTPRALELAEIGDIVEAYRVGAENAKAAGFDGVEVHGANGYLLEQFLLTGSNQRTDQYGGSLENRARLLLEVTDAVIDVWGAGRVGVHLSPRFDMHNMSDENRAETFSYVAKELGKRGIAFICARERDAEDSLGPQLKKDFGGVYIANEKFTKDSANAWLAEGKADAFAFGVPYIANPDLPERLASDAPLNEAHPETFYGKGPVGYIDYPRL

SEQ ID NO: 1395 - protein, 392 aa, Aristolochia grandiflora
DLEPVNLADAQVSASGALKSYKLAAKAISRLQSLPSGNIVLLCDVLVREVRDLTGYDRVMAYKFHEDEHGEVIAECKRPDLEPYLGLHYPATDIPQASRFLFMKNKVRMIYDCSATPVSVIQDKGLAQPLCLGGSTLRAPHGCHSQYMANMGSIASLVMSVTINEDDDEKGSGQRGRKLWGLVVCHHCSPRFIPFPFRYACDFLMQVFGIQINKEVELAAQVREKHILRTQTLLCDMLLRDAPMGIVNKSPNVMDLVKCDGAALYYQNKFWLLGTTPTEAQIRDLAQWLLQYHNNTTGLSTDSLVEAGYPGAQDLGDAVCGMAAVKITSRDFLFWFRSHAGKEIKWGGAKHDPKEHDGDGKKLHPRSSFNAFLEVVKWRSTPWEDVEMDAIQ

SEQ ID NO: 1396 - protein, 554 aa, Asparagus falcatus
PYEVPMTAAGALQSYKLAAKAISRLESLPGGSMEKLCNAVVEEVFELTGYDRAMAYRFHEDDHGEVFSEVTKPGLEPYLGLHYPATDIPQAARFLFMKSKVRMICDCRAKPVRVLQDEKLPFDITFCGSTLRAPHSCHLQYMENMNSIASLVMAVVVNEGGEDEGEGEAGQASSPAQQQQGLRRKRLWGLVVCHNESPRFVPFPLRYACQFLMQVFAIHVNKEFELEHQIREKNILRTQTLLCDILLREAGPLGIVTARSPNVTDLVRCDGAALLYEDKIWRLGRTPTDSEIRDIAYWLVEYHADSTGLSTDSLLEAGYPGAFALGDLVCGLAAARINSRDILFWFRSHTAAEVRWGGAKHDPSDEDDGRRMHPRSSFKAFLEVVKTRSLPWSDYEMDAIHSLQLILRGSFNDVKKSEGLDSRMRSLRVEGMEELQAVTNEMVRLIETATVPILAVDVDGVINGWNLKIAELTGLPVDEAIGKHLLALVEDSSVAQVRRMLLLALQGTEEQNVEFQMKTCGDRGDDGPVILVVNACASRDLNEKVVGVCFVAIT

SEQ ID NO: 1397 - protein, 391 aa, Dillenia philippinensis
DLEPVNPTDVPVTAAGALKSYKLAAKAISRLQSLPSGNMSLLCDALVQEVSDLTGYDRVMVYKFHEDDHGEVVAECRRPDLEPYLGLHYPATDIPQASRFLFMKNKIRMICDCLAPPVQVIQDKCLAQPLSLCGSTLRSPHGLHAQYMANMGSIASLVMSVTINEDDDEVESDKQKGRKLWGLVVCHHTSPKVVPFPLRYACEFLIQVFGVQVNKEVELAAQLKEKHILKTQTVLCDMLLRDAPVGIVTQSPNVMDLVKCDGAALYYRNKFWLLGITPTEAQIRELAGWLLDCHNGSTGLSTDSLMEAGYPGASILGDALCGMAAIKITSKDFLFWFRSHTAKEIKWGGAKHDPVDKDDGKKMHPRSSFKAFLDVVKRRSFPWEDVEMDAI

SEQ ID NO: 1398 - protein, 461 aa, Zea mays
  misc_feature (224)..(224): Xaa can be any naturally occurring amino acid
  misc_feature (265)..(265): Xaa can be any naturally occurring amino acid
  misc_feature (424)..(424): Xaa can be any naturally occurring amino acid
MARSRQEGEAGGEERKLVLGKYELGRLLGQGTFAKVYYARDLSAAAGTGSTSVAIKVIDKARLRRMEGMVEQLRREISVMRMVRHPNVVGIREVLASRSRVFVVMEYARGGELFAKVARGRLTEDHARRYFQQLVAAVGFCHRRGVAHRDLKPENLLLDEDGRLKVTDFGLAALPEQLRHDGLLHTQCGTPAYVAPEVLRKRGYDGARADLWSCGVVLYVLLCXFLPFQHDNCAKMYQRIFKAEYQVPPWVSGDARRLIARLLVXDPAKRASIPEVMCTPWFRKGFVPPVLSVSPPMTPKKRLDGDDGGGGALFDSSSNSGATSPRSCNAFQLISSMSSGLDLSGLFENEHKAATVFTARAPAATVVEKLESAARALGFETTRGKGWKVRMEAKAGGTNGRLAVTAEVLEVAVDVAVVEFAHDXGPALAFTKFCPVDVRPALPEIVWAWQGDSPAAAVGPA

SEQ ID NO: 1399 - protein, 391 aa, Dissiliaria muelleri
DLEPVNPADVPVTAAGALKSYKLAAKAISRLQSLPSGNISLLCDVLVKEVSDLTGYDRVMVYRFHEDEHGEVVAECRQPDLEPYLGLHYPATDIPQSSRFLFMKNKVRMICDCMAPPVEVVQDERLSQPLSLCGSTLRSPHGCHAQYMANMGSVASLVMSVTINEDDDEMDGDQQTGRKLWGLVVCHHTCPRFVPFPLRYACEFLVQVFGVQINKEVELAAQMREKHILRTQTVLCDMLLRDAPVGIITQSPNVMDLVKCDGAALYYRKKFWLLGVTPTEAEIRDIAEWLLECHSGSTGLSTDSLMEAGYPGASILGDAVCGMAAVRITSKDFLFWFRSHTAKEIKWGGAKHDPGDKDDGRKMHPRSSFKAFLEVVKRRSLPWEDVEMDAI

SEQ ID NO: 1400 - protein, 391 aa, Dovyalis rhamnoides
DLEPVNPADVPVTAAGALKSYKLAAKAISRLQSLPSGNISLLCDVLVKEVSALTGYDRVMAYKFHEDQHGEVVAECCRPDLEPYLGLHYPATDIPQASRFLFMKNKVRMICDCLAPPVKVVEHKRLAQPLNLCGSTLRSPHGCHVQYMENMGSIASLVMSVTINEDDDEMDSDQQKGRKLWGLVVCHHTSPRFVPFPLRYACEFLLQVFGVQINKEVELAAQMREKHILETQTVLCDMLLRDAPAAIITQSPNVMDLVKCGGAALYFRKKFWLLGVTPTEAQIRDLSEWLLQYHSESTGLSTDSLLEAGYPGASALGDAVCGMAAIKISSKDFLFWFRSYTAKEIKWGGAKHDPDDKDDGRKMHPRSSFKAFLEVVKRRSLPWEDVEMDAI

SEQ ID NO: 1401 - protein, 391 aa, Putranjiva roxburghii
DLEPVNPSDVPVTAAGALKSYKLASKAISRLQSLPVANISLLCDVLVKEVRDLTGYDRVMVYRFHKDEHGEVVAECCRPDLEPYLGLHYPATDIPQASRFLFVKNKVRMICDCMAPAVKVIQDKRVARPLSLCGSTLRAPHGCHTQYMVNMGSIASLVMSVTINEDDDEMDSDQEQGRRLWGLVVCHHTSHRFVPFPLRYACEFLIQVFGVQIDKEVELARQMRKNIFCKLKLVLCDMLLRDAPMAIITQSPNVMDLVNCDGAALYYRKKIWLLGVTPTEAQIRDITEWLLEYPSGSTGLTTDSLMEAGYPGASILGGSVCGMAAIRITSNDFLFWFRSHTAKEIKWGGAKHDPGDKDDGRQMHPRSSFKAFLGVVKWRSLPWEDIEMDAI

SEQ ID NO: 1402 - protein, 392 aa, Elaeodendron orientale
DLEPVNPADVPITAAGALKSYKLAAKAISRLQSLPSGNISLLCDVLVKEVNELMGYDRVMVYRFHDDDHGEVVAEYCRPDLEPYLGLHYPATDIPQASRFLFMKNKVRMICDCLAPPVKVLQDKILAQPLSLSGSSLRSPHGCHAQYMANMGSIASLVMSVTINDDDDDETNNDQQKGRKLWGLVVCHHTTPRFVPFPLRYACEFLIQVFGVQINKEVELATQLKEKHILRTQTVLCDMILRDAPVGILTQSPNVMDLVKCDGAALYYRNKVWLLGVTPTETQIKEIVEWLLEYHSESTGLSTDSLMEAGYPDASILGEAVCGMAAVKITSKDFLFWFRSHTAKEMKWGGAKHDPDDKDDGKRMHPRSSFKAFLEVVKIRSLPWEDVEMDNH

SEQ ID NO: 1403 - protein, 640 aa, Corynebacterium glutamicum
MCGLLGILTANGNAEAFVPALERALPCMRHRGPDDAGTWHDADAAFGFNRLSIIDIAHSHQPLRWGPADEPDRYAMTFNGEIYNYVELRKELSDLGYAFNTSGDGEPIVVGFHHWGESVVEHLRGMFGIAIWDTKEKSLFLARDQFGIKPLFYATTEHGTVFSSEKKTILEMAEEMNLDLGLDKRTIEHYVDLQYVPEPDTLHAQISRLESGCTATVRPGGKLEQKRYFKPQFPVQKVVKGKEQDLFDRIAQVLEDSVEKHMRADVTVGSFLSGGIDSTAIAALAKRHNPDLLTFTTGFEREGYSEVDVAAESAAAIGAEHIVKIVSPEEYANAIPKIMWYLDDPVADPSLVPLYFVAAEARKHVKVVLSGEGADELFGGYTIYKEPLSLAPFEKIPSPLRKGLGKLSKVLPDGMKGKSLLERGSMTMEERYYGNARSFNFEQMQRVIPWAKREWDHREVTAPIYAQSRNFDPVARMQHLDLFTWMRGDILVKADKINMANSLELRVPFLDKEVFKVAETIPYDLKIANGTTKYALRRALEQIVPPHVLHRKKLGFPVPMRHWLAGDELFGWAQDTIKESGTEDIFNKQAVLDMLNEHRDGVSDHSRRLWTVLSFMVWHGIFVENRIDPQIEDRSYPVEL

SEQ ID NO: 1404 - protein, 369 aa, Desulfotalea psychrophila
MSELFELAKINGLELKNRFIRSATYEAMAGLDGRVTDQLLLYMANLAQGELGLIISGHTHVTLEGQAGPRQMGIYSDEMIEGLQRFTATVHENGGLIAAQLAHAGLRAIGRNEYAPLSPSDLFAGSLKVASEMTVDDIARTVKAFGDAGQRAVAAGFDAIQIHAAHGYLLSQFLSPHYNTRDDLYGGSLENRARFLIQVYEEIRQRVGTSFPIMVKINSEDFLPGGITTEEVLKVCQMLEESGIDAIEMSGGTLESEELIPSRVGTATSAEREVYYRKAAEAFRKKKIAVPLILVGGFLSLYIAEEVVASGLADFVALSRALVREPHLVKRWAAGDRKKATCISCNKCFLTLAMPEGLYCAVEKKARRK

SEQ ID NO: 1405 - protein, 366 aa, Xanthomonas campestris
MSSLFSPYQLKDVSLRNRIAIPPMCQYTATDGFTNDWHQVHYASMARGGAGLVIVEATGVSPEGRITPGCLGLWNDAQAEGLAGIAASISAAGAVPGIQIGHAGRKASANLPWEGDDHIADGDARGWDTLSPSAVAFGANLPKLPRAMDLDDIARVRGDFVAAAKRALAAGFKWLELHFAHGYLAQSFFSVHANQRQDAYGGSAENRARFLLETLQAVRAVWPEHLPLTARFGVIEFDGRDEETLQEAIALTRNFKRDGLDLLNVSMGFSTPNAVIPWGPALLAPIAERVSREAALPVASSWNIDDPLEADRVVAAGQMELVMVGRAHLANPHWPYHAALALGEERPSRVLPPSYAHWLARYGKRS

SEQ ID NO: 1406 - protein, 917 aa, Pseudomonas chlororaphis
MLKKLGIKGRVLLLTLLPTSLMALVLGGYFTWMQQSDLQTQLLQRGEMIAEQLAPLVAPALAHQNTALLERIATQSLEQQDVRAVSFLAPDRTPLAHAGPSMLNQAPTGNGSQMLQRTGSDATRYLLPVVGRHRNLAGDLIPDESDRLLGWVELELSHNSMLLRGYRSLFASLLLITAGLICTGLLALRMGRTINNPLSQIKQAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLRLPKTRDDAEDLPAPPLLGRRVAVLENHELARQALQHQLEDCGLEVTPFNTLEALTNGVTGVHQTEQAIDLAVLGITTNDMPPERLNQHIWDLEHLGCKVLVLCPTTEQTLFHLSVPNPHSQLQAKPACTRKLRRALADLVNPKAVRSEPSEPIASRPPRVLCVDDNPANLLLVQTLLEDMGAKVLAVDSGYAAVKAVQNESFDLVMMDVQMPGMDGRQSTEAIRQWESERNCTPLPVIALTAHAMANEKRALLQSGMDDYLTKPISERQLAQVVLKWTGLALRNQGPERTGEPSGNGHELQVLDHDEGLRLAAGKADLAADMLAMLLASLEADREAIRAARAANDHNALIERVHRLHGATRYCGVPQLRAACQRSETLLKQEDIKAFAALDELERAINRLATEARINA

SEQ ID NO: 1407 - protein, 544 aa, Agrobacterium tumefaciens
MAAKEVKPGASAREKMLKGVDILADAVKVTLGPKGRNVVIDKSFGAPPITKDGVSVAKEIELEDKFENMGAQLVREVASKTNDIAGDGTTTATVLAQAIVREGAKAVAAGMNPMDLKRGIDLAVAEVVKDLQAKAKKINTSEEVAQVGTISANGERQIGLDIAEAMQRVGNEGVITVEEAKTAETELEVVEGMQFDRGYLSPYFVTNPEKMVADLEDAYILLHEKKLSNLQAMLPVLEAVVQTGKPLVIIAEDVEGERLATLVVNKLRGGLKIAAVKAPGFGDRRKAMLEDIAILTGGTVISEDLGIKLESVTLDMLGKSKKVSISKENTTIVDGAGQKSDIEGRVAQIKAQIEETTSDYDREKLQERLAKLAGGVAVIRVGGSTEVEVKEKKDRIDDALNATRAAVQEGIVPGGGVALLRSSTKITVKGVNDDQEAGINIVRKALQSLVRQIAENAGDEASIVVGKILDKNEDNYGYNAQTGEYGDLIALGIVDPVKVVRTALQNAASVASVLITTEAMIAELPKKESAMPQMPGGGMGGMDF

SEQ ID NO: 1408 - protein, 217 aa, Vibrio fischeri
MSLQYQIIPVTSYEQNCSIVWCDETMKGVVIDPGGDVQLLKQAIEALNVDVVHMVLTHGHLDHVGGTEDLAAITNATIVGPHKEDNFWLQGLPNQSERFGFPHTEAFEPSQWLNEGDVIEFGNQKLDVLHTPGHTPGHVVLFNQEAKMAFVGDVLFKGAIGRSDFPKGDFDTLISSIKTKLWPLGNDMRFVPGHGPESTFGHERQTNPFVADKMPLW

SEQ ID NO: 1409 - protein, 334 aa, Nitrosomonas europaea
MHTGTTLTQFIIEEQRHIAGASGDFTALLNDIVTAIKTISNAVNKGALIGVMGALDTENVQGETQKKLDVITNEIMIRNNEWAGHLSGMASEEMDDVYSIPSPYPLGKYLLVFDPLDGSSNVDLNISVGTIFSILRSPVPSRAASMEDFLQPGVKQVCAGYALYGSSTMLVLTTGHGVNGFTLDRDIGEFVLTHPNMRIPADTREFAINASNQRFWEAPVQRYVAECLAGSTGPRGRDFNMRWVASMVAEVHRILTRGGIFMYPRDTKDPSKPGRLRLMYEANPMSFIVEQAGGLSTTGYERILDVVPQDLHQRVPVILGSKNEVEVVLEYHNA

SEQ ID NO: 1410 - protein, 240 aa, Zea mays
MGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 1411 - protein, 142 aa, Streptococcus thermophilus
MLNKIQPRNSDTYSMTPFDFFEDFSRNLFNDFKSNLIKTDIHETDNEYLVEAELPGIPKENIQVTYEDGVLTISGQQQIDTVDEDKKGKLIRSERSSTSLRRQYLLENVKEDEIKASYSDGILKVTLPKDSNKEIKKSIPIE

SEQ ID NO: 1412 - protein, 212 aa, Zea mays
EACYNYGFLPADRGKHQPPPAPHATLPHAAADFLCISEDAGELWEYFPCPFCYIEVEVPFICNHLQEEHCFDTRNAVCPICANNLGKDMAAHFRLQHTHLLKRRKPYRPSSCPAAATSPATYQVNSYYEEAEPQQHYSRPYKDPAPDPLLSQFICSVDAIPGDDNAQKDDQRLKLNNKGATASDDDASSKLGLEERLQRIDFLTEILMSTIL

SEQ ID NO: 1413 - protein, 439 aa, Arabidopsis thaliana
MDKNGIVLMRKYELGRLLGQGTFAKVYHARNIKTGESVAIKVIDKQKVAKVGLIDQIKREISVMRLVRHPHVVFLHEVMASKTKIYFAMEYVKGGELFDKVSKGKLKENIARKYFQQLIGAIDYCHSRGVYHRDLKPENLLLDENGDLKISDFGLSALRESKQQDGLLHTTCGTPAYVAPEVIGKKGYDGAKADVWSCGVVLYVLLAGFLPFHEQNLVEMYRKITKGEFKCPNWFPPEVKKLLSRILDPNPNSRIKIEKIMENSWFQKGFKKIETPKSPESHQIDSLISDVHAAFSVKPMSYNAFDLISSLSQGFDLSGLFEKEERSESKFTTKKDAKEIVSKFEEIATSSERFNLTKSDVGVKMEDKREGRKGHLAIDVEIFEVTNSFHMVEFKKSGGDTMEYKQFCDRELRPSLKDIVWKWQGNNNNSNNEKIEVIH

SEQ ID NO: 1414 - protein, 1132 aa, Bdellovibrio bacteriovorus
MNHKNRLFLFTSVLVLGTLLIAGTVGYKMGSSSLEQSTRERLVQIRDFKSDEIQKEFAYLKNALVLTSEYTPILQFLRRYPQEHQQMQSWLRSHGKATAWRNEMEEHRPPQVSDYPRILEQFTALPLFLQYQFQQSARSQNRPLPQLASVNGFSDLNYFRSYESLHSKLFDVLERSHLNDVLLIEPNGTVAYSAAKSLALGDNLISGPLSNSRLAQAYRWSLNAPKGATKYFDFTPVSHFWHTPAAFLTMPLFDQTNFVGTLVFQLSLERIDQILSHNSKWKELGLGMTGEVVAFGTDGFVRNNPRLYLESPVQFLQKVRQQEDARAALESIERSSSASLSLILPPTQIRRYMERGVAFDSGEDYMGTRSLQSAGRVNVVDNTDWIIISKMDLNEALAPLSFKLPWFFIGGFLLWSLALGGAWLVYRRMFFPSQVLSDGMDKLKSHNFSETLQAPEEEEYKDLYKKFDEIREDFRKTKAARDFLENVVYSLNEVFFIVEVEDVEDSLRKNFRVRGFNPTAQSLTGAPGPALKNSDLSLWLETDYSVIENSLRERDANKSTHTAEASLKKITGDRVPLEVSWARVNTENKDKVLLAMMGTDMRWKKEIEKELKLKEELLKESQSLSKTGSFRWDIRTGKCLWSEEEFHLLGLTPDNVVPSYDLFRSLILSEDLPVFDKALAEAHKNIAPFHVDLRMKKQDSNDLIWVRCQGRTEYDDYGNALFMYVTTQDITELRRVEQSLITTKNEALKASQAKSEFLAQMSHEIRTPMNAIMGMAELLKETRLDVDQKYYVTIFCKAGEVLMSLINDILDLSKIEAGEVSIENIPFDMKKLMADVEDMMKPRALEKGLNCICEIAPGVSPHLMGDPTKLRQVLINLIGNSIKFTNKGQVRLVIGKNPSKKDTLLISITDTGIGIPEDRQHMIFQKFSQADNSVTRKYGGTGLGLAISKSLVELMGGQIWFKSRPGTGTTFFFTIPYREQIYNPVNYMPVPMRTPELDFVSPKPRDPNHKVKILIADDTEDNRTLFTHYLKNEPFEIIEAENGLQAIDQIKSGEFDIVFMDVQMPEMDGYAATDRIREWEKESHKPPVPIIALTAHALAEDRQKSLRAGCNDHIAKPFKKDTLLGVINKYSL

SEQ ID NO: 1415 - protein, 444 aa, Asparagus falcatus
  misc_feature (59)..(59): Xaa can be any naturally occurring amino acid
DLEPVNPADVPVTAAGALKSYKLAAKAISRLQSLPSGNISLLCDVLVREISDLTGYDRXMAYKFHDDEHGEVIAECRRSDLEPYIGLHYPATDIPQASRFLFMKSKVRMICDCSAHPVKIIQDKKLAQPLSLCGSTLRAPHGCHAQYMSNMGSVASLVMSVTINEDDDESGSDQKGRKLWGLVVCHHTNPRFVPLPLRYACEFLLQVFGIQLNKEVELAAQAREKHILRTQTVLCDMLLRDAPIGIFTQTPNVMDIVKCDGAALYYKNQIWVLGTTPAEPQIRDISAWLLECHDGSTGLSTDSLMEAGYPGALALGDAVCGMAAIKITDKDFIFWFRSHTAKEIKWGGAKHEPANRDDEGRKLQPRSSFKAFLEVVKWRSLPWEDIEMDSVHSLQLILRESLHNEIAVGESKTLVNSTLDDMKRIQGMDELRAVTNEMVRLIET

SEQ ID NO: 1416 - protein, 540 aa, Arabidopsis thaliana
MRRFLINQAKGLVDHSRRQHHHKSPSFLSPQPRPLASSPPALSRFFSSTSEMSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIAAGIEARDGFPADPNDIFLTDGASPAVHMMMQLLLSSEKDGILSPIPQYPLYSASIALHGGSLVPYYLDEATGWGLEISDLKKQLEEARSKGISVRALVVINPGNPTGQVLAEENQRDIVNFCKQEGLVLLADEVYQENVYVPDKKFHSFKKVARSLGYGEKDISLVSFQSVSKGYYGECGKRGGYMEVTGFTSDVREQIYKMASVNLCSNISGQILASLVMSPPKPGDDSYDSYMAERDGILSSMAKRAKTLEDALNSLEGVTCNRAEGAMYLFPRINLPQKAIEAAEAEKTAPDAFYCKRLLNATGVVVVPGSGFGQVPGTWHFRCTILPQEDKIPAIVNRLTEFHKSFMDEFRN

SEQ ID NO: 1417 - protein, 209 aa, Ustilago maydis
MIVLALIAKGSNILAETHDPAHDRFLPAAQTILSRIPPNSSKLSYAFEDWLFHYVSQDGMVYMAVADADTGRRMPFTFLAHIQKHFLSTYDVPEAGDSDMDYSSLTTTLSKLIKQFNSDPQAVDPIAQAKTELAGVKDIMTQNVEQILSRGERIELLMDRTDNAANQSMAFRRRAVGLRRQMWWKNAKVMALAGFSGLVFLFFLWGMFR

SEQ ID NO: 1418 - protein, 463 aa, Ceratophyllum demersum
GKPFYAVVHRVTGSLVIDFEPVRPYEVPTTAAGALQSYKLAAKAITKLQSLPSGSMQRLCDTIVKEVYELTGYDRVMVYKFHEDDHGEVVAEVTKPNMEPYLGLHYPATDIPQASRFLFMKNKVRMICDCHAKAIKVYQDGNLPMDLTLCGSTLRAPHSCHVQYMHNMGSVASLVMAVVVNEGEDDQGESTESGQQRKKKLWGLVVCHNTSPRFVPFPLRYACEFLMQVFAIHVGKQIELENQLQEKNILRIQTLLCDMLMRDSPLGIVSKSPSIMDLVKCDGAALLYKNKVWLLGLTPSELQIHDIASWLSTHHMDSTGLSADSLYDAGYPGALSLGNAVCGMASVRITSKDMIFWFRMHTASEVRWGGAKHYPDDKDDGQKMHPRSSFKAFLEVVKTRSLPWKDYEMDAIHSLQLILQGTFKEIENGGIKNTIDSQFDGLKIDQMEELQVVANEMVRLMET

SEQ ID NO: 1419 - protein, 356 aa, Ceratophyllum demersum
ILHRIDAGIVIDLEPVNPSDVPVTAAGALKSYKLAAKSISRLQSIPSGNISLLCDVLVREVSELTGYDRVMAYKFHEDEHGEVIAECKRSDLEPYLGLHYPATDIPQASRFLFMKNRVRMICDCMVKPVKVIQDKRLNQSLSLCGSTLRAPHGCHAQYMANMGSIASLVMSVTINDDEEEEAPGEVQNQKTRKLWGLVVCHHTSPRFVPFPLRYACEFLIQVFGIQLNKEVELAVQLREKHILRTQTMLCDMILRDTPIGIVTRSPNVMDLVKCDGAALYYQNQFWLLGITPTEVQIRDILLWLLEYHKGTTGLSTDSLMEAGYPGALVLGDAVCGMAAIEITPKDYLFWFRSHTA

SEQ ID NO: 1420 - protein, 541 aa, Bifidobacterium longum
MAKIISYDEEARQGMLEGLDKLANTVKVTLGPKGRNVVLDKTYGAPTITNDGVSIAKEIDLEDPYERIGAELVKEVAKKTDDVAGDGTTTATVLAQSLVHEGLKNVVAGSNPIALRRGIEKATEVIVKELVAAAKDVETKDQIAATATISAADPEVGEKIAEALDKVGQDGVVTVEDNNRFGLDLDFTEGMRFDKGYIAPYFVTNADDQTAVLEDPYILLTSGKVSSQQDIVHVAELVMKTGKPLLIIAEDVDGEALPTLILNNIRGTFKSCAVKAPGFGDRRKAMLQDMAILTGAQVVSDELGLKLESVDTSVLGHAKKVIVSKDETTIVQGAGSKEDIDARVAQIRAEIENTDSDYDREKLQERLAKLAGGVAVIKVGAATEVEAKERKHRIEDAVRNAKAAIEEGLLPGGGVALVQAAAKAEKTEAVTSLTGEEATGAAIVFRAIEAPIKQIAENAGVSGDVVINTVRSLPDGEGFNAATDTYEDLLAAGVTDPVKVTRSALQNAASIAGLFLTTEAVVANKPEPKSAAPAAGADMGY

SEQ ID NO: 1421 - protein, 465 aa, Coptis trifolia
SGKPFYAIAHRVTGSLIIDFEPVKPYEVPMTAAGALQSYKLAAKAITRLQSLPGGSMERLCDAVVQEVYELTGYDRVMAYKFHEDDHGEVVSEVTKEGLEPYLGLHYPATDIPQAARFLFMKNKIRMICDCRAKHVRVLQDEKLSFDLTLCGSTLRAPHSCHLQYMENMDSIASLVMAVVVNDDDEDDEGTRPSQPQKRKRLWGHAVCHNTTPRFVPFPLRYACEFLIQVFAIHVSKEFELENQILEKNILRTQTLLCDMLMRNVPLGIVSQSPNIMDLVKCDGAALLYKNKIWRLGSSPNEIQIRDIASWLSDYHMDSTGLSSDSLYDAGFPGALSIADTVCGMAAVRINSKDMLFWFRSHTAAEVRWGGAKHDPGEKDDGRKMHPRSSFKAFLEVVKTRSAPWKDYEMDAIHSLQLILRSAFKDIETTDGNTKAFHSQLDNLKINGMEELEAVTNEMVRLIET

SEQ ID NO: 1422 - protein, 492 aa, Raphanus sativus
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLVSKSGKVLFVKFHWKPTCGIKNLTDEEAKVVGGANHSHATKDLHDAISSGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPIPSKSYTGIRTKCVIKKENNFKQAGDRYRSWAPDRQDRFVKRWVEILSELRLTHEIRSIWISYWSQADRSLGQKLASRLNVRPSI

SEQ ID NO: 1423 - protein, 448 aa, Zymomonas mobilis
MALASTGMLIPALTSSMAAVDSQNKDTYHQLDQFMRVFEQVKSSYVDKVDDQKLIQGAIDGMLSNLDPHSSYMNAHQFANIKTQADGNYGGLGLTVMAQDGILKVISPMKDTPSWRAGLKAGDYITHIDGQFIYGSNIDDSVSKMRGKPGTSVKLTVVRPGRDKEFDVTLTREIIQVQSVKWAVTNHIGVITVSSFSHNVGADVTKAIADIEKQNKGAPLGYILDLRSNPGGLLDQAVALSDIFLDHGEVVSERGREKTDIRRYFSKPGDLANGLPLIVLVDGGSASASEIVSGALQDHHRALIMGTRSFGKGSVQTLLPLGDDTALRLTTARYYTPSGRSVQEGGIEPDIIVPQLSDPDYKTRPKLREADLLRHLVNQANTDNSLLEDDNGKTDPQFTATPESLKKENITDFQLDYALKTIGRISRQPSPITKEIPAGKSATPSGRE

SEQ ID NO: 1424 - protein, 391 aa, Coptis trifolia
DLEPVNPADVPVTAAGAMKSYKLAAKAISRLQSLPSGNIAVLCDVLVQEVSDLTGYDRVMVYKFHEDDHGEVIAECRVPELEPYLGLHYPATDIPQASRFLFMRNKVRMICDCSAAPVKVIQDNKLEQPLSLGGSALRAPHGCHAQYMANMGSVASLVMSVTINENDDQMETDQQKGRKLWGLLVCHHTSPRFVPYPLRYACEFLIQVFGMQINKEVELATQVRERHILQTQTVLCDMLLRDAPIGIVTQSPNIMDLVKCNGAALYYRSRFWLLGVTPTEAQIRDIAEWLLQYHNASTGLSTDSLMEAGFPGASVLGTAVCGMAAIKITLKDFLFWFRSHTAKEIKWGGAKHNPTEKDDGWKMHPRSSFKAFLEVVKHRSLPWEDVEMDAI

SEQ ID NO: 1425 - protein, 679 aa, Pseudomonas aeruginosa
MTAAVPYPHLLAPLDLGFTTLRNRTLMGSMHTGLEEKPQGFERMAAYFAERARGGVGLMVTGGIGPNEEGGVYSGAAKLSTPEEAEKHRIVTQAVHEAGGKICMQILHAGRYAYSPKQVAPSAIQAPINPFKPKELDEEGIEKQIADFVNCASLAQVAGYDGVEIMGSEGYFINQFLVQHTNQRTDRWGGSYENRMRLPVEIVRRVREAVGPNFIIIYRLSMLDLVEGGSSWDEIVLLAKAVEKAGATLINTGIGWHEARIPTIATKVPRAAFTKVTAKLRGEVGIPLITTNRINTPEVAEKVLAEGDADMVSMARPFLADPDFVNKAAAGHAERINTCIGCNQACLDHTFGGKLTSCLVNPRACHETELNYIPTTRPKKIAVVGAGPAGLAAATVAAERGHRVSLFDAAGEIGGQFNVAKRVPGKEEFHETLRYFRNKLESTGVELHLNRRVGVDDLVAGGYDEIVLATGIVPRTPAIPGIEHPKVISYLDAILERKPVGGKVAVIGAGGIGFDVSEFITHAGPSTSLEREAFWKEWGIDTRLEARGGIAGIKAEVHPAARQVFLLQRKKSKVGDGLGKTTGWIHRAGLKNKQVQMVNAVEYLRIDDAGLHIRVAEGEPQVLPVDTVIVCAGQDPLRELQDGLLAAGQSVHLIGGADVAAELDAKRAINQGSRLAAEL

SEQ ID NO: 1426 - protein, 391 aa, Elatine triandra
DLEPVNPADVPVTAAGALKSYKLAAKAISRLQSFPSGNIPLLCDVLVKEVSDLTGYDRVMVYKFHEDEHGEVIAECRKPDLEPYLGLHYPATDIPQASRFLFMKNKVRMICNCMVTPVKVIQDKRLPQPLSLSGSTLRSPHGCHAQYMANMGSIASLVLSVTINEEDDKIDGDQLLGRKLWGLVVCHHTNPRFVPFPLRYACEFLIQVFGVQINKEVELATQVKEKHILRTQSVLCDMLLRDAPVAIVTQSPNVMDLVNCDGAALYYKKKFWLLGVTPSEAQIRDIGDWILECHSSNTSLSTDSLMEAGFPGASVLGEAVCGMAAIKITSKDFLFWFRSHTAKEIKWGGAKHDPDDKDDGRKMHPRSSFRAFLEVVKWRSLPWEDVEMDAI

SEQ ID NO: 1427 - protein, 391 aa, Elatine triandra
DLEPVNPADVPVTAAGALKSYKLAAKAISRLQSLPSGNIPLLCDILVKEVRDLTGYDRVMVYKFHEDEHGEVIAECRKHDLEPYLGLHYPATDIPQASRFLFMKNKVRMICDCMATPVKVIQDKRLPQPLSLSGSTLRSPHGCHAQYMANMGSIASLVLSVTINEEDDKIDGDQLLGRKLWGLVVCHHTNPRFVPFPLRYACEFLIQVFGVQINKEVELATQVKEKHILRTQSVLCDMLLRDAPVAIITQSPNVMDLVNCDGAALYYKKKFWLLGVTPSEAQIRDISDWLLECHSGNTGLSTDSLMEAGFPGASVLGEAVCGMAAIKITSKDFLFWFRSHTAKEIKWGGAKHDPDDNDDGRKMHPRSSFRAFLEVVKWRSLPWEDVEMDAI

SEQ ID NO: 1428 - protein, 566 aa, Cladosporium fulvum
MAPSATAHSADGRTTGDIHRDYNDDRNASAEDTVYCTSNGVPIAHPYEAQRVGDNGPLLLQDFHLVDLLSHFDRERIPERVVHAKGGGAHGYYQTTDPLDDLCLADIFQAGKKCPISVRFSTVGGESGSHDCARDPRGFSVKFRTEEGNWDMVANNTPVFFLRDPAKFPHFIHTQKRDPQSHLTHADDSTMFWDYLSQNPESVHQVMILMGDRGIPDGWRKMHGYAGHTLKLVNKKGDWVYAQMHMKSKQGTDFITQEDSANYSPDYAQKDLYQAIEKGDYPGWDVEFQTMTPKEAEDLWETQKINVFDLTHVWPQKQFPRRKVGEFFLNENVKNYFAEIEQIAFNPAHMPPGIEPSADPVLQSRLFSYPDTHRHRIGVNYQQLPVNAPRVPYRIANFQRDGAMAYLNQGSRPAYLSSIQPNQFRKRTVNLDKTHGHFVGDAVTFLSEIRPEDFNAPRALWERVWDDGARERFINNVSGHMSNCTKEEIIKRQIAIFREVSNDLATRLEKATGVEGYDGIAGLSFNGEHNGMAKDASLRAANNMVDKQSMAANNGAPAAGTHVKVN

SEQ ID NO: 1429 - protein, 514 aa, Bifidobacterium longum
MFAERLRNAMNSRGLKQVDLVHAAEHRGVKMGKSHISQYVAGKTMPREDVLEFLASELDVDMNWLRGEESTTQLNSDASNSVTDGEHAATPLATGASKPQTDSEIPVGRRRTFGKSHKLDNVLYDVRGPVADEAMRMEANGTHILKLNIGNPAPFGFRTPDEVVYDMAHQLTDTEGYSPSKGLFSARKAIMQYAQLKNIPNVTIDDIYTGNGVSELINLSMSALLDTGDEVLVPSPDYPLWTACVNLAGGTAVHYLCDEQSEWYPDIDDIRSKITSNTKAIVIINPNNPTGALYPKEVLQQIVDIAREHQLIIFSDEIYDRLVMDGLQHISIASMAPDLFCVTFSGLSKSHMIAGYRIGWMILSGNKRIAKDYIEGLNMLANMRMCSNVPAQSVVQTALGGHQSVNDYIVPGGRVHDQRDLVYDMLNQIPGITAVKPKAAFYIFPKIDVKRFNIHSDEQFALDLLHDKHILISHGGAFNWHRPDHFRVVYLPRMGMLRETMGEISDFFSYYWQS

SEQ ID NO: 1430 - protein, 513 aa, Hordeum vulgare
MDGNNRGGGHSEVLKNYNLGKTLGLGTFGDVKVAEHKLTGQRVAIKILNRRKMETMEMEEKANREIKIMRLFIDFIHPHIIRVYEVIETPKDIFVVMEYCNNGELLDYIIENGRLQEDEARRIFQQILAGVEYCHRIMVVHRDLKPENLLLDSKYNVKLADFGLSNVMRDGHFLKTSCGSLNYAAPEIISSKLYAGPEVDVWSCGVVLYALLCGSVPFDDDNIPSLFRKIKGGTYILPSYLSDSARDLIPKLLNIDPMKRITIHEIRVHPWFKNHLPCYLAVPPPYKEQQAKMIDEDILREVVNLGYDKDHVCESLWNRLQNEETVAYYLLLDNRFRSTSGYLGADHQHLMDRSFNEFTLSESASPSTRNYLPGINDSQGGGLRPYYPVQRKWAIGLQSGAHPRDIMIEVLKALKELNVCWKKNGLYNMKCRWCPGFPQVSDMLLDSNHNFVDDSTIMDNGNADGRLPAVVKFEIQLYKTKDNKYLLDIQRVTGPQLLFLEFCGAFLTNLRVL

SEQ ID NO: 1431 - protein, 240 aa, Oryza sativa
MVSPDLIRNVVGIVGNVISFGLFLSPVPIFWRIIKNKNVQNFKADPILVVTINGISLVIEAVYLTIFFLFSDKKNKKKMGVVLATEALFMAAVAVGVLLGAHTHQRRSLIVGILCVIFGTIMYSSPLTIMVVKTKSVEYMPLLLSVVSFLNGLCWTLYALIRFDIFITIPNGLGVLFAIMQLILYAIYYRTTPKKQDKNLELPTVAPIAKDTSIVAPVSNDDDVNGSTASHATINITIEP

SEQ ID NO: 1432 - protein, 391 aa, Endospermum moluccanum
DLEPVNPVDVPTTAAGALKSYKLAAKAISKLQSLPSGNISMLCDVLVTEVRDLTGYDRVMVYKFHEDEHGEVIAECHKPDLEPYLGLHYPATDIPQASRFLFMKNKVRMIYDCFASPVKVIQDKSLSQPLSLCGSTLRSPHGCHAQYMANMGSIASLVMSVTINVDGDEMDNDQQKGIKLWGLVVCHHTSTRFVPFPLRYACEFLIQVFGVQIHKEVGLAKQMREKHILQTQTLLCDMLLRDAPVAIITQSPNLMDLVKCDGAALYFENKFWLLGVTPTEEQIRDIAEWLLKYHSENTGLSIDSLVEAGYPGASVLGDAICGMAAIRIASKDFLFWFRSHTAKEIKWGGAKHDPEEKDDGRKMHPRSSFKAFLEVVKWRSSPWEDVEMDAI

SEQ ID NO: 1433 - protein, 391 aa, Galearia filiformis
DLEPVNPADVPVTAAGQLKSYKLAAKAISRLQSLPSGNISLMCDVLVKEVSDLTGYDRVMVYRFHEDEHGEVVAECCRPDLEPYLGLHYPATDIPQASRFLFMKNKVRMICDCQAPAVKVIQDKRLVQPLSLCGSTLRSPHGCHAQYMANMGSVASLVMSVTINGDDDEMHSDQQKRRKLWGLVVCHHTSPRFVPFPLRYACEFLIQVFGVQINKEVELAAQMREKHILQIQTMLCDMLLRDSPLAIITQSPNVMDLVKCDGAALYYKKKFQLLGVTPTEAQIKDIADWLLEYHSGSTGLSTDSLMEAGYQGASILGDAVCGMAAVRITSNDFLFWFRSHTAKEIKWGGAKHDPNDKDDGRKMHPRSSFKAFLEVVKWRSLPWEDVEMDAI

SEQ ID NO: 1434 - protein, 391 aa, Goupia glabra
DLEPVNPADVPVTAAGALKSYKLAAKAISRLQSLPSGNISLLCDVLVKEVSDLTGYDRVMAYRFHDDEHGEVVAERRRPDLEPYLGLHYPATDIPQASRFLFMKNKVRLICDCLAPPVKVIQDKRLAQPLSPCGSTLRSPHGCHAQYMANMGSIASLVMSVTINDDDDEMNSDQQKGRKLWGLVVCHHTSPRFVPFPLRYACEFLIQVFGVHISKEVELAAQMRKSIFCEFKLVLCDMLLRDAPVAIITQSPNVMDLVKCDGAALYYKKKFWLLGVTPTEAQIRDIAEWLLEYHNESTGLSTDSLMEAGYPGASILGDAICGMAAARITSKDFLFWFRSHTAKEIKWGGAEHDPGDQDDGRNMHPRSSFKAFLEVVKQRSLPWEDVEMDAI

SEQ ID NO: 1435 - protein, 534 aa, Sodalis glossinidius
MAAKDVKFGNDARVKMLRGVNVLADAVKVTLGPKGRNVVLDKSFGAPVITKDGVSVAREIELEDKFENMGAQMVKEVASKANDAAGDGTTTATVLAQSIVNEGLKAVAAGMNPMDLKRGIDKAVIAAVEELKKLSVPCSDSKAIAQVGTISANADETVGTLIAEAMAKVGKEGVITVEEGSGLQDELDVVEGMQFDRGYLSPYFVNKPETGAVELESPFILLADKKISNIREMLPVLEAVAKAGKPLLIIAEDVEGDALATLVVNTMRGIVKIAAVKAPGFGDRRKAMLQDIAILTAGTVISEEIGLELEKATLEDMGQAKRVVITKDTTTIIDGEGDKALIDSRVTQINQQRDEATSDYDREKLQERVAKLAGGVAVIKVGAATEVEMKEKKARVEDALHATRAAVEEGVVAGGGVALIRVANRIAELRGDNEDQNVGIKVARRAMEAPLRQIVANAGEEPSVIANKVKAGEGNTGYNAATEEYGNMIDMGILDPTKVTRSALQYAASIAGLMITTECMVTDLPKEDKPDLGG

SEQ ID NO: 1436 - protein, 388 aa, Prunus armeniaca
YFDGWKAYDRNPFHPTKNPEGVIQMGLAENQLSFDLIEERIKKNPKASICTPEGVEEFKNVAIFQDYHGFPEFRKAVAMFMSKARGGRVTFDPNRVVMSGGATGANELVMFCLADPGDAFLVPSPYYPAFFRDLGWRTGVQIVPVDCHSSNNFKITKEALEAAYEKAQKNNIKVKGLIITNPSNPLGTTLDRDTLESLVEFINQKNIHLVCDEIYAATVFSSPTFTCISEVIQNMNCNPNLIHIVYSLSKDMGLPGLRVGIVYSYNDDVVNIGRKMSSFGLVSSQTQHMLASMLLDEEFVARFLETSSKRLANRHGVFTKGLEEVGINCLKSNAGLFCWMDLRRLLKDQTFDGEMVLWRVIVNEVGLNVSPGSSFKCVEPGWFRVCFA

SEQ ID NO: 1437 - protein, 492 aa, Arabidopsis thaliana
MDPYRVRPSSAHDSPFFTTNSGAPVWNNNSSLTVGTRGPILLEDYHLLEKLANFDRERIPERVVHARGASAKGFFEVTHDITQLTSADFLRGPGVQTPVIVRLSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPFIHYSDDNVLQTRIFSYADSQRHRLGPNYLQLPVNAPKCAHHNNHHDGFMNFMHRDEEVNYFPSRLDPVRHAEKYPTTPIVCSGNREKCFIRKENNFKQPGERYRSWDSDRQERFVKRFVEALWEPRVTHEIRSIWISYWSQADKSLGQKLATRLNVRPNF

SEQ ID NO: 1438 - protein, 368 aa, Prunus armeniaca
QMGLAENQVSFDLLEKYLELEKHSKSSNLGSKGVSGFKKNALFQNYHGLLSFKKAMAIFMDQIKGGRAKFDPDRVFLTAGATAANELLTFIIADPGDALLVPTPYYPGFDKNLRWRTGVNIVPIHTDSSNNFQVTPQALEAAYKEAEAKNMKVRGVLITNPSNPLGATIQRQVLERILGFVTQKNIHLVSDEIYSGSAFSSSEFISVAEILESQQYKNSERVHIVYSLSKDLGLPGFRVGTVYSYNDKVVTTARRMSSFTLISSQTQHLLASMLSDKEFTENYIKTNRERLRKRYDMIIEGLKKAGIECLRGNAGLFCWMNLSPLLEKPTRGGELALWDSMLHEVKLNISPGSSCHCSEPGWFRVCFA

SEQ ID NO: 1439 - protein, 274 aa, Listeria monocytogenes
MNLKDTVKLANGVEMPRLGFGVWKVQDGDEAVNSVKWAIEAGYISIDTAAAYKNEEGVGQAIKESGIKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELTEEEVAKISGLNKDERTGPDPDNFNF

SEQ ID NO: 1440 - protein, 383 aa, Corynebacterium efficiens
MLPASRWEIRWTIVDIMTSLFSPLQLRGLTVRNRVWMAPMCQYQVTTGDGVPNDWHLVHYGARAAGGFGLIIAEATGVSPEGRISPACTGLWNDEQVHAWKRITDFAHTQGAPMGVQLNHAGRKAGTYPWLPGNPSGTVPVAEGGWRILGPSAVAQKGLDVPEEMTLADIRKVVEDFAAASRRAVEAGFDSIEIHGAHGYLLHQFLTPLANKRTDDYGGSFDNRTRLIREVVTAVRATIPEEMPLVVRLSATDWIDDEPSWDADQTVRLVEILKGLGVDAVDISTGGAAPARIPVGPGYQVDFAARVKREVGIPTSAVGLITEPAQAQELLDDGLADIISLGRAVLRDPSWPLRAAHELGLPNEEIPYPASYWRGVWPEKVTV

SEQ ID NO: 1441 - protein, 194 aa, Arabidopsis thaliana
MTGTGQKLNIRRRVGEVNSLSFCCLSPTPTSLDNRCVNMIANLFHAPVGQDEAVISCGIVASSESAGLAFKMKWQHRRKAQGLPIDKPNIVTGVNVQVCWEKFARYFEVELKEVKLSEDYYVMDPAKAVEMVDENSICVAAILGSTFTGEFEYVKLLNDLLAEKNAKTAWETPIHVDAASGGFIASMGEEYQCQ

SEQ ID NO: 1442 - protein, 145 aa, Cytophaga hutchinsonii
MTIVKRNGHFPFIFDDFFNRQYNRGMADYSNTNTTIPAVNIKESAENFVIEVAAPGMNKKDFNVQVDGNVLTIRSEKTTEKEDANNEKYTTREFSYQSFVRTFNLPKDIADTDKIEAKYEDGVLHVLIPKKEKEKVKESRLVEVV

SEQ ID NO: 1443 - protein, 473 aa, Clostridium acetobutylicum
MKMKDGFLWGGATAANQFEGAWNEDGKGPSTADMMTGGTHTTPRRITPVLEEGTYYPSHEAIDFYHHYKEDIKLFAEMGFKTFRLSIAWSRIFPNGDDKEPNEAGLQFYDNVFDELLKYNIEPLVTISHYETPFGLTEKYNGWVGREVIDFYTRYCETIFNRYKDKVKYWLTFNEINCLTIPQFGAYMGGGIIPKEGDSEAQLRFQALHHQFVASAKAVKLGHEINPNFKIGCMIAYMCNYAKTCNPDDVLETQRKDQIHNMLCSDVQVRGYYPGFALNYFKENGIEIKMEKDDEKILREGCVDFYSFSYYMSNLVSTDKNDKEVSGNLLGGYKNPYLKSSDWGWQIDPKGLRWTLNHIYDRYQIPVMVVENGLGAVDVIEEDGSINDDYRIDYLRDHIVEMEEAVKNGVDLMGYTMWGCIDLVSASTGEMKKRYGFIYVDKDNDGNGTMARKPKKSFNWYKKVIASNGENLE

SEQ ID NO: 1444 - protein, 175 aa, Glycine max
  misc_feature (127)..(127): Xaa can be any naturally occurring amino acid
  misc_feature (164)..(164): Xaa can be any naturally occurring amino acid
  misc_feature (169)..(169): Xaa can be any naturally occurring amino acid
MSGGGCSSIVWFRRDLRVEDNPALAAGVRAGAVVAVFIWAPEEEGQYYPGRVSRWWLKHSLAHLDSSLRNLGSPLITKRSTDTLSSLLEVVKSTGATQLFFNHLYDPLSLVRDHRAKEVLTAQGITXVRSFNADLLYEPWDVNDAHGQPYTTCSADWERCLTMXPYDPXAPLLPP

SEQ ID NO: 1445 - protein, 243 aa, Lycopersicon esculentum
KRLMTDVPFGVLLSGGLDSSLVASVTARYLAGTKAAKQWGAQLHSFCVGLEGSPDLKAAKEVADFLGTVHHEFHFTVQDGIDAIEDVIYHIETYDVTTIRASTPMFLMSRKIKSLGVKMVISGEGADEIFGGYLYFHKAPNKEEFHRETCRKIKALHQYDCLRANKATSAWGLEARVPFLDKEFINVAMSIDPEWKMIKHDQGRIEKWVLRKAFDDEEQPYLPKHILYRQKEQFSDGVGYSWI

SEQ ID NO: 1446 - protein, 494 aa, Arabidopsis thaliana
MVLATNSDSDEHLHSTFASRYVRAVVPRFKMPDHCMPKDAAYQVINDELMLDGNPRLNLASFVTTWMEPECDKLIMDSVNKNYVDMDEYPVTTELQNRCVNMIANLFHAPVGEDEAAIGCGTVGSSEAIMLAGLAFKRKWQHRRKAQGLPIDKPNIVTGANVQVCWEKFARYFEVELKEVKLSEDYYVMDPAKAVEMVDENTICVAAILGSTLTGEFEDVKQLNDLLAEKNAETGWETPIHVDAASGGFIAPFLYPDLEWDFRLPWVKSINVSGHKYGLVYAGVGWVVWRTKDDLPEELVFHINYLGADQPTFTLNFSKGSSQIIAQYYQFIRLGFEGYKNIMENCMDNARRLREGIEMTGKFNIVSKDIGVPLVAFSLKDSSKHTVFEIAESLRKFGWIIPAYTMPADAQHIAVLRVVIREDFSRGLADRLITHIIQVLKEIEGLPSRIAHLAAAAAVSGDDEEVKVKTAKMSLEDITKYWKRLVEHKRNIVC

SEQ ID NO: 1447 - protein, 361 aa, Burkholderia vietnamiensis
MLGGGCLARPRILVGRARAAGGIEHEAAIRHAVLAQGIELRQPELQRVKPEHVGHDPVELRLLPAQHVAAGRRVGPGGPVYNLRIGHNDDCAPMNELEYVPVPAFEDNYIWLVSDGRDAIAVDPGEAAPVRRVLAERGWRLTAILLTHHHADHVGGVAALRDSQPDDAPLVVYGPAAEAIGVVTRPLAGGARVTLDAPALAFDVLDVPGHTRGHIAYFQAAGHGAAIPHVFCGDTLFSCGCGRLFEGTPAQMLASLDALAALPGDTRVHCAHEYTLSNIRFALACEPGNAALAAWRDDAQALRARGMPTLPTTIAHERAVNPFLRADSAAIHATLEAELHETVPDRLAAFTLMREWKNRFR

SEQ ID NO: 1448 - protein, 184 aa, Glycine max
MTNYGTIPTSSSPSTNLDFISRAKQRVKEGLGTRRPWKLMFNFRSFGLPAGVGDAVARVRENISYFQMNYAIVVLIVLFLSLLWHPISLIVFVVLMAAWLFLYFLRDEPLIIFGRLISDRVVLIVMAVLTVVLLLLTGAIGNILVALLIGAVLIVAHAALRKTDDLFLDEEEATGFSPPGAPLS

SEQ ID NO: 1449 - protein, 544 aa, Chlamydophila pneumoniae
MAAKNIKYNEEARKKIHKGVKTLAEAVKVTLGPKGRHVVIDKSFGSPQVTKDGVTVAKEIELEDKHENMGAQMVKEVASKTADKAGDGTTTATVLAEAIYSEGLRNVTAGANPMDLKRGIDKAVKVVVDELKKISKPVQHHKEIAQVATISANNDSEIGNLIAEAMEKVGKNGSITVEEAKGFETVLDVVEGMNFNRGYLSSYFSTNPETQECVLEDALILIYDKKISGIKDFLPVLQQVAESGRPLLIIAEEIEGEALATLVVNRLRAGFRVCAVKAPGFGDRRKAMLEDIAILTGGQLVSEELGMKLENTTLAMLGKAKKVIVTKEDTTIVEGLGNKPDIQARCDNIKKQIEDSTSDYDKEKLQERLAKLSGGVAVIRVGAATEIEMKEKKDRVDDAQHATIAAVEEGILPGGGTALVRCIPTLEAFLPMLANEDEAIGTRIILKALTAPLKQIASNAGKEGAIICQQVLARSANEGYDALRDAYTDMIDAGILDPTKVTRSALESAASIAGLLLTTEALIADIPEEKSSSAPAMPSAGMDY

SEQ ID NO: 1450 - protein, 273 aa, Zymomonas mobilis
MVPVKNVVLNDGHSMPAIGQGVYQLNPAQAESMVALGYDLGYRAVDTAAWYENEEGVGEGLRSRHARSFITTKLMPQDMGRVNCFVALDKSIRNLGVTSLNLYLIHWPGQDRKRYEETWQTLIQIRAIGKASSIGVSNFTIDHLDHIIADSGVVPAVNQIELHPYFQQKELRAYHAERGIVTTSWSPLGRGAALNDPVIREIALKHGKTPAQVVLNWHLSLGLTVIPKASSKARLQENLEADSFALDEEDMQRIESLDKPDGRQGIDPAVFDF

SEQ ID NO: 1451 - protein, 745 aa, Cladosporium fulvum
MATEKISSGLGKLQDQLNGAAEGQKVAHVKNDPLYKDYHEPSNRITTDYGVKQHNTDDWLKIASEDKTGPMLLEDHAAREKINRFDHERIPERVVHARGSAAFGTFKLHKSLEQYTTAGVLTDTSRTTPTFLRFSTVLGSRGSADTVRDVRGFAIKHYTPEGNWDVVGNNIPVFFIQDAIKFPDVIHAGKPEPDNEVPQAQTAHNNFWDFQFMHTEATHMFMWTQSDRAIPRSYRMMQGFGVNTFTLTNAKGERFFVKFHWTPHLGVHSFVWDEALKLAGQDPDFHRKDLWEAIEAKAYPKWDFGVQVISEGEEDNFEFDILDATKVWPEELVPIQYVGELELNRNPDEFFPQTEQVAFCTGHVVPGIGFSDDPLLQGRNFSYQDTQISRLGVNFQELPINRPVCPVMNNNRDGALRHTVTKGKVNYWPNRFEATPPAAAEEKPYLDYPQKVAGMKTRLRSKKFSEHFNQAQLFYNSMSEPEKEHIKFALAFELDHCEDPVVYDRVSQRLADIDLSLAQSVADLVGGQIPQQQGRPNHGKKSKGLSQTEFPGKTPTIETRRIAIIIADGYDLVAYNGIVAAAKACQALPFTIAPRRSPIYAAGESKENSKGVKPDHHLEGMRSTMFDSVFVPGGADSVATLRKNGRALHWVREAFAHLKAIGAVGEAVDFVRNACQLPGMTFSASEEVTDSYGVVTAAKVKPESLSEAVKIGKDAADFVSKYFYEISQHKNFERELKGFPLMVAY

SEQ ID NO: 1452 - protein, 340 aa, Solanum tuberosum
MDHAADRHRTDLMTITRFVLNEQTKHPESRGDFSILLSHIVLGCKFVCTAVNKAGLAKLLGLAGETNVQGEDQKKLDVLSNEVFIKALVSSNRTCILVSEEDEEATFVRPANRGKYCVVFDPLDGSSNIDCGVSIGTIFGIYMIKDGHEPTLDDVLQPGMNMLAAGYCMYGSSCTLVLSTGSGVNGFTLDPSLGEFILTHPDIKIPKKGKIYSVNEGNAKNWDSPTSKYVQSCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEQN

SEQ ID NO: 1453 - protein, 391 aa, Hirtella bicornis
DLEPVNPADVPVTAAGALKSYKLAAKAISRLQSLPSGNISLLCDVLVKEVSDLTGYDRVMVYRFHEDEHGEVIAECCMPDLEPYLGLHYPATDIPQASRFLFMKNKVRMICDCLAPPVKVIQDKRLAQPLSLCGSTLRAPHGCHSQYMANMGAIASLVMSVTINEDDEEMETGQQKARKLWGLVVCHHSSPRFIPFPLRYACEFLIQVFGIQINKEVELAAQTREKHILRTQTVLCDMLLRDAPVAIITQSPNIMNLVKCDGAALYYRKKFWLLGITPTDTQIKDIVEWLLQYHGESTGLSTDSLMEAGYPGASVLGDAVCGMAAVKITSKDFLFWFRSHTAKEIKWGGAKHDPDDKDDGRKMHPRSSFKAFLEVVKRRSLHWEDVEMDAI

SEQ ID NO: 1454 - protein, 404 aa, Gibberella zeae
MSNSAPEFLKFSGHRSFTQRLVLSTLTGRPIHIAKIRSSSPTNPGLAPHEISFLRLLEAVTNGSSMQISYTGTTITYHPGLITGTIAGFGASDGDVINHNISVNNTRGVTYFLMPLCLLAPFSKAHMNVRFTGPGVITSSTETGDISVDSFRTAILPLFGLYGIPPARIELRVLQRSCAGPGGKGGGGCVELRFASQVRLPKTLHLNRSPGRIKRIRGVAYCTGVSASNNARMIHSAREVLNPLVPDIHIAAQYDQAPLVPTGDKAGSKRRLGIGFGLSLVAESSAVGVLYSADVVVPAQGGVVPEDIGKQCAYQLLENISQGGCATQVSAKTMLILMAMGSEDVGRLRIGREVLGNEEMVILARDLRTFGASSWGLRDVGDDTNDIIVSVKGTGVGNVGRKIA

SEQ ID NO: 1455 - protein, 391 aa, Homalanthus populneus
DLEPVNPADVPITAAGALKSYKLVAKAISKLQSLPSGNISRLCDVLVKEVSDLTDYDRVMVYRFHNDEHGEVIAENCRPDLDPYHGLHYPATDIPQASRFLFMKNKVRMICDCLAPPVKVIQDQSLGQSINLCGSALRSPHGCHAQYMENMGSIASLVISVTINEDGSEMDDDQQKARKLWGLVVCHHTSPMFIPFPLRYACEFLIQVFGVQINKEVEMAAQMREKRILQTQTVLCDMLLRDAPVAIITQSPNVMDLVKCDGAALFYRKKFWLLGVTPTEAQVEDIVEWLLEFHSESTGLSTDSLMEAGYPGASTLGHAICGMAAVRISSKDFLFWFRSHTAKEIKWGGAKHDPEDKDDGRKMHPRSSFNAFLEVVKWRSLPWDDVEMDAI

SEQ ID NO: 1456 - protein, 205 aa, Yarrowia lipolytica
MPPKKRTMLKVVILGDSGVGKSSLMQQYVNNKFSTQYKATIGADFLNKELTLEGRKVNMQIWDTAGQERFQSLGLAFYRGADCCVLVYDVNNSKSFDALTLWRDEFLLLANPRDPENFPFVVIGNKVDVEESKRAVSAKRAQAFCKATGNIPYFETSAKEDTGVDQAFETVARNAMAQVDSEDYTDDFADTINIHLDNEQSNCAC

SEQ ID NO: 1457 - protein, 499 aa, Zea mays
MVVSVAATGPGTDAEPVSSTFFASRYVRDPLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 1458 - protein, 391 aa, Hugonia platysepala
DLEPVNLADVPMTATGALTSYKIAAKAISRLQTVPSGSINLLCDVLVKELRELTGYDRVMVYRFHEDDHGEVVAECRSSDLESYLGLHYPATDIPQASRFLFMKNKVRMICDCLASSVKVMQDKSLAEPVSLSGSILRSPHGCHAQYMANMGSIASLVMSVTINEDCNEMESDQQRGRKLWGLVVCHHTSPRFVPFPLRYACEFLIQVFSIQISKEVELEAQRREKHIMQTQTVLCDMLLRDAPLAIMTQSPNVMDLVKCDGAALCCRKNCWLLGLTPTEQQIADIAEWLLEYHGESTGLTTDSLMEAGYPGASVLGNAICGMAAIRITSKDFLFWFRSHTAKEIMWGGAKHDPGDKDGGRKMHPRSSFKAFLEVVKWRSLTWEDVEMDAI

SEQ ID NO: 1459 - protein, 548 aa, Raphanus sativus
MKLLHGLALVFLLAAASCKAYEEITCEENEPFTCNNTARLSSKNFPKDFIFGVASSAYQIEGGRGRGVNIWDGFSHRYPEKAGSDLKNGDTSCESYTRWQKDVDVMGEINATGYRFSFAWSRIIPKGKVSRGVNQGGLDYYHNLIDALLEKNITPFVTLFHWDLPQTLQDEYEGFLDRQIIQDFKDYADLCFREFGGKVKHWITINQLYTVPTRGYAIGTDAPGRCSPMVDTKHRCYGGNSSTEPYIVAHNQLLAHATVVDLYRTKYKFQRGKIGPVMITRWFLPFDESDPASIEAAERMNQFFHGWYMEPLTKGRYPDIMRQIVGSRLPNFTEEEAALVARSYDFLGLNYYVTQYAQPKPNTYPSPKHTAQDDAGVKLSYKNSRGEFIGPLFVEDKDNGNSYYYPKGIYYVMDYFKTKYGNPLIYVTENGFSTPDSENREQAIADYRRIDYLCSHLCFLRKVINEKGINVRGYFAWALGDNYEFCKGFTVRFGLSYVNWADLNDRNLKESGKWYQRFISGTVKNPAKQDFLRSSLSSQSQKKRLADA

SEQ ID NO: 1460 - protein, 406 aa, Candida albicans
MTVESTNSFVVPAGTKQIEIAPLGSTKLFQPIKVGKNILPHRVAHAPTTRFRAAKNHTPSDLQLEYYKTHSQYPGTLIITEATFTSEQGGMDLHVPGIYNDAQTKAWKKINDEIHANGSFSSMQLWYLGRVANPKDLKDAGLPLIGPSAVYWDKESEKLAKSIGNELRELTEKEIDHIVEVEYPNAAKRAIEAGFDYIEVHSAPGYFLDQFLNPASNKRTDKYGGSIENRARLLLRIIDKLIGIVGAEKLAVRLAPWSSFLGMEIEGEEIHSYILQQLQQRADNGQQLAYVSLIEPRVIGIFDASLEHQKGRSNEFAYKYWKGNFVRAGNYTYDAPEFKTLLHDLDNDRTIVAFARFFTSNPDLVEKLKLGKPLNHYDREEFYKYYNYGYNSYDESEKQVIGKPLV

SEQ ID NO: 1461 - protein, 154 aa, Lycopersicon peruvianum
MSLIPRIFGDRRSSSMFDPFSIDVFDPFRELGFPGTNSRETSAFANTRIDWKETPEAHVFKADLPGLKKEEVKVEIEEDRVLQISGERNVEKEDKNDTWHRVERSSGKFMRRFRLPENAKMDQVKASMENGVLTVTVPKEEVKKPDVKSIEISG

SEQ ID NO: 1462 - protein, 391 aa, Hymenanthera alpina
DLEPVNPADVPVTAAGALKSYKLAATAISRLQSLPSGNISLLCDTLVKEVSDLITYDRVMVYRFHDDEHGEVIAESCKPGLEPYLGLHYPATDIPQASRFLFMKNKIRMICDCLAPPVKVVQDKRLEQPLSLCGSTLRSPHGCHSQYMANMGSIASLVMSVTINEDDDEMDSDQQKGRKLWGLVVCHHSSPRFVPFPLRYACEFLIQVFSVQISKEVEVAAQMKEKHIFKTQTVLCDMLLRDAPEAIITHSPNVMDLVKCDGAALYYRKKVCLLGVTPTEAQIRDIAEWLLEYHSGSTGLSTDSLMEAGYPNASILGDLVCGMAAVRITSKDFLFWFRSQTDKEVKWGGAKHDATDKDDLRKMHPRSSFKAFLEVVKWRSLPWEDVEMDAI

SEQ ID NO: 1463 - protein, 546 aa, Raphanus sativus
MKLLGLALVLLLAAASCKAGEEITCEENEPFTCSNTAKLSSKSFGKDFIFGVASSAYQIEGGRGRGVNIWDGFSHRYPEKSGSDLKNGDTTCESYTRWQKDVDVMGEINATGYRFSFAWSRIIPKGKVSRGVNQGGLEYYHKLIDALLEKNITPFVTLFHWDLPQTLQDEYEGFLDRQIIQDFKDYADLCFKEFGGKVKHWITINQLYTVPTRGYAIGTDAPGRCSPMVDTKHRCYGGNSSTEPYIVAHNQLLAHAAAVDLYRTKYKFQKGKIGPVMITRWFLPYDDSDPASIEAAERMNQFFHGWYMEPLTKGRYPDIMRQIVGSRLPNFTEEEAALVAGSYDFLGLNYYVAQYTQPKPNPYPSETHTAMMDAGVKLTYENSRGELIGPLFVEDKDNGNSYYYPKGIYYVMEYFKTKYGNPLIYVTENGFSTPGSEKREQAIADYKRIDYLCSHLCFLRKVIKEKGVNVRGYFAWALGDNYEFCKGFTVRFGLSYVNWDDLDDRNLKESGQWYQRFINGTVKNPAKQDFLRSSLSSQSQKRLADA

SEQ ID NO: 1464 - protein, 392 aa, Hypericum empetrifolium
DLEPVNPADVPVTAAGALKSYKLAAKAISKLQSLPSANISLLCDVLVKEVSDLTGYDRVMVYKFHEDDHGEVVAECHRPDLEPFLGLHYPATDIPQASRFLFLKNKVRMICDCYAQPVKVVQYSGLSQSLSLCGSSLRAPHGCHAQYMVNMGSIASLVMAVTINDDDDDEAEADRRKGRKLWGLVVCHHRAPRFVPFPLRYACEFLIQVFGIQINKKVKLEAQMREKHILETQTVLCDMLLRESPVAIVTQSPTVMNLVKCDGAALCYQNTFWLLGVSPTEAQVRDITEWLLEYHAGSTGLSTDSLMEAGYPGASVLGDAVCGMAAIRINSKDFLFWFRSHAAKEIKWGGAKHDPDDKDEGRKMHPRSSFKAFLEVVKWRSLPWEDVEMDAI

SEQ ID NO: 1465 - protein, 367 aa, Bradyrhizobium japonicum
MSRSTKLFETYKLGPITLANRLVMAPLTRNRAVPGTFVPGALAADYYGQRASAGLLITEASQVSQQGQGYQDTPGIYSKDQVAGWRKVTDKVHERGGKIFIQLWHVGRISHVALQANGAAPVAPSAIRAKGKTFVNGTFADVSEPRALELSEIRGIIDDFKRATKNALEAGFDGVEIHGANGYLLDQFAKDGANKRTDAYGGSIENRARLMLEVSRAVAAEAGTERTGIRISPVTPANDVSDSNPQALFDHIVDGLSALKLVYLHVVEGATGGPRDFAPFDYASLRKRFSGAYVANNGYDFDLATKVLDANAADLIAFGKPFISNPDLVERLKQGAALNDWDKNTFYGGSAKGYTDYPTLEAAEAAQ

SEQ ID NO: 1466 - protein, 248 aa, Helianthus annuus
MSFQNEDSGDISPQRRIGKGKIEIKRIENTTNRQVTFCKRRNGLLKKAYELSVLCDAEVALIVFSSRGRLYEYANNSVTGTIDRYKKSCLDPPSTGSVAEANAQFYQQEATKLRQQIANLQNQNRQFYRNIMGESLADMPGKELKNLESKLEKAINRIRAKKNELLFAEIEYMQKRELELHNSNQFLRARIAENERAQQQHMSLMPGSSGYNDLGPHQSFDGLNDLQTNELQLNNNYSCQDQTPLQLV

SEQ ID NO: 1467 - protein, 553 aa, Unknown
  Frankia sp. EAN1pec
MAADRPELGEPDRPGRPQHAGRGPLPGQHPRPRRHRARHAPRPRRIRPVRPPDHRRNHGRRVERLTTSPVPATDTTAATGVPAPEPSPGADELAARIATGLPTGFVWGAATSAYQIEGGAREGGRGPSIWDVFARTPGMTANGENGDVAADHLHRYREDVALMAGLGLGAYRFSVAWPRIVPAGSGAVNPDGLAFYDRLVDEILAAGIDPWLTLYHWDLPQPLQDAGGWPNRDTALRFADYTEHVVSALGDRVRHWSTLNEPWCSAFEGHLTGRHAPGVRDAGAAVRAVHHLLLAHGLGTAVLRAHGAADVGITLNLIPAEPPPDAGGAGDAVRLVDGQQIRLWLDPVLHGTYPSDVIADFARAGAELPAQDGDLAVIAQPVDWIGVNYYAPHIVAPGPDPSPKPTPFAGAGNVTRVPTSEDVTALGWPVRPRSFLALLRRLGADYPGVPFYIHENGAAYDDEVSPDGTVHDPLRVRYLAGHLDAVRQASEDGVDVRGYFVWSLLDNFEWAEGYRMRFGIVHVDFESLVRTPKSSGLWYSRLIREHRAASGTR

SEQ ID NO: 1468 - protein, 612 aa, Leifsonia xyli
MCGIVGWVSFDRDLTEHRESVDAMTATMACRGPDAEGVWLDRHGALGHRRLAIIDVEGGSQPMSAHTDDGAVTLTYSGEVYNFSELRGELMRRGHRFETRSDTEVVLHGYLEWDEAVAERLNGMYAFAIWDARAEKLVMIRDRMGVKPLYFFTTDDGVLFGSEPKAILAHPLADRAVDLDGLREVVSFAQTPGSAVWCGMREIVPGGVVTVCRAGLREYRYWTLTTRPHTDDLPTTIARVRSLLEDTVGRQLVSDVPRCTLLSGGLDSSAITAFSAAQLAGHGEKVRSFAVDFVGREDDFVADDLRSTPDAPYAREVASHVGSQHETIVLDNDAIADPAVRRAVIAARDNPLSLGDLDASLYLLFQAIRAHSTVALSGESADEVFGGYRWFHQPEVQAAPTFPWMALPVSGSPTRVRDRFTAKITAALDLPAYLRERYTSAIAEVQPLENESAHERRMREICYLHLTRLVRMLLDRKDRISMAVGLEVRVPFCDHRLVEYVYNVPWAMKTFDGREKSLLRAATADLLPESVLQRTKAPYPTTSDPGYARTLIQQSRDLLSADDRVFGLVDRGRLEEITRQDPATMTLDVRNGMETALDLSTWLEIYQPELRM

SEQ ID NO: 1469 - protein, 550 aa, Brassica juncea
MKLLYGLALVFLLAAASCKADEEITCEQNEPFTCGNTDILSSKNFGKDFIFGVASSAYQIEGGRGRGVNVWDGFSHRYPEKSGSDLKNGDTSCESYTRWKKDVEIMGELNATGYRFSLAWSRIIPKGKVSRGVNQGGLDYYHSLIDALLEKNITPFVTLYHWDLPQTLQDEYEGFLDRQIIQDFKDYADLCFKEFGGKVKHWITINQLFTVPTRGYALGTDAPGRCSPMVDSKHRCYGGNSSTEPYIVAHNELLAHAAVVDLYRKNYADQKGKIGPVMITRWFLPYDEADPSCREAADRMNQFFHGWYMEPLTKGKYPDIMRKIVGSRLPNFTEAEAKLVAGSYDFLGLNYYVTQYAQPKANPLLSEKHTAMMDAGVGLTYDNSRGEFIGPLFIEDKIAGNSYYYPKGIYYVMEYFKTQYNDPLIYVTENGFSTPSSENRCEAIADYKRIDYLCSHLCFLRKVIKDRGVNVRGYFAWALGDNYEFCKGFTVRFGLSYVNWDDLDDRNLKESGKWYQRFINGTSKNPTKQDFLRSSLSFLKARRRGLLADA

SEQ ID NO: 1470 - protein, 172 aa, Arabidopsis thaliana
SVRGTIERYKKACSDAVNPPTITEANTQYYQQEASKLRRQIRDIQNLNRHILGESLGSLNFKELKNLESRLEKGISSCSDPRKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 1471 - protein, 712 aa, Neurospora crassa
MAPRAEGSSTLKRARGSTDDNDSFKKPRRSERLSSQRTGDSPEPKQKTPLKTTKQLPSPVTHDSDEFPQDSKEPTATPPAGRPSQLSQISPRPENQHSQSQASQLNDTQAFSQLPDLDKALSDEVEDEVKEGVWGYLFPLDPRYGGRCVVLRRRAACPLPDTVSQAVGSKRGKRGQKALIKEEHDLDKTKVKGLPSGGYLIGRHPECDIQIEDPIVSNRHCIIFTENKGNDTIAVLEDLSSNGTFVNEAIVGRNRRRELQELDEIAVLGTARFIFRYPKSRHTSAFRQQYTMLQKLGKGHFAEVYLCVEKSTGTQYAVKVFSKTPGVEERSKDEGLQQEIAVLMGVSHPNVLCLKDTFNEPNAVHLVLELAPGGELFNYIVKKTKLSENECRKLFTQLFQGVKYLHDRNIVHRDIKPENILLVDDDLHVKLADFGLAKIIGEESFTTTLCGTPSYVAPEILTDTRHRKYTKAVDVWSLGVVLYICLCGFPPFSDELTSPDFPYSLSDQIRQGKFDYPSPYWDPVDDLALDLIDSMLVVDPEKRFTIDDCLSHPWMTQKTPGVNDSTNGLVNGIAGLDVTRRGVLRERTLLSSINTVEIADKIPLGENKPELKIYKKNPTETVGGPSEHELAGAQAGPSRQKEARPDDNRDPNEFMKMGGKGDEVLFADDPKSNYPTAKKDAKDIVESTTKTNGKGKLASGFGIVIMDARFHG

SEQ ID NO: 1472 - protein, 175 aa, Xylella fastidiosa
MHPKNFQHQLKTIPQPPDETRDFVFNHTMLRVKEINASLDFYARILGFRLIDQRDFPEAQFSLYFLALLPQTVHISDNDTERRLWMSGIPGVLELTHNYGTETQEGQIYHNGNSEPRGFGHICISVPDLYSACARFDTLQVPYQKRLTDGRMKNIAFIKDPDGYWVEIISNTPLP

SEQ ID NO: 1473 - protein, 349 aa, Nostoc sp.
MAKTPESLESSINEITDRALDRDCTTLSRHVLQQLQSFSPDAQDLSALMNRIALAGKLVARRMSRAGLMEGVLGFTGEVNVQGESVKKMDVYANDVFISVFKQSGLVCRLASEEMENPYYIPENCPIGRYTLLYDPIDGSSNTDNNLSLGSIFAIRQQEGTDSDGKATDLLANGRKQLAAGYILYGPCTMLVYTIGKGVHSFVLDPSLGEFILTEENIRIPNHGSVYSVNEGNFWQWEESIREYIRYVHRTEGYSARYSGAMVSDIHRILVQGGVFLYPGTIQNPEGKLRLLYETAPLAFLIEQAGGRATTGLVNILDVVPKKLHQRTPLIIGSKEDVAKVESFIQNGH

SEQ ID NO: 1474 - protein, 168 aa, Arabidopsis thaliana
  misc_feature (106)..(106): Xaa can be any naturally occurring amino acid
  misc_feature (112)..(113): Xaa can be any naturally occurring amino acid
  misc_feature (117)..(117): Xaa can be any naturally occurring amino acid
  misc_feature (124)..(124): Xaa can be any naturally occurring amino acid
  misc_feature (132)..(132): Xaa can be any naturally occurring amino acid
  misc_feature (134)..(135): Xaa can be any naturally occurring amino acid
  misc_feature (146)..(146): Xaa can be any naturally occurring amino acid
  misc_feature (152)..(152): Xaa can be any naturally occurring amino acid
  misc_feature (155)..(155): Xaa can be any naturally occurring amino acid
  misc_feature (163)..(163): Xaa can be any naturally occurring amino acid
  misc_feature (165)..(165): Xaa can be any naturally occurring amino acid
  misc_feature (167)..(167): Xaa can be any naturally occurring amino acid
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFXVYREQXXNTPXYYDGRYXWAMWKLPXFXXPIPLKFLKEVXGSRRGXPGXLFGSIGFXKXRXA

SEQ ID NO: 1475 - protein, 533 aa, Corynebacterium efficiens
MTENSAADQIIDRGMRPKVAGNTTRHNGAPVASENISVTAGPQGPNILNDIHLIEKLAHFNRENVPERIPHAKGHGAFGELHITEDVSQYTKADLFQPGKVTPMGVRFSTVAGEQGSPDTWRDVHGFALRFYTQEGNYDIVGNNTPTFFVRDGMKFPDFIHSQKRLNKNGLRDADMQWDFWTRAPESAHQVTYLMGDRGTPKTTRHMNGYGSHTFQWVNKDGEAFWVKYHFISRQGVENFTDAEAAEMAGINADYHREDLYNAIERGDYPIWDVKVQIMPFAEAENYRWNPFDLTKVWSKKDYPRIDVGYFILNRNPRNFFAQIEQIALDPGNIVPGVGLSPDRMLQARAFAYADQQRYRIGPNYRDLPINRPINEVNTYSREGHMQYVFDAEGEPSYSPNRYTKGAGYLDDGETSSSNHTSYGQASDIYVNPDPHGTDLVRAAYVKHQDDDDFMQAGILYREVYNDEEKARLADNISNAMQGISEETEPRVYEYWTNVDENLGARVKELYLQKKAAGAAEHTSSTGDDIDKK

SEQ ID NO: 1476 - protein, 673 aa, Yersinia pestis
MLAYPHLFTPLDLGFTTLKNRILMGSMHTGLEELPDGPQRLAAFYAERAAGGVGLIVTGGIAPNMKGGVYQGASVLNDAAQIPHHQVVTEAVHQAGGKIALQILHAGRYSYQKHPVAPSALQAPINPFVPQALSHEEILQTIADFAHCAQLAKQAGYDGVEIMGSEGYLINQFLTARTNQRDDEWGGDFTHRMRFAVEIVRAVRQATGHDFILIYRLSMLDLVEEGSNWVEIEQLAQAVEQAGATVINTGIGWHEARIPTIATMVPRAGFSWVTRKLMGKVNIPLITTNRINDPAVAEQVLADGCADMVSMARPFLADAAFVQKAAQGRADEINTCIGCNQACLDQIFDGKLTSCLVNPRACRETEMPELPTDAPKRLAVVGAGPAGLAFAVTAARRGHQVTLFDAAAEIGGQFNIAKQIPGKEEFYETLRYFRRQLVLNGVTLQLNTLVQVKQLAEFDEVILACGIQPRLPCINGIDHPKVLTYLDVLRDKKPVGQRVAIIGAGGIGFDTAEYLSQSGDSPRFDSTAFSTEWGIDQDLAHRGGLSPAGAKVPPSPRQIFLLQRKASKVGEGLGKTTGWIHRTSLAMRGVKMLNSVSYEAIDDKGLHIIRAEQACCLPVDTIIICAGQEPRRELHQPLLDMGKTVYLIGGADKAVELDARRAIDQGTRLALAI

SEQ ID NO: 1477 - protein, 259 aa, Pseudomonas syringae
MIQIHALPAFNDNYIWLLQDLSSQQCVVVDPGDAAPVLEWLAQNPHCRLTDILITHHHNDHVGGVVELKQATRARVLGPAAESIPARDVALADHDRLTVLGLEFVVHAVPGHTLGHIAFYHEDAAAPLLFSGDTLFAAGCGRLFEGTPGQMHASLERLAALPDSTLIYCAHEYTLSNLRFAQAVEPDNQDIAERLAQVTLMRSENRISLPSSLALEKRTNPFLRTRETSVKEKADERSGGQNTSQSAVFASLRAWKDKF

SEQ ID NO: 1478 - protein, 146 aa, Unknown
  Mesorhizobium sp. BNC1
MRYLHTMVRVRDIGESLDFYCNKLGMKEVRRIENEAGRFTLIFLAAPEDVEAAERHKAPLVELTYNWDPEDYQGGRNFGHLAYEVDDIYAFCQHLMDAGITINRPPRDGNMAFIRSPDGISIEILQKGEAKPKAEPWASMPNTGAW

SEQ ID NO: 1479 - protein, 679 aa, Lycopersicon esculentum
MSGGGCSIVWFRRDLRVEDNPALAAGVRAGAVIAVFIYAPEEEGHYYPGRVSRWWLKQSLAHLDSSLKSLGTSLITKRSTDSISSLLEVVKSTGATQLFFNHLYDPISLVRDHRTKEILTAQGISVRSFNADLLYEPWEVNDDEGRPFTTFSAFWEKCLSMPYDPEAPLLPPKRIISGDASRCPSDNLVFEDESEKGSNALLARAWSPGWSNADKALTTFVNGPLLEYSQNRRKADSATTSFLSPHLHFGEVSVRKVFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGRELDRIDNPQFVGYKCDPHGEYVRRWLPELARLPTEWIHHPWNAPESVLEAAGIELGSNYPLPIVEIDSAKVRLEQALSQMWQNDAAARAAIENGMEEGHGDSADSPIAFPQAMHMEMDHEPVRNNPVIVTVRRYEDQMVPSMTSSLFRAEDEENSVDIRNSVVESRAEVPTDINVAEVHRRDTRDQAVMQTARTNATPHFNFAVGRRNSEDSTAESSSSTRERDGGVVPTWSPSSSNYSDQYVGDDNGIGTSSSYLQRHPQSHQLMNWQRLSQTG

SEQ ID NO: 1480 - protein, 391 aa, Lachnostylis bilocularis
DLEPVNPADVPVTTAGALKSYKLAAKAISRLQSLPSGNISLLCDVLVKEISDLTGYDRVMVYRFHDDEHGEVIAECRRPDLEPYLGLHYPAIDIPQASRFLFMKNKVRMICDCLAPPVKVIQDKRLSQQLSLGGSTLRSPHGCHAQYMANMGSIASLVMSVTINEDDDEMDSDRERGIRLWGLVVCHHTSPRFVPYPLRYACEFLIQVFGVQVSKEVQLAAQMREKHILQTQTVLCDMLLRDAPVAIITQSPNVMDLVKCDGAALYYRKKFWLLGVTPTEAQIKDIAEWLLECHGGSTGLSTDSLMEAGYPGAAVLDDAVCGMAAVRITSKDFLFWFRSHTAKEIKWGGAKHDPEDKDDGRKMHPVSSFKAFLDVVKQRSLPWEDIEMDAI

SEQ ID NO: 1481 - protein, 422 aa, Aspergillus nidulans
MALPDVENTPAAGIPYFTPAQNPPAGTAANPQTSGNAVPKLYTPLTVRGVTFHNRLGLAPLCQYSAEDGHMTDYHIAHLGGIAQRGPGLMMIEATSVSPEGRITPQDVGLWKDSQIAPMKRVIDFVHSQSQKIGVQIAHAGRKASNIAPWLMNKGIVATEKVGGWPDRVIGPSTVPFHETFPTPKAMTKDDIEQFKRDWFDACKRAIAAGADFIEIHNAHGYLLSSFLSPSSNTRTDEYGGSFENRIRLSLEIAQVTRDAVGPNVPVFLRVSATDWIEETLPEESWKLSDSVRFAEALAAQGAIDLIDVSSGGVHAAQKIKSGPAFQAPFAVAIKKAVGDKLLVATVGTITNGKQANKLLEEEGLDVALVGRGFQKDPGLAWTFAQHLDVEIAMASQIRWGFTRRGGTPYIDPKAYKESIFE

SEQ ID NO: 1482 - protein, 391 aa, Leonia glycycarpa
DLEPVNPIDVPVTAAGALKSYKLAAKAISRLQSLPSGNISLLCDVLVKEVSELTGYDRVMVYRFHEDEHGEVIAESCKPGLEPYLGLHYPATDIPQASRFLFMKNKIRMICDCLAPPVKVVQDKRLDQPLSLCGSALRSPHGCHSQYMTNMGSIASLVMSVTINEDDDEMDSDQQKGRKLWGLVVCHHTSLRFVPFPLRYACEFLIQVFGVQINKEVKLAAQMKEKHILQTQTVLCDMLLRDAPVAIITQSPNVMDLVKCDGAALYYGKKFWLLGVTPTEAQIRDIAEWLLEYHSGSTGLSTDSLMEAGYPNASILGDPVCGMAAVRITSKDFLFWFRSHTAKEVKWGGAKHDPDDKDDGRKMHPRSSFKAFLEVVKQRSLPWEDVEMDAI

SEQ ID NO: 1483 - protein, 545 aa, Triticum aestivum
  misc_feature (55)..(55): Xaa can be any naturally occurring amino acid
  misc_feature (294)..(294): Xaa can be any naturally occurring amino acid
VTLQNKFVQKSRLVPVRNSRDIVDPRVRPRVRDLIAHHPPPSTRDRPGRRRRPWXPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDETXTVGGTCHTHATKDLTDAIAAGNYPEWKLFIQTIDADHEDKFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDASLGQKLALRLKIKPSM

SEQ ID NO: 1484 - protein, 635 aa, Lycopersicon esculentum
MESNYKTIVWFRRDLRIEDNPALAAAARNGSVLPVFIWCPKEEGQFYPGRVSRWWLKQSLIHLKQSLKSLGAELVLMKAQSTLSALTECVDAVGATKVVYNHLYDPVSLVRDHNIKQKLGDLGISVQSYNGDLLNEPWEVYDDDGKVFTTFDAYWEKSLSIQNEPVSQLPPWRLTQAAGSVKMCSVEELGLENESEKSSNALLGKGWAPGWSNADKALTEFVESNLLAYSKDRLRVGGNSTSLLSPYLHFGEVSVRKVFNSVRLKQILWTKEGNSVGKDSATIYLRAIGLREYSRYICFNFPFTHERSLLNNLRFFPWNADQAHFKAWRQGRTGYPLVDAGMRELWATGWVHNKIRVIVSSFFVKFLLLPWQWGMKYFWDTLLDADLESDIIGWQYISGSLPDGHELERLDNPEVQGFNYDPEGEYVRHWLPELARMPAEWIHHPWDAPLNVLKAAGVELGMNYPNPIIDVDVARDRLMQAIIIMREKEAAVNTSHANGTVEVVFDNSENVGDSASIPKDDVVKGKEPCPSSSSYDQRVPSMQNVGTYRKRPKPEEETKKLNDNKLSYKNERIKMSNVDGDLCSTAESSSMKKQMTVSRNSFSVPRTITMSHDRKSFDDEASSHVKLQKEEEIDT

SEQ ID NO: 1485 - protein, 391 aa, Maytenus arbutifolia
DLEPVNPADVPITAAGALKSYKLAAKAISRLQSLPSGNMSLLCDVLVKEVSELTGYDRVMVYRFHDDDHGEVVGECCRPDLEPYLGLHYPATDIPQASRFLFMKNKVRMICDCLAPPVKVLQDKRLAQPLSLGGSTLRSPHGCHAQYMSNMGSIASLVMSVTINEDDDETTSDQQKGRKLWGLVVCHHSTPRFVPFPLRYACEFLIQVFGVQINKEVELATQLKEKHILRTQTVLCDMLLRDAPVGILTQSPNVMDLVKCDGAALYYRNKFWLLGVTPTETQITDIAEWLLEYHSESTGLSTDSLMEAGYPDASILGEAVCGMAAIKITSKDFLFWFRSHTAKEMKWGGAKHNPDDKDDGKRMHPRSSFKAFLVVVKRRSLPWEDIEMDAI

SEQ ID NO: 1486 - protein, 515 aa, Saccharomyces cerevisiae
MSKLGQEKNEVNYSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 1487 - protein, 392 aa, Maytenus senegalensis
DLEPVNPADVPITAAGALKSYKLAAKAISRLQSLPSGNMSLLCDVLVKEVSELTGYDRVMVYRFHDDDHGEVVAECCCRPDLEPYLGLHYPATDIPQASRFLFMKNKVRMICDCLAPPVKVLQDKRLAQPLSLGGSTLRSPHGCHAQYMTNMGSIASLVMSVTINEDEDETNSDQQKGRKLWGLVVCHHSTPRFVPFPLRYACEFLIQVFGVQINKEVELATQLKEKHILRTQTVLCDMLLRDAPVGILTQSPNVMDLVKCDGAALYYRNKFWLLGVTPTETQVKDIAEWLLEYHSESTGLSTDSLMEAGYLDASILGEAVCGMAAIKITSKDFLFWFRSHTAKEMKWGGAKHDPDDKDDGKRMHPRSSFKAFLVVVKRRSLPWEDVEMDAI

SEQ ID NO: 1488 - protein, 391 aa, Unknown
  Mesua sp. Coode 7884
DLEPVNPADVPVTAAGALKSYKLAAKAISKLQSLPSGNISLLCDVLVKEVCELTGYDRVMVYKFHEDDHGEVVAECRRPDLEPYLGLHYPATDIPQASRFLFMKDKVRMICDCLAPPAKVIQDNGLTQALSLCGSTLRAPHGCHAQYMENMGSIASLVMSVTINDDDDEMASDRQKGRKLWGLVVCHHTGPRFVPFPLRYACEFLIQVFGIQITKEAELAAQIREKHILETQTVLCDMLLRDSPMAIVIQSPNVMDLVKCDGAALYFKEKFWLLGITPTEAQIRDISEWLLDYHNGSTGLSTDSLMEAGYPGASILGDAVCGMAAIRVNSKDFLFWFRSHTAKEIKWGGAKHDPGDKDEGRKMHPRSSFKAFLEVVKWRSLPWEDMEMDAI

SEQ ID NO: 1489 - protein, 510 aa, Zea mays
  misc_feature (30)..(30): Xaa can be any naturally occurring amino acid
  misc_feature (227)..(227): Xaa can be any naturally occurring amino acid
MDGSSKGSGHSEALRNYNLGRTLGIGTFGXVKIAEHKLTGHRVAIKIINCRQMRNMEMEEKAKREFKILKLFIHPHIIRLYEVIYTPTDIYVVMEYCKYGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKXIKGGIYTVPSHLSALARDLIPRMLVVEPMKRITIREIREHQWFQIRLPRYLAVPPPDTTQQAKMIDEDTLRDVVNMGFNKNHVCESLCSRLQNEATVAYYLLLDNRFRATSGYLGADYQESMDRNLNQLASSESSSSGTRNYVPGSSDPHSSGLRPYYPVERKWALGLQSRAHPREIMVEVLKALQELNVRWKKNGHYNVKCRWCPGFPEVNDTLDASNSFLGDSTIMDNDDANGRLPTVIKFEFQLYKTKDDKYLLDMQRVTGPQLLFLDFCAAFLTKLRVL

SEQ ID NO: 1490 - protein, 548 aa, Rhopalosiphum padi
MAAKDVKFGNEARIKMLRGVNVLADAVKVTLGPKGRNVVLDKSFGAPSITKDGVSVAREIELEDKFENMGAQMVKEVASKANDAAGDGTTTATLLAHSIVNEGLKAVAAGMNPMDLKRGIDKAVISAVEELKNLSVPRSDSKAITQVGTISANADEKVGALIAEAMEKVGNDGVITVEEGTVFKDELEVVKGMQFDRGYLSPYFINKPETGVVELENPYILMADKKISNVREMLPILESVAKSGKPLLIISEDLEGEALATLVVNSMRGIVKVAAVKAPGFGDRRKAMLQDISVLTGGSVISEELAMDLEKSTLEDLGQAKRVVINKDTTTIIGGVGEKSQAIQSRISQIRQEIQEATSDYDKEKLNERLAKLSGGVAVLKVGAATEVEMKEKKARVEDALHATRAAVEEGVVAGGGVALVRVAGKISNLRGHNEDQNVGIRVRLRAMEAPLRQIVSNSGEEPSVVTNNVKDGKGNYGYNAATDEYGDMIDFGILDPTKVTRTALQYAASVAGLMITTDMVTDLPEEDKTSDASSSPAGGMGGMGGMM

SEQ ID NO: 1491 - protein, 548 aa, Sitobion avenae
MAAKDVKFGNEARIKMLRGVNVLADAVKVTLGPKGRNVVLDKSFGAPSITKDGVSVAREIELEDKFENMGAQMVKEVASKANDAAGDGTTTATVIAQSIVNEGLKAVAAGMNPMDLKRGIDKAVISAVEELKFHLSVPCSDSKAITQVGTISANADEKVGSLIAEAMDKVGNDGVITVDEGTGLQDELEVVKGMQFDRGYLSPYFINKPETGIVELENPYILMADKKISNVREMLPILESVAKSKPLLIISEDLEGEALATLVVNSMRGIVKVAAVKAPGFGDRRKAMLQDISILTGGSVISEELAMELEKSTLEDLGQAKRVVISKDTTTIIGGVGEKHTVQSRISQIRQEIQEATSDYDKEKLNERLAKLSGGVAVLKVGAATEVEMKEKKARVEDRLHRTRAAVEEGVVAGGGVALVPVAGKISHLRGQNEDQNVGIRVALRAMEAPLRQIVSNSGEEPSVVTNNVKDGQGNYGYNAATDEYGDMIDFGILDPTKVTRSALQYAASVAGLMITTECMVTDLPKEDKSSDSNSAPAGGMGGMGGMM

SEQ ID NO: 1492 - protein, 392 aa, Unknown
  Bradyrhizobium sp. BTAi1
MADTCETSDQRAFRRPPFRNIRMSVLFTPIKLRGLELANRIVVSPMCQYSAENGAANDWHFTHINTLALSGAAMFCIEATHVEPIGRITPGCLGLWDDATEAALVPILTSVRKHSKTAIAMQLAHAGRKGSSHKPWDGGQQIAPASGGWQTVAPSAVPHKDGELAPEALDTDGLARIRDAFVSAAQRAARLGIDAIELHAAHGYLLHQFLSPLANRRSDAYGGSLENRMRYPLELFDAVRSVFPADKPVGVRVSATDWVDGGWDLDQTIVFAQELKRRDVDWIDVSSGGVSPLQKITLGPGYQVPFAAAVKQATGLPTMAVGLITQAQQAEEIVASGKADMVALARGMLYDPRWGWHAAAELGGQVAAPPQYWRSQPSTQKELFGRTTFGAR

SEQ ID NO: 1493 - protein, 686 aa, Bacillus subtilis
MSDDQNKRVNEHSKDEQLEQYRTDNSGKKMTTNQGLRVSEDEHSLKAGVRGPTLMEDFHFREKMTHFDHERIPERVVHARGFGVHGFFQVYEPMTEYTRAKFLQDPSVKTPVFVRFSTVAGSKGSADTVRDARGFATKFYTEEGNYDLVGNNIPVFFIQDAIKFPDLVHAFKPEPHNEMPQAATAHDTFWDFVANNPESAHMVMWTMSDRGIPRSYRMMEGFGVHTFRFVNEQGKARFVKFHWKPVLGVHSLVWDEAQKIAGKDPDFHRRDLWETIENGGKVEYELGVQMIDEEDEFKFDFDILDPTKLWPEELVPVKIIGKMTLNRNQDNVFAETEQVAFHPGNVVPGIDFTNDPLLQGRLFSYTDTQLIRLGGPNFHEIPINRPVCPFHNNQYDGYHRMTINKGPVAYHKNSLQNNDPSPATAEEGGYVHYQEKVEGKKIRQRSDSFNDYYSQAKLFWNSMSPVEKQHIISAFCFEVGKVKSKDVQRQVVDVFSNVDADLAEEIAKGVGVAAPAKRKASKENLTSPALSQARTVKTASTRKVAVLAGNGFHEKELQTVLEALKQEGITVDIISQNLGYMTSGSGQQLEASGTFLTVDSVLYDAVYAAGGLELKDNKQAMAFIREAYNHYKAIGAANEGIDLLQSSVGTTEGLGIVTAKDEPDYTAFSKAFIDAVAAHRHWDRRI

SEQ ID NO: 1494 - protein, 328 aa, Wigglesworthia glossinidia
MISLREFIFSNNVNKYISKEDLYSLFIIIELTSKIIHNYIILNNITRIKQEKIKKNIHGEHQTKLDLLSNKKFIDMIKTHYNIAGIASEEEAKFISFKQEKYGKYIFLIDPLDGSLSADCNTPVGTIFSLYCRVTPIGVEISEKDFLQPGNKQILSGYILYGSSTILVFTVKSGVHIFTYHPFFSTFFLSKKNFNYPKKNNIYSINEANYNNFSLGIKKYIMSCKSNNNISSRYTGSLVADFHRNLIKGGIYLYPNTKIYKHGKLRLMYECNPIALISSQANGSSSDGNINILDINPKILHQCSPFFVGTKSMVKLVNKFILGYYNHN

SEQ ID NO: 1495 - protein, 338 aa, Oryza sativa
MSTTKVKRRVGKYELGRTIGEGTFAKVKFARDTETGDPVAIKILDKEKVLKHKMVEQIKREISTMKLIKHPNVVRIYEVMGSKTKIYIVLEYVTGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRVTIPEILEDEWFKKGYKRPEFDEKYDTTLDDVYAVFNDSEEHHVTEKKEEPEALNAFELISMSAGLNLGNLFDSEQVRDLPI

SEQ ID NO: 1496 - protein, 419 aa, Oryza sativa
MSTTKVKRRVGKYELGRTIGEGTFAKVKFARDTETGDPVAIKILDKEKVLKHKMVEQIKREISTMKLIKHPNVVRIYEVMGSKTKIYIVLEYVTGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRVTIPEILEDEWFKKGYKRPEFDEKYDTTLDDVYAVFNDSEEHHVTEKKEEPEALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKVDHAN

SEQ ID NO: 1497 - protein, 742 aa, Vibrio vulnificus
MRIVFTTLAVWRGKKGLKKLVKSKVNQMFEKLSQAACSEPFAFLGPFIDPTQGALRVWMPGATGVALVLEGQPRIALEREKESAFILKADLNLHLTHYQLAIDWNGIEQLVDDPYQYHGIYAEYDDLHTPKTMYQHMGSQFMTLERDGKSISGIRFLVYAPHATAVSLVGSFNDWDGRRHPMQRLDYGIWGLFIPGLTEGVSYKFEMKGPKGEGLPHKADPWGFYAEQYPSFASVTYDHARYQWQDAQWQTRPVTEKRKEALSFYELHAGSWKRNEQGEFLNYRELAAELVPYLVDMGYTHVELMPVSEHPFYGSWGYQPVGLFAPTSRYGSPDDFKFFVDACHQAGIGVVLDWVPAHFPSDDHGLANFDGTPLFHDPDPRRGWHQDWNSFIYDLGREQVRRFLVSNALYWFEQFHIDGIRVDAVASMLYLDYSRSHGQWIPNMDGGNENYDAIATLKWMNEEVYKYFPNAMTIAEESTAFPGVSAPTFMGGLGFGFKWNMGWMHDSLSYIKEEPVHRKYHHNTLTFPLVYAHSENYVLSLSHDEVVYGKGSIHNKMPGDEWQQTANLRAYFGYMYGQPGKKLNFMGAEIGQTAEWNHDDQLQWFLLDFPRHQGVQALTRDLNHLYRNEAALHDQDCIPAGFEWRLQDAAEQSIIAHERISEAGERILVVSNFTPVPRDEFRLGVPNKGRYQLLLNTDDSKYAGSGYEVVVDVKSEAVVSEDLAQSIVLRLPPLSTLFYKLA

SEQ ID NO: 1498 - protein, 613 aa, Bacillus licheniformis
MCGITGWVDFKKPLVREQSIMEKMTDTLSKRGPDDTNIWGKRHVLFGHKRLAVVDLEGGRQPMTRTHQGYDYTICYNGELYNTEDLRKELRRRGHQFKSHSDTEVLLHSYMEWKEECIDRLNGIFAFAVWDEKRDLLFAARDRLGVKPFFYTEQGSSFLFGSEIKAILAHPEVKAKVDRSGLAEIFGLGPSRSPGSGVFKGVKEIRPGHAMIFSKDGLTVWRYWNVKSEKHTDSFDETVENVRSLFQDAVTRQLVSDVPVCTFLSGGVDSSAITATAAKHFEREGKAPLHTFSIDYEDNEQYFTSSSFQPNADGPWIKKMSDAFGTVHHNCVISQEELAAYLEEAVLVRDLPGMADVDSSLLWFCREIKKDFVVSLSGECADEIFGGYPWFHSAEDVKGFPWMRSMEERIGLLQDGWQKKLNLSEYVKAKYEETVKETPLLEGETGAEKRRRELFYLNMLWFMTTLLDRKDRMSMGASLEVRVPFADHRLVEYVWNIPWDVKMHGSREKGIFRKALEGILPDEVLYRKKSPYPKTHHPAYTKAVIRWLESLLEQKDSALYAFLEKKKLERLIETEGASFQVPWYGQLMKGPQLIAHLAQIHTWFESYRIDIEE

SEQ ID NO: 1499 - protein, 502 aa, Corynebacterium glutamicum
MRPKLSGNTTRHNGAPVPSENISATAGPQGPNVLNDIHLIEKLAHFNRENVPERIPHAKGHGAFGELHITEDVSEYTKADLFQPGKVTPLAVRFSTVAGEQGSPDTWRDVHGFALRFYTEEGNYDIVGNNTPTFFLRDGMKFPDFIHSQKRLNKNGLRDADMQWDFWTRAPESAHQVTYLMGDRGTPKTSRHQDGFGSHTFQWINAEGKPVWVKYHFKTRQGWDCFTDAEAAKVAGENADYQREDLYNAIENGDFPIWDVKVQIMPFEDAENYRWNPFDLTKTWSQKDYPLIPVGYFILNRNPRNFFAQIEQLALDPGNIVPGVGLSPDRMLQARIFAYADQQRYRIGANYRDLPVNRPINEVNTYSREGSMQYIFDAEGEPSYSPNRYDKGAGYLDNGTDSSSNHTSYGQADDIYVNPDPHGTDLVRAAYVKHQDDDDFIQPGILYREVLDEGEKERLADNISNAMQGISEATEPRVYDYWNNVDENLGARVKELYLQKKA

SEQ ID NO: 1500 - protein, 509 aa, Candida albicans
MDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDGAMFNNYCNDHQ

SEQ ID NO: 1501 - protein, 391 aa, Micrantheum hexandrum
DLEPVNPADVPVTAAGALKSYKLAAKAISRLQSLPSGNISLLCDVLVKEVSELTGYDRVMVYRFHEDEHGEVIAECCQPDLEPYLGLHYPATDIPQASRFLFMKNKVRMICDCMALPVKVLQDERLSQPLSLSGSTLRSPHGCHAQYMANMGSVASLVMSVTINDDDDGLDSDQQAGRKLWGLVVCHHTCPRFVPFPLRYACEFLIQVFGVQINKEVELAVQMREKHILQIQTVLCDMLLRDAPVAIITQSPNVMDLVKCDGAALYYRKKIWLLRVTPTEAQIRDIAEWLLESHSGSTGLSTDSLMEAGYPGASVLGDAVCGMAAVRITSKDFLFWFRSHAAKEIKWGGAKHDPDDKDDGRKMHPRSSFKAFLEVVKRRSLPWEDIEMDAI

SEQ ID NO: 1502 - protein, 391 aa, Microdesmis puberula
DLEPVNPADVPVTAAGALKSYKLAAKAISRLQSLPSRNISLLCDVLVKEVSDLTGYDRVMVYRFHEDEHGEVVAECCRTELEPYLGLHYPATDIPQASRFLFMKNKVRMICDCQAPPVKVLQDRRLAQPLSLCGSTLRSPHGCHAQYMANMGSVASLVMSVTINEDDDEMHSDQQKGRKLWGLVVCHHTSPRFVPFPLRYACEFLIQVFGVQINKEVELAAQMREKHILRIQTLLCDMLLRDSPVAIITQSPNVMDLVKCDGAALYYNNKFWLLGVTPTEAQIRDISEWLLEYHSGSTGLSTDSLMEAGYHRASILGDAVCGVAAVRITSNDFLFWFRSHTAKEMKWGGAKHDPVDKDDGKKMHPRSSFKAFLEVVKWRSLPWEDVEMDAI

SEQ ID NO: 1503 - protein, 507 aa, Unknown
  Frankia sp. EAN1pec
MTVQKPRPTTTDAGIPVASDEHSLSVGPDGPLLLQDHYLIEQMANFNRERIPERQPHAKGGGAFGTFQVTQDMSAFTRAAVFQPGTETDVIIRFSTVAGERGSPDTWRDPRGFAVKFYTSEGNLDIVGNNTPVFFIRDPLKFQHFIRSQKRRADNNLRDHDMQWDFWTLSPESAHQVTWLMGDRGIPRTWRHMNGYSSHTYMWINAAGERFWVKYHFKTDQGIEFFTQDEGDQMASVDTDYHQRDLFEHIAAGDFPSWTLKMQIMPFEEAKTYRFNPFDLTKVWPHGDYPLHEVGRLTLNRNITDFHTEMEQAAFEPNNIVAGTGLSPDKMLLARGFSYADAHRARLGVNYKQIPVNSAKVPVHSYSKDGAMRVQNVTDPVYAPNSYSGPVAQPELTDDGGHWYSDGEMVRAAYTSRPEDDDWGQAGTMVRDVLDDAARQRLVDNVVGHLLDGVSEPVLVRAFEYWRNVDKDLGTRIEADVRAKQDETDPKAAQQANPARSSAQAKA

SEQ ID NO: 1504 - protein, 391 aa, Neoscortechinia kingii
DLEPVNPADVPVTAAGALKSYKLAAKAISRLHSLPSGNISLLCDVLVKEVSDLTGYDRVMVYKFHEDEHGEVVAEFRRPDLEPYLGLHYPATDIPQASRFLFMKNKVRMICDCLAPPVKVIQDKSLAEPLSLWGSTLRSPHGCHAQYMANMGSIASLVMSVTINEDDDRMDSDQQKGRKLWGLVVCHHTCPRFVSFPLRYACEFLIQVFGIQINKEVQLAAQMREKHILQIQTMLCDMLLRDAPVAIITQSPNVMDLVKCDGAALYYKKKFWLLGVTPTEAQIRDIVEWLLDVHSESTGLSTDSLMEAGYLGASILGDAVCGMAAIRISSKDFLFWFRSHTAKEIMWGGAKHDPDDKDHVRKMHPGSSFKAFLEVVKWRSLPWEDMEMDAI

SEQ ID NO: 1505 - protein, 392 aa, Ochna multiflora
DLEPVNPADVPVTAAGALKSYKLAAKAISRLQSLPSGKISMLCDVLVKEVHDLTGYDRVMVYKFHEDEHGEVVAECHRPDLEPYIGLHYPATDIPQASRFLFMKNKVRMICDCMESPVKVIQDKKLAQPLSLSGSILRAPHGCHSQYMANMGSIASLVMSIMINDDDDNEMESNHQKPRKLWGLVVCHHTSPKVCPFPLRYACEFLIQVFGVQINKEVEVPAQVKEKHILRTQNVLCDMLLRDTPVAIVTQSPNVMDLVKCDGAALFYKNKFWLLGITPTADQIRDIASWLNEYHNGSTGLSTDSLMEAGYHGASILGGAVCGMAAIRISSKDFLFWFRSQTAKEIKWGGAKHDPNEKDDGRKMHPRSSFNAFLEVVKWCSLPWEDMEMDAI

SEQ ID NO: 1506 - protein, 902 aa, Clostridium thermocellum
MDCRVKNEVRDDLNVNLEVMVAGNDEEFAASLKNALLDVGCKHSVKSAATFNEFKNYLRKNNFHIVFFDCSSDISFADVMESFENLKKEMPVVAVLEEDGSRHGFEMIKLGACEYLEKKDSSRLRSIIFKRCRELERERERIRFEKRLKEENERLLTTLESIGDGVIVTDKAGCVIMMNKAAQELTGYLSCNSIGKPLSEVFVIINGVNREPEPDPYERVLSERKTVGLRKNTMLVSKDGTLRYVSASTAPIKSSDREIMGVVVVFRDITRIRKAEEKLQKLSQAVEQSPGIIVMADTRGNIEYVNPRFTEVTGYSFDEVKGKSLFFMELEENGEEKCKDMIQAVFSGKEWRSEIRHKSKNNVVFWEYAYYSPIINSEGVVTNYLKVSEDITERKLMSENLFKAKEAAEAANRAKSEFLANMSHEIRTPLNGIIGMTNLTLQTELTDEQRENLNIVNSCAELLLRVINDILDYSKIEAGKMTLENVKFDFFNLLEKTYKAHIVQANEKGLRLSYTVQKGIPRILVGDPGRLQQVLNNLISNAVKFTDIGEVRIDVDIIEKRDDSVKLKFTVSDTGIGIDGDKMNMLFKSFSQVDSSITRKYGGTGLGLAISKQLVEMMGGEIWVESQKGKGSTFYFTAGFKRKAKSSVKAECTSNADERVLGRKLNILLAEDDKVNQQVIAGMLKKEQCSLTIAENGFEAIKLFEENEFDLILMDVQMPEMDGIEATKRIRKMEEGTFRHIPIIAVTAFAFENDREKILEAGMDDYISKPFSFDDIYAAINRVLYKDEQSSDDMQKEKEDEKGSLDPDEKVNETLSESGTVNETGPDYSLKDIMERLDLSILNGNFTAIDKSALAVKEFAQNRGFDKVKNLAFKIQLSARKNQLEDVKKLYEVLKQEISKFN

SEQ ID NO: 1507 - protein, 392 aa, Unknown
  Ochna sp. Davis 31-01
DLEPVNPADVPVTASGALKSYKLAAKAISRLQSLSSGNISMLCDVLVKEVHDLTGYDRVMVYKFHEDEHGEVVAEYHRPGLEPYIGLHYPATDIPQASRFLFMKNKVRMICNCMEPAVKVIQDKKLAQPLSLAGSTLRAPHGCHSQYMANMGSVASLVMSVMINDDDDNEMESNHQKPRKLWGLVVCHHTSPRFVPFPLRYACEFLIQVFGVQINKEVELTAQLKEKHILRTQSVLCDMLLRDTPVAIVTQSPNVMDLVKCDGAALFYKNKFWLLGITPTEDQIRHIASWLNEYHNGSTGLSTDSLMEAGYHGASILGGAVCGMAAIRISSKDFLFWFRSQTAKEIKWGGAKHDPSEKDDGGKMHPRSSFNAFLEVVKWCSLPWEDMEMDAI

SEQ ID NO: 1508 - protein, 617 aa, Escherichia coli
MLSEGTHLRPYETLGAHADTMDGVTGTRFSVWAPNARRVSVVGQFNYWDGRRHPMRLRKESGIWELFIPGAHNGQLYKYEMIDANGNLRLKSDPYAFEAQMRPETASLICGLPEKVVQTEERKKANQFDAPISIYEVHLGSWRRHTDNNFWLSYRELADQLVPYAKWMGFTHLELLPINEHPFDGSWGYQPTGLYAPTRRFGTRDDFRYFIDAAHAAGLNVILDWVPGHFPTDDFALAEFDGTNLYEHSDPREGYHQDWNTLIYNYGRREVSNFLVGNALYWIERFGIDALRVDAVASMIYRDYSRKEGEWIPNEFGGRENLEAIEFLRNTNRILGEQVSGAVTMAEESTDFPGVSRPQDMGGLGFWYKWNLGWMHDTLDYMKLDPVYRQYHHDKLTFGILYNYTENFVLPLSHDEVVHGKKSILDRMPGDAWQKFANLRAYYGWMWAFPGKKLLFMGNEFAQGREWNHDASLDWHLLEGGDNWHHGVQRLVRDLNLTYRHHKAMHELDFDPYGFEWLVVDDKERSVLIFVRRDKEGNEIIVASNFTPVPRHDYRFGINQPGKWREILNTDSMHYHGSNAGNGGTVHSDEIASHGRQHSLSLTLPPLATIWLVREAE

SEQ ID NO: 1509 - protein, 138 aa, Hortaea werneckii
YTDTDKDPYSVRKGLLYSHFGWMIMKQNPKRIGRTDISDLNDDAVVVWQHKHYLKVVLFMGLIFPCLVSGLGWGDWMGGFIYAGILRIFFVQQATFCVNSLAHWLGDQPFDDRNSPRDHVITALVTLGEGYHNFHHEF

SEQ ID NO: 1510 - protein, 537 aa, Glycine max
  misc_feature (205)..(205): Xaa can be any naturally occurring amino acid
  misc_feature (217)..(217): Xaa can be any naturally occurring amino acid
  misc_feature (220)..(220): Xaa can be any naturally occurring amino acid
MYRSSNIVARVFDRQICTPAPGTSVHHARRFYENLVPSHTVYEVECPDHSFRKFTDDGQYLISFSRNHQELIVYRPRWLSFSCKDEDCDKHDLPSRAKRFDSFFSQLYCVPLASCNELICKDFFLYMESNQFGLFATSTAQIHDAPAVGGAVHGVPSIEKITFHLLRLEDGEILDKKVFSNDFVNLTHNMGVFLYDDLLAIVSLXRYQTIHILQIRXSGXLVDVRAIGEFCREDDELFLNSNAQGMAFSDKNKQLQLPGNHIENHMHQGQPNLGNSFLSGIKQRLLSFIFQGLWNEERDDTLRIQRLRKKFYFHFQDYVDLIIWKVQFLDRHHLLIKFGSVDGGVSRNADHHPAFVAVYNMDTTEIVSFYQNSADELYLLFEQFCDHFHATSRNSMYMNFISSHSNNIHALEQLRSIKDKASSSAQFVKKMLASLPFSCQSQSPSPYFDQSLFRFDDKLISATDRHRQSTDHPIKFILRRYPYSLKFKIKPGPEAGSMDGRAKKISSFLFHPILPLALSVQQTLFLQPSVVNIHFRR

SEQ ID NO: 1511 - protein, 577 aa, Arabidopsis thaliana
MCGILAVLGCVDNSQAKRSRIIELSRRLRHRGPDWSGLHCYEDCYLAHERLAIVDPTSGDQPLYNEDKTIAVTVNGEIYNHKALRENLKSHQFRTGSDCEVIAHLVKHGEEFVDMLDGMFAFVLLDTRDKSFIAARDAIGITPLYIGWGLDGSVWFASEMKALSDDCEQFMCFPPGHIYSSKQGGLRRWYNPPWFSEVVPSTPYDPLVVRNTFEKAVIKRLMTDVPFGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSETMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 1512 - protein, 682 aa, Yersinia pestis
MVVCLMETAMLAYPHLFTPLDLGFTTLKNRILMGSMHTGLEELPDGPQRLAAFYAERAAGGVGLIVTGGIAPNMKGGVYQGASVLNDAAQIPHHQVVTEAVHQAGGKIALQILHAGRYSYQKHPVAPSALQAPINPFVPQALSHEEILQTIADFAHCAQLAKQAGYDGVEIMGSEGYLINQFLTARTNQRDDEWGGDFTHRMRFAVEIVRAVRQATGHDFILIYRLSMLDLVEEGSNWVEIEQLAQAVEQAGATVINTGIGWHEARIPTIATMVPRAGFSWVTRKLMGKVNIPLITTNRINDPAVAEQVLADGCADMVSMARPFLADAAFVQKAAQGRADEINTCIGCNQACLDQIFDGKLTSCLVNPRACRETEMPELPTDAPKRLAVVGAGPAGLAFAVTAARRGHQVTLFDAAAEIGGQFNIAKQIPGKEEFYETLRYFRRQLVLNGVTLQLNTLVQVKQLAEFDEVILACGIQPRLPCINGIDHPKVLTYLDVLRDKKPVGQRVAIIGAGGIGFDTAEYLSQSGDSPRFDSTAFSTEWGIDQDLAHRGGLSPAGAKVPPSPRQIFLLQRKASKVGEGLGKTTGWIHRTSLAMRGVKMLNSVSYEAIDDKGLHIIRAEQACCLPVDTIIICAGQEPRRELHQPLLDMGKTVYLIGGADKAVELDARRAIDQGTRLALAI

SEQ ID NO: 1513 - protein, 212 aa, Vibrio vulnificus
MRKVLLTGFEPFGGESINPSLELVKQMASRALPQVEIIGCEVPVVRYQAIETVLQAVETHQPDLVLMIGQASGRCAITPERVAINLDDYRIEDNAGHQPVDEPIIATGPAAYFSTLPVKAITHALQQAGIPCQISHSAGTFVCNHLFYGVQHHLHTRAIRSGFIHIPLLPEQASASNQPSMSLETLVHGLEMMMITCLETEQDTKHTGGTIC

SEQ ID NO: 1514 - protein, 692 aa, Yersinia pseudotuberculosis
MNKFVRLAAIAGLLLAGASYATDTTYRIDQLPQLRQEPEHATVSERVTSRFTRSHYRQFALDDQFSAKIFDRYLNMLDYSHNVLLASDVAQFADKKYSLDKELKSGQLDTPFALFNLAQKRRFERYQYALSVLDRPMVFTGNDTIDIDRAKAPWPSSEAELNALWDAKVKYDQLNLKLAGKTDKEIKETLTKRYQSAIKRLTQSNSEDVFQLIMNAFAREIDPHTNYLSPRNTEQFNTEMSLSLEGIGAVLQMDDDYTLINSMVPGGPAAKSKTIAVGDRVIGVGQAGKPMVDVIGWRLDDVVALIKGPKGSKVRLEILPAGKGTKPRTVTLTRERIRLEDRAVKMSVKTIGKERVGVLDIPGFYVGLTEDVKVQLQKLEKQNVSSIIIDLRSNGGGALTEAVSLSGLFIPSGPVVQVRDNNGKVREDSDTDGVVYYKGPLVVLVDRYSASASEIFAAAMQDYGRALIVGEPTFGKGTVQQYRSLNRIYDQMLRPEWPALGSLQYTIQKFYRVDGGSTQRKGVTPDIVMPTGVDPAETGENFEDNALPWDRINAASYTKTGDLKPWEPELLKNHAERIAANPEFQYIQKDIERYKALKDKRNIVSLNYAQREKENRDDDMTRLTRLNERFIREGKKPLKSLDDLPKDYQEPDPYLDETVNIALDLAHQEKAQPQIASRPVAAATATAGATVK

SEQ ID NO: 1515 - protein, 493 aa, Cucumis melo
MGFHQTHETNQVLLSKIAISDGHGEDSPYFDGWKAYDNDPFHPENNPLGVIQMGLAENQLSPDLIVDWIRKHPKASIYTDEGLLNFKDIANFQDYHGLPEFRNAIASFMGKARGGRVKFDPSRIVMGGGATGASETVIFCLADPGDAFLIPSPYYAAFDRDLQWRTRAQIIPVHCNSSNNFQITREALEVAYKKAEESNIKVKGLIITNPSNPLGTIYDRDTLKSLVNFVNDNNIHLICDEIYSATVFKSPSFTSIAEIIEEMDHCKKELIHILSSLSKDMGLPGFRVGILYSYNDTVVSIARKMSSFGLVSSQTQHLLAAMLSDEEFVDNFLVENSKRLAKRHARFTEELEKMGITCLNSNAGLFVWMDLRKLLKDQSFESEMELWRVIINEVKLNVSPGSSFHVTEPGWFRVCFANMDDNTVGVALDRIHSFVGKIDKKENSTIPMPPKKKHRENKLRLSFSFSGRRYEEGNVLKSPHMMSPHSPLVRAKT

SEQ ID NO: 1516 - protein, 566 aa, Zea mays
MAPLLAAAMNHAAAHPGLRSHLVGPNNESFSRHHLPSSSPQSSKRRCNLSFTTRSARVGSQNGVQMLSPSEIPQRDWFPSDFTFGAATSAYQIEGAWNEDGKGESNWDHFCHNHPERILDGSNSDIGANSYHMYKTDVRLLKEMGMDAYRFSISWPRILPKGTKEGGINPDGIKYYRNLINLLLENGIEPYVTIFHWDVPQALEEKYGGFLDKSHKSIVEDYTYFAKVCFDNFGDKVKNWLTFNEPQTFTSFSYGTGVFAPGRCSPGLDCAYPTGNSLVEPYTAGHNILLAHAEAVDLYNKHYKRDDTRIGLAFDVMGRVPYGTSFLDKQAEERSWDINLGWFLEPVVRGDYPFSMRSLARERLPFFKDEQKEKLAGSYNMLGLNYYTSRFSKNIDISPNYSPVLNTDDAYASQEVNGPDGKPIGPPMGNPWIYMYPEGLKDLLMIMKNKYGNPPIYITENGIGDVDTKETPLPMEDALNDYKRLDYIQRHIATLKESIDLGSNVQGYFAWSLLDNFEWFAGFTERYGIVYVDRNNNCTRYMKESAKWLKQFNAAKKPSKKILTPA

SEQ ID NO: 1517 - protein, 337 aa, Unknown
  Burkholderia sp. 383
MSIARRTTLSKFLIEQQRETNNLPADLRLLIEVVARACKAISYNVSKGALGEALGTAGSENVQGEVQKKLDILSNEILLDANEWGGNLAAMASEEMETFFPIPANYPRGEYLLVFDPLDGSSNIDVNVSIGTIFSVLRCPDGKQATEESFLQPGTQQVAAGYAVYGPQTVFVLTTGNGVNCFTLDREVGSWVLTQSNMQIPADTREYAINASNARHWYDPVKRYVDELNAGKDGPRGDNFNMRWIASMVSDVHRILNRGGVFMYPADKRTPDRPGKLRLMYEANPMSFIVEQAGGAATTGTQRIMEVQPTGLHQRVPVFLGSKNEVDRVTGYHQEKQ

SEQ ID NO: 1518 - protein, 469 aa, Bacillus subtilis
MSSNEKRFPEGFLWGGAVAANQVEGAYNEGGKGLSTADVSPNGIMSPFDESMTSLNLYHNGIDFYHRYKEDIALFAEMGFKAFRTSIAWTRIFPNGDEEEPNEEGLRFYDDLFDELLKHHIEPVVTISHYEMPLGLVKNYGGWKNRKVIEFYERYAKTVFKRYQHKVKYWMTFNEINVVLHAPFTGGGLVFEEGENKLNAMYQAAHHQFVASALAVKAGHDIIPDSKIGCMIAATTTYPMTSKPEDVFAAMENERKTLFFSDVQARGAYPGYMKRYLAENNIEIEMAEGDEELLKEHTVDYIGFSYYMSMAASTDPEELAKSGGNLLGGVKNPYLKSSEWGWQIDPKGLRITLNTLYDRYQKPLFIVENGLGAVDKVEEDGTIQDDYRINYLRDHLIEARERIADGVELIGYTSWGPIDLVSASTAEMKKRYGFIYVDRDNEGNGTFNRIKKKSFNWYQQVIATNGESL

SEQ ID NO: 1519 - protein, 449 aa, Arabidopsis thaliana
MSGSRRKATPASRTRVGNYEMGRTLGEGSFAKVKYAKNTVTGDQAAIKILDREKVFRHKMVEQLKREISTMKLIKHPNVVEIIEVMASKTKIYIVLELVNGGELFDKIAQQGRLKEDEARRYFQQLINAVDYCHSRGVYHRDLKPENLILDANGVLKVSDFGLSAFSRQVREDGLLHTACGTPNYVAPEVLSDKGYDGAAADVWSCGVILFVLMAGYLPFDEPNLMTLYKRVRICKAEFSCPPWFSQGAKRVIKRILEPNPITRISIAELLEDEWFKKGYKPPSFDQDDEDITIDDVDAAFSNSKECLVTEKKEKPVSMNAFELISSSSEFSLENLFEKQAQLVKKETRFTSQRSASEIMSKMEETAKPLGFNVRKDNYKIKMKGDKSGRKGQLSVATEVFEVAPSLHVVELRKTGGDTLEFHKFYKNFSSGLKDVVWNTDAAAEEQKQ

SEQ ID NO: 1520 - protein, 405 aa, Shigella flexneri
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPRGALYMFPKIDAKRFNIHDDQKMVLDFLLQEKVLLVQGTAFNWPWPDHFRIVTLPRVDDIELSLSKFARFLSGYHQL

SEQ ID NO: 1521 - protein, 391 aa, Pera bicolor
DLEPVNPSDVPVTAAGALKSYKLAAKAISKLQSLPSGNISLLCDVLVKEVGDLTGYDRVMVYRFHEDEHGEVVAECRRPDLEPYLGLHYPATDIPQASRFLFMKNKVRMICDCLAPPVKVIQDSSLCQPVKSLWIYTEIPSWLHAQYMANMGSVASLVMSVTINEDDDEIDTDQRKGRKLWGLVGCHHTSPRFVPFPLKDACEFLIQVFGVQINKEVELAAQMREKHILRTQTMLCDMLLRDDPAAIVTQSPNVMDLVKCDGAALYYRKKFWFLGVTPTEAQTRDIAEWLLEYHSDSIGLISDSLMEAGYPGASVLGNAICGMAAVRITSKDLLFWFRFHTAKEIKWGGAKHDPGDKDDGRKMHPRSSFKAFLETVKWRSLPWEDVEMDAI

SEQ ID NO: 1522 - protein, 391 aa, Peridiscus lucidus
DLEPVNPADVPVTAAGALKSYKLAAKAISRLQSLPSGNISLLCDVLVKEVSDLTGYDRVMVYKFHEDEHGEVVAECCRPDLEPYLGLHYPATDIPQASRFLFMKNKVRMICDCLALPVKVIQDKRLAQPLSLCGSTLRSPHGCHAQYMANMGSIASLVISVTINEEDEEMESSQQRGRKLWGLVVCHHASPRFVPFPLRYACEFLIQVFGVQINKEVELAAQLKEKHILQTQTVLCDMLLRDAPVGILTQSPNVMDLVKCDGAALYYREKFWLLGVTPTEVQIKTIAEWLLEYHSGSTGLSTDSLTEAGYPGASILGDAVCGMAAVKITSKDFLFWFRSHTAKEIKWGGAKHDPSDKDDGRKMHPRSSFKAFLEVVKRRSLPWEDMEMDAI

SEQ ID NO: 1523 - protein, 419 aa, Bifidobacterium longum
MHFSSRVDISAPNPIAAAAAAAKANGIALSKLNDSNPTRHGLAPELVPSVYTADPRGPRAAREALAAFLNTAKAVDASSPQSTSPAASEGGNERHAAFNNANTAIEGVDPDALYLLSSTSEAYSWLIKLLCDAGDAVLAPKPGYPLIESIARLECVDTVEYQLQFDGSWFIDIAELERLLSEPGGERIRALVLINPNNPTGSYVKPTERARIVTLCREHGIALIADEVFFDYSLEPFPGNARLAGERGVLTFALDGFSKMLAAPHAKVGWIQVSGPAEDVAEAQRRLDVIADDYLPMSDIIAERIPALLNAAPAQTRRVGERVRNNLAKLHELLDADPNGLVSVLRAEGGWNVLLRVPSVIDENELVLRLIDEHKLTGQPGYFFDMTSNGYLAVSLLPEPDEFERGIRAVLNTVAALLR

SEQ ID NO: 1524 - protein, 391 aa, Petalostigma pubescens
DLEPVNPADVPVTAAGALKSYKLAAKAISRLQSLPSGNISLLCDVLVKEVSELTGYDRVMVYRFHEDEHGEVVAECCRPDLEPYLGLHYPATDIPQASRFLFMKNKVRMICDCMAPPVEVVQDERLSQPLSLCGSTLRSPHGCHAQYMANMGLIASLVMSVTINEDNDEMDGDQQTGRKLWGLVVCHHTSPRFVPFPLRYACEFLIQVFGVQINKEVELAVQMREKHILRTQTVLCDMLLRDAPVAIITQSPNVMDLVKCDGAALYYRKKFWLLGVTPTEAQVRDIAEWLLECHSGSTGLSTDSLMEAGYPGASILGDAVCGMAAVRITSKDFLFWFRSHTAKEIKWGGAKHDPGDKDDGRKIHPRSSFNAFLEVVKRRSLPWEDVEMDAI

SEQ ID NO: 1525 - protein, 391 aa, Phyllanthus epiphyllanthus
DLEPVNPDDVPVTAAGALKSYKLAAKAISKLQSLPSGNISLLCDVLVKEVSELTGYDRVMVYKFHQDEHGEVVAESCRPDLEPYLGLHYPATDIPQASRFLFMKNKVRMICDCQAPPVKVVQDKQIAQLLSLCGSTLRSPHGCHAQYMANMGTIASLVMSVTINEDDEETDNDQQIGRKLWGLVVCHHTNPKFVPFPLRYACEFLIQVLGVQVHREVELAAQTTEKHILQTQTVLCDMLLRDAPVAIVTQSPNVMDLVKCNGAALFYRKKFWMLGVTPTEAQIKDITEWLLEYHGESTGLSTDSLMEAGYPGAAILRYAVCGMAAIKITSKDFLFWFRSHSAKEIKWGGAKHDPGDKDDGRKMHPRSSFKAFLEVVKWRSIAWEDVEMDAI

SEQ ID NO: 1526 - protein, 243 aa, Hordeum vulgare
MAAATAPFALVSRLSQAARLPIRAWRAARPAPLWTGRTRPLSVASAAQEDRDNSVDVQVSQARNAGNQQGNAVQRRPRRAGFDISPFGLVDPMSPMRTMKQMSDTMDRLFDDAVGFPTARRSPAAAAGEMPRMPWDIMEDDKEVKMRFDMPGLSREEVKVMVEDDALVIRGEHKKEAGEGQGEAAGGGDGWWKERSVSSYDMRLALPDECDKSQVRAELKNGVLLVSVPKRETERKVIDVQVQ

SEQ ID NO: 1527 - protein, 244 aa, Hordeum vulgare
MAAATAPFALVSRLSPAARLPIRAWRAARPAPLWTGRTRPLSVASAAQENTDSSVDVQVSQDRNAGNQQGNAVQRRPRRAAGFDISPFGLVDPMSPMRTMKQMLDTMDRLFDDAVGFPTAGRSPAAAAGEMPRMPWDIMEDDKEVKMRFDMPGLSREEVKVMVEDDALVIRGEHKKEAGEGQGEAAGGGDGWWKERSVSSYDMRLALPDECDKSQVRAELKNGVLLVSVPKRETERKVIDVQVQ

SEQ ID NO: 1528 - protein, 391 aa, Pimelodendron zoanthogyne
DLEPVNPADVPVTAAGALKSYKLAAKAISKSQSLPSGNISLLCDVLVKEVSDLTGYDRVMVYKFHEDEHGEVIAEYHRPDLEPYLGLHYPATDIPQASRFLFMKNKVRMICDCLAPPVKVIQDRSLAQSLSLCGSTLRSPHGCHAMYMTNMGSIASLVMSVAINEDGSEMDDDQQKGRKLWGLVVCHHTSPRFIPFPLGYACEFLIQVFGVQINKEVEMAAQMREKHILQTQTVLCDMLLRDSPMAIITRSPNVMDLVKCDGAALYYRKKFWLLGVTPTETQIKDIAEWLLECHRESTGLSTDSLIEAGYPGASIIGKAICGMAAVRINSKDFLFWFRSHTAKEIKWGGAKHDPDDKDDGRRMHPRSSFEAFLDVVKWRSLPWEDVEMDAI

SEQ ID NO: 1529 - protein, 642 aa, Caulobacter crescentus
MGKRLDTKAGARIEAAAADWFFQNSLDMFVVLRDSRIIRANPAWSQLTGWAAEDTLGREIRDFFHLHDTEVLTAAGHTLKTVGHAHSENRLARKGGGWLWVRTQSTILEGGGQLIVFQDISEDRAREAARLQAERSNELLRNAAGVYVWRFNPRRGVYAFDQDIPTPSAPEGGARTMTVAEMTQSIHPEDSARVWQAFSRTLQTGEHVEIDYRYLDPGADDWIHLHVAWRGVRGSSPDTYDVIGITQNVTELVAARDAALAAAETKSQFLANMSHEIRTPMNGVLGVLHLLKTEKLSDDGRRLLTEALSCGEMLSALLNDIIDFSKIEAGKLELSAEPVCPAELLRGVADMLRAQAETKGLYLRVEASDDLGWVATDPLRLRQALFNLIGNAVKFTLEGGVVARLSGRRIDSPDGARLRLRFEIDDTGVGIGEEAGARLFERFRQGDGSTTRRFGGSGLGLAICRRLAELMGGEVGFESQLGKGSTFWLEVETQACARPDTQETLADGPLFDGLHVLLVEDNATNRLIATRMLEALGARVTTAEDGAQGVAAARQGFDLILMDIQMPVMDGVEATHRIRAFNSPAGAAPILAMTANAMAHQQASYLAAGMDGAIAKPLSPLALTQAIAAALTLDPSRQRKAS

SEQ ID NO: 1530 - protein, 281 aa, Campylobacter upsaliensis
MQELVKLIQEAVIDISNALKFPDTSYSEEKNSSGDTQLKFDILSDEIITHHLSKSKALKALISEEKEEILKLNENAQFIVAYDPLDGSSLMDVNFAIGSIFAIYKEKVSPKNLKAALYSVYGARLELVCCEGKEVKLYRLNEGGKFDFVKELKMAEKGKINATGGTQKFWDNKHANFIKELFEEGYRLRYSGAMVSDIHQILLKGGGLFSYPATKDAPNGKLRAFFEIFPLAFIIEKAGGATTNGQNASLLELEFNQIHATSPCFFGSEYEINKLLKAYNG

SEQ ID NO: 1531 - protein, 144 aa, Brassica napus
VDPRVRFPGQSIDFFGALRARVYDDEVRKFVEGLGVEKIGKRLVNSREGPPVFEQPAMTLEKLMEYGNMLVMEQENVKRVQLADQYLNEAALGDANADAIGRGTFYGKAAQQVNLPVPEGCTDPQADNFDPTARSDDGTCVYNF

SEQ ID NO: 1532 - protein, 474 aa, Streptococcus pyogenes
MSKERTKDMKQRKHRYQFPDGFLWGSSTSGPQSEGTVPGDGKGPSNWDYWFSIESAKFHHQIGPEKTSTFYENYKGDIALLKETGHTIFRTSIQWSRLIPEGVGEVNPKAVTFYREVFQDIIAQGIKLIVNLYHFDLPYALQEKGGWENKATVWAYETYAKTCFELFGDLVNTWITFNEPIVPVECGYLGYYHYPCKVDAKAAVQVAYNTQLASSLAVKACHKLHPDHKISIVLNMTPAYPRSDAPEDVKAARIAELFQTKSFLDPSVLGVYPAELVSILEEADLLPQYSADELEVIKNNTVDFLGVNYYQPLRVQAPSKSQQEGDPLILDIYFEPYDMPGKKVNPHRGWEIYEPGLYDIALNLKEHYGNIEWLVTENGMGVEGEEAFLADGQIQDDYRITFIEDHLIQLHKALGEGANCKGYLLWTFIDCWSWLNAYKNRYGLVALDLESQKRTIKKSGYWFKALSESNGFDK

SEQ ID NO: 1533 - protein, 535 aa, Zea mays
MATCSRPLFVSNSAASASPSRASFRRLHTVAVVSIWEPLPHPPLRAAACRFARTKQCSRRSTECLASGPSVSRLTRPIRRMLSRYSSLMVTLHGNLSRCYKAMSALRPDGVSRHFMSAGGFERVVLGVVLVMSISGASYTAPSSSALTEENLLFLEAWRAVDRAYYDKSFNGQSWFRYRENALRNEPMNTREETYAAIKKMLSTLDDPFTRFLEPEKLKSLRSGTQGALTGVGLSIGYPMAINGSPSGVAVMTATPGGPAEKAGILPGDTILAIDNRSTEDMDIYDAAERLQGPEGSSVDLSIRSGTNTRHVVLKRQTVNLNPVRSRMCEIPGSKDSSKIGYIKLTTFNQNAAESVKEAIKTLRDNNVKSFVLDLRNNSGGLFPEGIQIAKIWMDKGVIVYICDSQGVRDIYEADGADTIAASEPLVVLVNKGTASASEILAGALKDNKRAVVYGEPTYGKGKIQSVFGLSDGSGLAVTVARYETPAHTDIDKVGVIPDRPLPASFPTDEDAFCSCLRDSTAACNLNAAQLFAKS

SEQ ID NO: 1534 - protein, 192 aa, Zea mays
MSKYGTIPTTSSTPAPEGSSQLDFISRAKARGASALATRRPWRELADPRALSVPRGFSDAYRRARANLAHFAANYALVVLLVVFVSLLWRPVSMLVFLACFAAWLVLYFLRDRDVDGTLVICGRGVGDGVVVAVLSAVTLALLLLTGATGFILTSLLVGLLLVLLHALLHRPADSIDDEAGRWYTPVPPSNY

SEQ ID NO: 1535 - protein, 841 aa, Oryza sativa
MASFAVSGARLGVVRAGGGGGGGGGPAARSGGVDLPSVLFRRKDSFSRGVVSCAGAPGKVLVPGGGSDDLLSSAEPDVETQEQPEESQIPDDNKVKPFEEEEEIPAVAEASIKVVAEDKLESSEVIQDIEENVTEGVIKDADEPTVEDKPRVIPPPGDGQKIYQIDPMLEGFRNHLDYRYSEYKRMRAAIDQHEGGLDAFSRGYEKLGFTRSAEGITYREWAPGAQSAALVGDFNNWNPNADTMTRNEYGVWEISLPNNADGSPAIPHGSRVKIRMDTPSGVKDSIPAWIKFAVQAPGEIPYNGIYYDPPEEEKYVFQHPQPKRPNSLRIYESHIGMSSPEPKINTYANFRDEVLPRIKKLGYNAVQIMAIQEHSYYASFGYHVTNFFAPSSRFGTPEDLKSLIDKAHELGLLVLMDIVHSHASNNTLDGLNGFDGTDTHYFHGGPRGHHWMWDSRLFNYGSWEVLRYLLSNARWWLEEYKFDGFRFDGVTSMMYTHHGLQVAFTGNYGEYFGFATDVDAVVYLMLVNDLIHGLYPEAVAIGEDVSGMPTFCIPVQDGGVGFDYRLHMAVPDKWIELLKQSDEYWKMGDIVHTLTNRRWSEKCVTYAESHDQALVGDKTIAFWLMDKDMYDFMALDRPSTPRIDRGIALHKMIRLVTMGLGGEGYLNFMGNEFGHPEWIDFPRGPQSLPNGSVLPGNNYSFDKCRRRFDLGDADYLRYHGMQEFDQAMQHLEEKYGFMTSEHQYISRKHEEDKVIIFERGDLVFVFNFHWSNSYFDYRVGCLKPGKYKIVLDSDDGLFGGFSRLDHDAEYFTADWPHDNRPCSFSVYTPSRTAVVYALTED

SEQ ID NO: 1536 - protein, 579 aa, Arabidopsis thaliana
MCGILAVLGCIDNSQAKRSRIIELSRRLRHRGPDWSGLHCYEDCYLAHERLAIIDPTSGDQPLYNEDKTVAVTVNGEIYNHKILREKLKSHQFRTGSDCEVIAHLYEEHGEEFIDMLDGMFAFVLLDTRDKSFIAARDAIGITPLYIGWGLDGSVWFASEMKALSDDCEQFMSFPPGHIYSSKQGGLRRWYNPPWYNEQVPSTPYDPLVLRNAFEKAVIKRLMTDVPFGVLLSGGLDSSLVAAVALRHLEKSEAARQWGSQLHTFCIGLQGSPDLKAGREVADYLGTRHHEFQFTVQDGIDAIEEVIYHIETYDVTTIRASTPMFLMSRKIKSLGVKMVLSGEGSDEILGGYLYFHKAPNKKEFHEETCRKIKALHQFDCLRANKSTSAWGVEARVPFLDKEFLNVAMSIDPEWKLIKPDLGRIEKWVLRNAFDDEERPYLPKHILYRQKEQFSDGVGYSWIDGLKDHANKHVSDTMLSNASFVFPDNTPLTKEAYYYRTIFEKFFPKQSAARATVPGGPSIACSTAKAVEWDATWSKNLDPSGRAALGVHVAAYEEDKAAAAAKAGSDLVDPLPKNGT

SEQ ID NO: 1537 - protein, 744 aa, Unknown
  Mesorhizobium sp. BNC1
MGLANIKQIWKWLWDEIAQPGRGFSSRGGTILVAFGFADLLIAGAAFLTKAAPLIPFLLVFAGAAAVAAAIALPSEKKPEEHPHEQTPAEQHIEELADRVSQMQEAEQRFYGLLETLGDLVINRDGEGRILYANRIFGELMECEPQDLFGKTLHQLGVDITPPSAGIFPEEERLSSTDVAIHTRNGLRWFSWTEISRREGESSSVSHWAIARDITARKRAETALVNARERAEQASIAKSRFLATVSHEIRTPMNGIIGMATLLSDTRLSSEQRTYVAAISTSASALLALIEDLLDYSKIEAGRLELEPQRMAARELIESVIELMAVRAFTKKIGLGCHIAPTVPDTILADPGRLRQILLNLLGNAIKFTDEGGVLMTVTTTIHDGAPKLAFRVDDTGPGIEKDSLSRIFQEFEQADTSSTRKHGGAGLGLAITRRLIDAMEGTVTVDSAPGEGATFTVYIPLVGAEGSAAETSLALKGFDVAILTPHAVEGEALAMTVRAHGGKARVFEGEKSALSLLRRRKSGFDAVIIDASLENDNGDLLRRLCRNGLRVHQALTLIAPTDRGRLNKFRTNGYNAFIARPARDRTLLRLLLNPQTAENVAPIGEATARTKATNDGRGLKVLLAEDNEINAMLARATLSKAGHSVAVVSNGRAAVDVLTHPARDFDIVLMDLHMPIMDGLDAIIQIRRYEEDTGLAPIPILVLSADGQEKTRQNALAQGATGFITKPLEPGRLLSALEVHTPA

SEQ ID NO: 1538 - protein, 182 aa, Saccharomyces cerevisiae
MSSRKKNILKVIILGDSGVGKTSLMHRYVNDKYSQQYKATIGADFLTKEVTVDGDKVATMQVWDTAGQERFQSLGVAFYRGADCCVLVYDVTNASSFENIKSWRDEFLVHANVNSPETFPFVILGNKIDAEESKKIVSEKSAQELAKSLGDIPLFLTSAKNAINVDTAFEEIARSALQQNQA

SEQ ID NO: 1539 - protein, 275 aa, Kineococcus radiotolerans
MTQATPQVTLHDGVGIPQLGFGVWQVPPEQTAEVVLRALQAGYRHIDTAAGYGNEAGVGDALRASQIPREDVFITTKLANSEHGRDKTLAAFDASMAKLGLDYLDLYLIHWPLQADDYVETWKAFEEIKASGRVRTIGVSNFQKTHLRKLLDETGTVPTVNQVEVHPYLVQEDLRSFHAEHGIATEAWSPLAQRAGLVEDPVVTGIAEQLGRTPAQVVIRWHLQQGNVVIPKSVTPERIVSNIDVFGFELPPEQVDALTGLDRAERTGPDPDVLG

SEQ ID NO: 1540 - protein, 232 aa, Triticum aestivum
MVISHASSSAGEAVYSTFSSRYVREELPRYRMPEGSIPKEAAYQIISDELMLDGNPRLNLASFVTTWMEPECGKLIMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAIEMVDENTICVAAILGSTLTGEYEDVKLLNDLLVEKN

SEQ ID NO: 1541 - protein, 125 aa, Zea mays
  misc_feature (106)..(106): Xaa can be any naturally occurring amino acid
MATSSRAHEAPANNPDLPTEDDPYTTGYFLPPTMLREKDPQESLDYYSRERGMSLLHRLDYEEMTFWVVSYEVTSVRCYCSDDHIKLTVRTIREKATHAIAHYRRXHSDPALKGYYNGNSDPRES

SEQ ID NO: 1542 - protein, 634 aa, Ustilago maydis
MCGILGCIHHPDAPAYRGKMLNMSRCIRHRGPDWSGCVVTQEEGSKGSILCHERLAIVGISTGAQPLVSTDGKLILAVNGEIYNHRQLRKNLKDQNAEFKTESDCEVILHLYREHGSDFVKMLDGMFSFILLDTTTTPHRVIAARDPIGITTLYQGASYKYPGAIYFSSELKAIHEECDRIRSFPPGHFYDSSLPEGKETVRYYTPSWLDGDAEGATIPTNPTDLKQIREALEKAVRKRLMSEVPYGVLLSGGLDSSLIASIAARETDKMADLQRKQWEERQARRSRGLTTPAGDANGAKLPVGLDEDADNEVENLAAWPRLHSFSIGLPGSPDLIAARKAAQFLGTVHHEYTFTVQEGLDAIADVIFHLETYDVTTVRASTPMYLLSRKIKAMGVKMVLSGEGSDEIFGGYLYFHAAPDKTSFHQECVRRVKNLHTADCLRANKSTMAWGLEARVPFLDKAFLDVAMNTDAADKMFSKGSLQQVDADGRPRMEKYILRKAFDVIPDDIEAGGDGSGSMLSASAPRKPYLPEDILWRQKEQFSDGVGYSWIDGIKDHAEKTVSDEKFQERAKRYPNDTPDTKEAYMIREIFESWFPSEAAASTAVRWIPRADWGCAADPSGRAVNIHESAYSTE

SEQ ID NO: 1543 - protein, 570 aa, Unknown
  Malus x domestica
RTLALEECALWMPTRTGLELQLSYTLRQQNPVGYTVPIHLPVVNQVFSSNCAVKISPNSPVARLRQLAGKHIPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTAEQRLMVETILRSSNLLATLINDVLDLSRLEDGSLQLEIATFNLHSVFREVHNMIKPVASIKRLSVTLNIAADLPMYAIGDEKRLMQTILNVVGNAVKFSKEGSISITAFVAKSESLRDFRAPDFFPVQSDNHFYLRVQVKDSGSGINPQDIPKLFTKFAQTQALATRNSGGSGLGLAICKRFVNLMEGHIWIESEGLGKGCTATFIVKLEFPERSNESKLPFAPKLQANHVQTNFPGLKVLVMDDNGVSRSVTKGLLAHLGCDVTAVSLIDELLHVISQEHKVVFMDVSMPGIDGYELAVRIHEKFTKRHERPVLVALTGSIDKTTKENCMRVGVDGVILKPVSVDKMRSVLSELLEHRVLFEAM

SEQ ID NO: 1544 - protein, 319 aa, Oryza sativa
MAAAEVYSPTAAAAAQQQQRGKVAAQAWQAVVGWIGFLLQVLLQILRGTPSCAQLLSFVGFRYPLLSGPADSEQSPSVAFMPLRSEIPADTAPAPTPPPESLQRLTSLAELWMVVLDLDETLVSAYESSSLPAIVRTQAVEAGLHCFDMECISTEKDVEGRNKVNHVTVFERPGLHEFLQKTSEFADLILFTAGLEGYARPLVDRIDVHNRFKLRLYRPSTVTTEYREHVKDLSCVSKDFCRVVIVDNNPFSFILQPLNGIPCVPFSAGQHNDNQLMEVIFPLLKHLSIQRDVRPALYERFHMPEWFQKHGIPQTDQAV

SEQ ID NO: 1545 - protein, 903 aa, Photobacterium profundum
MSAFFTMSRYRDLEHQLISTGSSIIEPLAISSEYGMTDKNREAVRRLISYTHRKNSQIIRSIAVFDANNQLFVTSNFHRNFETLMYPTGQPIPLLLETRLSDNSLILRAPILAEGQFGSNNSNSYQGKALGYIALELDLSALRLQQYQEVFTALMVLLFGLTLSSLFAYRLMQDVTRPISHMVSVVDRIRRGHLDIRIEGQLLGELDTLKNGINAMAISLSEYHIEMQQSIDQATSDLRETLEQLEIQNVELDIAKKRAQEAARVKSEFLANMSHELRTPLNGVIGFTRQMLKTRLSSSQHDYLLTIEKSANNLLTIINDILDFSKLEAGKLLLENIPFDFTESLDEVMRLLAPSAHEKGLELTLKVDDRIPAGLIGDPLRIQQVVTNLIGNAVKFTERGNIDVSVELKASKDESIELQFTVRDTGIGISERQQAQLFQAFSQADASISRRYGGTGLGLVITQKLVTQMGGEISLTSRLHQGSTFWFSLSMLKTDLPVSQPIDTTALVGQKVLLIEPNMQAASIVQQRLIKAGMFVTYRSTMPEEVEHHQFALICLPPGQQPPIAILLDRVFKAEQVTDKVIISLPTTELALSERLINAGVSACLGKPLSHRKLFEVLNNKPDDIFEPELLSLPETAQKIEPLTVMAVDDNPANLKLISALLSERVETVITATGGRKAVEYAHQKAFDLIFMDIQMPEMDGVTACEAIHKTELNHSTPVIAVTAHAMPGERERLINAGMDDYLTKPIEEHILQQILAKWNQPPENEHNQNTIIDLEPDVISTQQHPIQDNKDISWDWDLALKQAAGKEDLAKDMLQMLLDFMPEVEMLVNEALDGKDIELWPPIHKLHGSCAYSGVPRLKSLCYTIETQLKANATVADIEPELFELMDEMNHVVKASKAFRNR

SEQ ID NO: 1546 - protein, 391 aa, Podostemum ceratophyllum
DLEPVNPSDVPASAAGALKSYKLAAKAISKLQSLPSGNIGLLCDVLVKEVTDLTGYDRVMIYKFHEDDHGEVVSEWHAPELEPYLGLHFPATDIPQASRFLFMKNKIRMICDCMAAPVNVVQDAGLTQALNLSGSTLRAPHGCHAQYMANMGSIASLIMSVTINEDDEELEQQQQAGDELWGLVVCHHTVPRFRAVPAAVRCEFLIQVFGIQINKEVEMAAQMHEKRVLETQAVLCDMLLRDSPVAIMTRTPNVMDLVKCDGAALYHEKRFWLLGITPKETQIRHLMTWLNENHRETTGLSTASLLEAGFPDAMALGDAVCGMVAIRVNSKDFLFWFRSHTAKEIKWGGAKHDADEKDEERKMHPRSSFKAFLEVVKWQSLPWEDMEMDAI

SEQ ID NO: 1547 - protein, 395 aa, Quiina pteridophylla
DFEPVKPYEVPMTAAGALQSYKLAAKAITRLQALPSGSMERLCDTMVQEVFELTGYDRVMTYKFHDDDHGEVISEITKPGLEPYLGLHYPATDIPQAARFLFMKNKVRMIVDCRAKHVKVLQDDKLPFDLTLCGSTLRAPHSCHLQYMENMDSIASLVMAVVVNEGNEDSDGPDPVHPQKRKRLWGLVVCHNTTPRFVPFPLRYACEFLAQVFAIHVNKELELENQIVEKNILRTQTLLCDMLMRDAPLGIVTQSPNIMDLVKCDGAALLYKSKIWRLGVTPTDLQLQEIALWLSDYHMDSTGLSTDSLYDAGYPGALALGDVVCGMAAVRITSKDLLFWFRSQTAAEVRWGGAKHEPGEKDDGRRMHPRSSFKAFLEVVKTRSLPWKDVEMDAI

SEQ ID NO: 1548 - protein, 360 aa, Stackhousia minima
DLEPVNPADVPITAAGALKSYKLAAKAITRLQSLPSGNISLLCDVLVKEVSELTGYDRVMVYRFHDDDHGEVVAECCRPDLEPYLGLHYPATEIPQASRFLFMKNKVRMICDCLAPPVKVLQDKRLTQPLSLGGSTLRSPHGCHAQYMVNMGSIASLVISVTINDDEDEANSEQHRGRKLWGLVVCHHTTPRSVPFPLRYACEFLIQIFGVQINKEVELSAQKKEKHILRIQTVLCDMLLRNAPEGILAQSPNVMDLVKCDGAALYYRNDVRLVGITPTEKQIRDIAEWLLEHHSESTGLTTDSLMEAGYADASILGEAVCGMAAVKITSKDFLFWFRSHTAKEMKWGGAKHDPDDKDGG

SEQ ID NO: 1549 - protein, 405 aa, Populus nigra
MGFLCCSGKPSKRLESSSINENNSNIKRKDQTHVTSGSLKMKPYVNNLSKEGESKDDQLSLDVKSLNMKDEISKDRRSNGKQAQTFTFEELAAATSNFRSDCFLGEGGFGKVYKGYLDKINQAVAIKQLDRNGVQGIREFVVEVVTLSLADHPNLVKLIGFCAEGDQRLLVYEYMPLGSLENHLHDIPPNRQPLDWNTRMKIAAGAAKGLEYLHNEMKPPVIYRDLKCSNILLGEGYHPKLSDFGLAKVGPSGDKTHVSTRVMGTYGYCAPDYAMTGQLTFKSDIYSFGVVLLELITGRKAIDQRKERGEQNLVAWARPMFKDRRNFSCMVDPLLQGQYPIRGLYQALAIAAMCVQEQPNMRPAVSDLVMALNYLASHKYDPQVHSVQDSRRSPSRPGLDKDRGQ

SEQ ID NO: 1550 - protein, 95 aa, Pisum sativum
MEGLHETGPPPFLTKTFDVVEDPSTDGIVSWSRARNSFVVWDLSKFSTAILPRYFKHSNFSSFVRQLNTYGFRKVDPDRWEFANEGFLAGQRILL

SEQ ID NO: 1551 - protein, 406 aa, Populus nigra
MGFLCFSGKSSKRSENSSIDENNSNIKRKDQTQLTSGSMKVKPYVNDSREEGASKDDQLSLDVKSLNLKDEISKDIRNNGNPAQTFTFEELVAATDNFRSDCFLGEGGFGKVYKGYLEKINQVVAIKQLDQNGLQGIREFVVEVLTLSLADNPNLVKLIGFCAEGDQRLLVYEYMPLGSLENHLHDIPPNRQPLDWNARMKIAAGAAKGLEYLHNEMAPPVIYRDLKCSNILLGEGYHPKLSDFGLAKVGPSGDHTHVSTRVMGTYGYCAPDYAMTGQLTFKSDVYSFGVVLLELITGRKAIDQTKERSEQNLVAWARPMFKDRRNFSGMVDPFLQGQYPIKGLYQALAIAAMCVQEQPNMRPAVSDVVLALNYLASHKYDPQIHPFKDPRRRPSHPGLDKDNGRT

SEQ ID NO: 1552 - protein, 701 aa, Gluconobacter oxydans
MSTDKRKTVTIGDQTFERGPQGATHQVASGETPTLTTQQGVPVSDDQNTEKAGARGPALLEDFHFREKIFHFDHERIPERVVHARGYGAHGFFELTDSLADYTTASVLGKIGKRVPAFVRFSTVAGGRGSFDVARDVRGFAVKLYTEEGNWDLVGNNMPVFFIQDAIKFPDMVHAVKEEPDSGFPQAQSAHDNFWDFASLSPETVHMLMWIMSDRAIPRSFRFMEGFGVHTFRLVNAEGKSTYVKFHWKPKQGLQSVVWNEAVKINGADPDFHRRDLWESINSGDFPEWELGVQLFDDDFADKFDFDILDATKLIPEELIPVRRIGRLVLNRTVDNFFAETEQVAFCTQNVVPGIAFTNDPLLQGRNFSYLDTQTKRLGGPNFTHIPINAPKCPFHNFQQDGHMAMHNPKGRANYEPNSWGMGPRENPQTGYKPYAEELNGRKTRERGELFADHYSQARQFYTSQTPTEQTHIKNAFVFELSKCLTPAIRARVVAHLLNVDEKLAKGVAEGLRLEKMPAPAPAARTPLTDLPASDPLSILKNGPKTFKGRNLGVLVTDGTDADLLAALMKAAEAEGTIVELVAPAVGGVKTTDGKLVPAGQKIVGAPSVLYDAVVLLPSAAGAKLLTGEATARDFVADAFAHAKFIGYGPDAKPLLAKGGITPEDMDDGIIPLEAPSDLKTFITLCRKLRFWDREARTHAV

SEQ ID NO: 1553 - protein, 236 aa, Cucumis sativus
MGRGKIEIKRIENTTNRQVTFCKRRNGLLKKAYELSVLCDAEVALIVFSTRGRLYEYANNSVRGTIERYKKAFADSSNSGLSVAEANVQFYQQEATKLKRQIREIQNSNRHILGEALSSLPLKELKSLEGRLERGISKVRAKKNETLFAEMEFMQKREMELQSHNNYLRAQIAEHERIQQQQQQQQQTNMMQRATYESVGGQYDDENRSTYGAVGALMDSDSHYAPQDHLTALQLV

SEQ ID NO: 1554 - protein, 149 aa, Oryza sativa
MSLVRRSNVFDPFADFWDPFDGVFRSLVPATSDRDTAAFANARVDWKETPESHVFKADLPGVKKEEVKVEVEEGNVLVISGQRSKEKEDKNDKWHRVERSSGQFMRRFRLPENAKVDQVKASMENGVLTVTVPKAEVKKPEVKAIEISG

SEQ ID NO: 1555 - protein, 248 aa, Arabidopsis thaliana
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 1556 - protein, 1647 aa, Ustilago maydis
MSQPGARRAYHHGSQRGGSTINQKAALASAYQELGKELSSSKLKIVGNYTLQRPIGEGTFGKVRLGLHRLTNTRVAIKQIPKAHSASLTREIHHHRRLHHPNVMQLYEVIATEQYIWMVSELCAGGELYDYLVENQVLAEPEARRIFGQLCLAVAYVHSKGIVHRDLKLENILLDERCNVKLGDFGFTREFERNRLMDTFCGTTGYASPEMLAGKKYTGEQVDIWSLGVILYALLCGALPFDDDDEAVMKQKILQGDFEIPDCLSEEAHDLVVSILQHDPAKRPSIQSILAHPWFTKMMVNSPMSTLEEDQIATDYFASKPSASTSQSKQHDRFPPTLHKALAELDTATELDTADATSAAPPTNPADAFDFEDHDSSNSCHRHHLSASSEQSYHSARSDSESSGRRSTNTDLTDPTTADSLSGTDEVEGLDQAIVQLNASSRPSALANATAAASHPDKNAIGLHRNERLGSNGSDASLSGVPRPSTKTNTASLPTHHELPPVPDGTGQDDHLSIYQSVPLTKRGSQSSSRGHHRTPSRTKRRSLSSGGLSDHHPPMLGRKPVDYVSQLADLQPATFSTSIEQNLLHQLSALGLDVGQMVHSVVTDACDASGATWWMLLRKSKDRHSEQPDITSPIVQVIPAPGDHPAPINASAFSKAGQTVTPSSPAQFSPPPVPVKDPARRSEDKFRTQERPTTLEASSSENAGLAEQSIRRLQTVVSHEELDVSAAPALHTSTSELMMATKPATDRQSSVPASGPMPLAGLPASTVSLPNDRSLTSTPDSVSSRPKSQHRHTTAVASPAKLQHVALTTLEGSPTSEGSKARGNSQNDRPRSNSLSVRQFAQSVLGTKDRGSATSSPVRPPPEQVVVAGEALPLERAKSPTLFGRRNTVSNVKDSMVGRLSGPSTPKKTPVDMLDKPRKSTGKKSCETDLDRVKALERSADSASSSPSRSTTGQAVGVVSNAKVDSSVPSASQDSFSTMSVTPQGSEKSGHRGKAGSFFMSTVRTWLGGNEKPTRKSKTGKQASASHRGLGIDDGPMAAKSPTNSLSTSGSVSTLTYGTPSRSASVRRRSAHYQQTSATRRGGPRSPHLGTSSRRSSNGSSYQAHLELPPNSFQQSMNRPANMRRMSAGSITPTATLHGDYLNDVGGVSGASRHSRPSSSHSLAHSGAASRPGLHGKAGSTGSTSSAYRPGQASSVYSTGSGRRHPRPSQDGGTTVRRHRTYASSSGSPSRRNSFRHDSRPSSIKSRASSPGRAMSGLGELWAADAEADGDGGGTGARRSTRSTPRHSLEMRKTGEAFDSAAPHHQHHQHVVAQSIFVAHKSRSPYRPPSANPNLHGSLVRGSSQLSGRSNVSANSEDAGYVAPNSTLGLPATGTGAWRHSWGRPPPCWAGPVDPPPTSSYSKRSGAAGVEDDGRPKLRDVFANRDDDDWTDEEEEQTYSGGLGQMGTLSSAMSSSVGRVGSGIGASSSPYATRNLAALGSSGYSTQRAVNLDTANAPEIGLREAPFSSRYAGVRNMFQTATAGTPAFGSRSHHSVSLSLGNEFAPRLLSTTIHSPTVSAASLGGGLGCIGESADAHSVTVSSKPKPESSGTQTQAQQQQSSASASASASASQQQQSGGGSSGSGSRITASFHKPVQIIEEEEEDE

SEQ ID NO: 1557 - protein, 221 aa, Glycine max
MGQKSLIYAFVSRGTVILAEYTEFSGNFNSIAFQCLQKLPATNNKFTYNCDAHTFNYLVDNGYTYCVVADESIGRQLPMAFLERVKDEFVAKYGGGKAATAPVNSLNKEFGPKLREHMQYCVDHPEEISKLAKVKAQVSEVKGVMMENIEKVLDRGDKIELLVDKTENLHNQAQDFRTSGTRIRRKMWLQNMKIKLIVLGILIALILIIVLSVCRGFNCGK

SEQ ID NO: 1558 - protein, 370 aa, Pseudomonas aeruginosa
MSAPVEALFQPFRLGALELPTRVVMAPMTRNFSPGGVPNAKVVEYYRRRAAAGVGLIVSEGTTVGHKAANGYPNVPRFYGEDALAGWKQVVDAVHAEGGRIVPQLWHVGSVRRLGVEPDASVPGYGPMEKAKDGKVLVHGMSKADIQEVIAAFAQAARDAQAIGMDGVEIHGAHGYLIDQFFWEGSNQRDDEYGGSLANRSRFAVELVRAVRAAVGADFPIIFRFSQWKQQDYSARLVETPEGLREFLAPLVEAGVDIFHCSTRRFWIPEFEGSELNLAGWTRELTGKPTITVGNVGLDGSEFLQFFGKTDEVAQPASIDGLVERLDKGEFDLVAVGRALLVDPEWAVKVREGRIGDIKPFSREALASLV

SEQ ID NO: 1559 - protein, 578 aa, Arabidopsis thaliana
MCGILAVLGCIDNSQAKRSRIIELSRRLRHRGPDWSGLHCYEDCYLAHERLAIIDPTSGDQPLYNEDKTVAVTVNGEIYNHKILREKLKSHQFRTGSDCEVIAHLYEEHGEEFIDMLDGMFAFVLLDTRDKSFIAARDAIGITPLYIGWGLDGSVWFASEMKALSDDCEQFMSFPPGHIYSSKQGGLRRWYNPPWYNEQVPSTPYDPLVLRNAFEKAVIKRLMTDVPFGVLLSGGLDSSLVAAVALRHLEKSEAARQWGSQLHTFCIGLQGSPDLKAGREVADYLGTRHHEFQFTVQDGIDAIEEVIYHIETYDVTTIRASTPMFLMSRKIKSLGVKMVLSGEGSDEILGGYLYFHKAPNKKEFHEETCRKIKALHQFDCLRANKSTSAWGVEARVPFLDKEFLNVAMSIDPEWKLIKPDLGRIEKWVLRNAFDDEERPYLPKHILYRQKEQFSDGVGYSWIDGLKDHANKHVSDTMLSNASFVFPDNTPLTKEAYYYRTIFEKFFPKSAARATVPGGPSIACSTAKAVEWDATWSKNLDPSGRAALGVHVAAYEEDKAAAAAKAGSDLVDPLPKNGT

SEQ ID NO: 1560 - protein, 414 aa, Anabaena variabilis
MSYYIAPRFLDKLAVHITKNFLNIPGVRVPLILGIHGRKGEGKTFQCELAFEKMGIEVTLISGGELESPDAGDPARLIRLRYRETAELIKVRGKMCVLMINDLDAGAGRFDEGTQYTVNTQLVNATLMNIADNPTDVQLPGSYDSNPIRRVPIIVTGNDFSTLYAPLIRDGRMEKFYWEPNRDDKVGIVGGIFAEDGLSKREIEQLVDTFPKQSIDFFSALRSRIYDEQIRDFIHQVGFERISLRVVNSVEAPPEFKKPDFSLAHLIESGNLVLGEQQRVDNSQLVDEYNRLNRGRGYQAAPPPEAPMIQPVNNSSHKRETSNTHLSLETQEQIRQILSQGHKITFEHVDARRFRTGSWQSCGTLHIDAESDAISTLEACLVDYEGEYVRLVGIDPKGKRRVVETIIQRPNDKN

SEQ ID NO: 1561 - protein, 150 aa, Unknown
  Bradyrhizobium sp. BTAi1
MRYLHTMLRVRNLDAALKFYSDALGLKEVRRIDNDKGRFTLVFLCAPEDEHLLKSLPPTRGAPLVELTYNWDEESYGEDRFFGHLAYEVDDIYATCDRLMKLGITINRPPRDGNMAFVRSPDLHSIELLQKGEPKAPAEPWLSMPNTGHW

SEQ ID NO: 1562 - protein, 214 aa, Solibacter usitatus
MIHEILPVGMLQCNCSIFGDEGTREAIVVDPGDEIESILAIVTRHGLTVKAIVITHAHIDHIAGAQQLKKATGAPVYMNQNDTELQRMLDVQATWLGMPTPQAVEIDVAAKDGDTLLLGSTELHVLHTPGHTQGSICLWMPGEGKLVAGDTLFRESIGRTDLPGGDGRQILQSIHDKLLPLPGETEVIPGHGDLTTLAHERQFNYFLKGMRQPQ

SEQ ID NO: 1563 - protein, 351 aa, Pneumocystis carinii
MTASSRNVRFNVSDDYEILDVIGEGAYGIVCSAIHKPSGQKVAIKKISPFDHSMFCLRTLREMKLLRYFNHENIISILDIQQPQDFESFSEVYLIQELMETDMHRVIRTQDLSDDHCQYFIYQILRALKAMHSADILHRDLKPSNLLLNANCDLKVCDFGLARSAVSTEDSSSFMTEYVATRWYRAPEIMLTFKEYTKAIDIWSVGCILAEMLSGRPLFPGKDYHHQLMLILDVLGTPTMEDYYGIKSRRAREYIRSLPFKKRVSFASIFPRANPLALDLLEKLLAFNPAKRVTAEEALQHNYLEPYHDPDDEPTAPPISPSFFDFDRIKDSLTKNDLKILIYKEIMSMNN

SEQ ID NO: 1564 - protein, 277 aa, Prochlorothrix hollandica
MTVATAEKRPLEWTTILFILGLHLGALCVLFPSNFSWYAVALALFMHWFTGCLGITLGWHRLISHRSFQVPKWLEYFFVFCGSLSCQSGPIEWIGLHRHHHAYSDQEEDHHNSNKGFWWSHMNWMWVDVPARKQLPRFTRDIASDPVYLFFDKYFIPLQFAVGIIFFIASDAIVGNGWSFVVWGVFLRIVLLYHCTWFVNSATHKFGYRTHETTDNSRNCWWVALLTYGEGWHNNHHAFQYSARHGWQWWEIDITWLTIRLLERLGLATKVKLISEA

SEQ ID NO: 1565 - protein, 728 aa, Rhodobacter sphaeroides
MNVTSKPGELVPESDVAAIMRGTHGDPFRVLGMHGGGGAPLSVRVFAPQAAEVAVLGQGGEVLAPLERIGAEGFFAGTVPGEEKFPYRLRFVSGPHEWEADDPYRFPEVLGELDEYLLGEGRHYQLYTRLGAHPAEIEGVQGVSFAVWAPNARRVSVVGAFNAWDGRRHPMRKRIGVGVWELFVPGLHTGDLYKYELLGPSGERLPLKSDPLSFAQEAPPATASVVHGLPEAEWHDAGWMQERESRQRRDAPISIYEVHAGSWRQGLDYDALAEELSAYVREMGFTHVEFLPISEHPFTGSWGYQPIGLFAPTARFGPPEGFARLVDRLHRDGIGVILDWVPAHFPSDAHGLANFDGTHLYDHADPRQGFHRDWNTQIYNFGRQEVANFLQASALFWLDRYHVDALRVDAVASMLYLDYSRNAGEWVPNRHGGRENLEAIDFLRGVNERVRLDHPGCITIAEESTAFPQVSRPVEDGGLGFGFKWNMGWMHDTLGYFRRDPIHRKHHQNDLTFGMVYAYSEDFVLPLSHDEVVHGKGSLIGQMAGDRWQKFANLRAYFGFMWAHPGKKLLFMGGEFAQEREWNHDASLDWHLLDDPSHAGMKRLVADLNREYRKRPALHRMDCDPEGFEWIDAGDSENSVLSFLRKAPGEKPVLAVCNLTPVVRSDYRIGVPEGGEWREILNSDAAIYGGSDVGNPGGLQAEEFSWHGRPASLRLTLPPLATIFVTPA

SEQ ID NO: 1566 - protein, 429 aa, Mycobacterium bovis
MDNDGTIVDVTTHQLPWHTASHQRQRAFAQSAKLQDVLYEIRGPVHQHAARLEAEGHRILKLNIGNPAPFGFEAPDVIMRDIIQALPYAQGYSDSQGILSARRAVVTRYELVPGFPRFDVDDVYLGNGVSELITMTLQALLDNGDQVLIPSPDYPLWTASTSLAGGTPVHYLCDETQGWQPDIADLESKITERTKALVVINPNNPTGAVYSCEILTQMVDLARKHQLLLLADEIYDKILYDDAKHISLASIAPDMLCLTFNGLSKAYRVAGYRAGWLAITGPKEHASSFIEGIGLLANMRLCPNVPAQHAIQVALGGHQSIEDLVLPGGRLLEQRDIAWTKLNEIPGVSCVKPAGALYAFPRLDPEVYDIDDDEQLVLDLLLSEKILVTQGTGFNWPAPDHLRLVTLPWSRDLAAAIERLGNFLVSYRQ

SEQ ID NO: 1567 - protein, 202 aa, Sinorhizobium meliloti
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEF

SEQ ID NO: 1568 - protein, 592 aa, Rhodobacter sphaeroides
MNDWAWGPRIEDGLGRFRLWAPSQERLVLRLDGTDHPMTRSDDAWFEVQVPAEAGMDYGFVLESGQVVPDPAARAQAGDVHGLSRLVAPSFDWRHDWTGRPWAETVVMELHIGTFTEEGTFRAAIEHLPHLAEIGITMIELMPVAQFGGNRGWGYDGVLLYAPHPAYGTPEDLKALVDAAHGLGMSVVLDVVYNHFGPDGNYLGAYAADFFDPERHTPWGSAIAYHLPPVRRFFLDNALYWLTEFRFDGLRIDAADHIRDPDSDPEVLVDLARAIRKRIPDRPIHLTTEDNRNITRLHERGPEGEVVLHTAEWNDDLHNVAHVLLTGETEGYYCDFVKDHWRKYARALAEGFVYQGEHSEHEGAPRGTPSGHLPPLAFVDFLQNHDQIGNRAFGERLTTLAPEARLRAMMAVLLLSPHVPLLFMGEEWGETRPFTFFTDFHGELADAVRNGRRKEFAHFSAFQGLDLDRTVPDPNAEGTFLSSKLDWLHRETERGRSWMAFVKDLLAARAREIAPRLERAPGNGGRIVAVSDDLVAVDWQLDGAVLRLRVNFDDRPQDLPEAGGRVIHASPGTEAGGPLPPCSVLVTLEETA

SEQ ID NO: 1569 - protein, 705 aa, Ajellomyces capsulatus
MPSGQKGPLDRRHDTLSDPTDQFLSKFYIDDEQSVLTTDVGGPIEDQHSLKAGNRGPTLLEDFIFRQKIQHFDHERVPERAVHARGAGAHGVFTSYNNWSNITAASFLNAAGKQTPVFVRFSTVAGSRGSVDSARDIHGFATRLYTDEGNFDIVGNNVPVFFIQDAIQFPDLIHAVKPQPDSEIPQAATAHDTAWDFLSQQPSSLHALFWAMSGHGIPRSMRHVDGWGVHTFRLVTDEGNSTLVKFRWKTLQGRAGLVWEEAQALGGKNPDFHRQDLWDAIESGRYPEWELGFQLVNEADQSKFDFDLLDPTKIIPEELVPFTPIGKMVLNRNPKSYFAETEQIMFQPGHVVRGIDFTDDPLLQGRLYSYLDTQLNRHGGPNFEQLPINRPRIPFHNNNRDGAGQMFIPLNTAAYTPNSMSNGFPQQANRTHNRGFFTAPGRMVNGPLVRELSPSFNDVWSQPRLFYNSLTVFEKQFLVNAMRFENSHVRSETVRKNVIIQLNRVDNDLARRVALAIGVEPPSPDPTFYHNKATVPIGTFGTNLLRLDGLKIALLTRDDGSFTIAEQLRAAFNSANNKVDIVLVGSSLDPQRGVNMTYSGADGSIFDAVIVVGGLLTSASTQYPRGRPLRIITDAYAYGKPVGAVGDGSNEALRDVLMAAGGDASNGLDQPGVYISNDVSEAYVRSVLDGLTAYRFLNRFPLDRS

SEQ ID NO: 1570 - protein, 203 aa, Thermoanaerobacter tengcongensis
MKILVTAFDPFGGESVNPSYEVLKNLKDNIEGAEIIKLQVPTAFYVSVEKAIEKIKEVNPDAVLSIGQAGGRYDISVERVAINIDDARIPDNMGQQPIDIPIDPEGPPAYFATIPIKEIVEAIKKENLPASVSNSAGTYVCNHLMYGILNYIHKNKLNIKAGFIHIPYLPEQVLEKPNTPYMSLSDMVKAIETAIKVIVKAMA

SEQ ID NO: 1571 - protein, 548 aa, Buchnera aphidicola
MGAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMDLEKSTLEDLGQAKRVVINKDTTTIIGGSGEKQAIQSRIGQIRQEIQEATSDYDKEKLNERLAKLSGGVAVLKVGAATEVEMKEKKARVEDALHATRAAVEEGVVAGGGVALVRVAGKISNLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPREDKSSDVASSPAGGMGGMGGMM

SEQ ID NO: 1572 - protein, 565 aa, Zea mays
  misc_feature (50)..(50): Xaa can be any naturally occurring amino acid
  misc_feature (221)..(221): Xaa can be any naturally occurring amino acid
MSPFLAVVMNHAAPHPGLRSHLVRPNNDSFSRHHLPTSSPQSSNGMSKLXFTTRSGTVSRQYGDQMMIPSQIPQREWFPSDFTFVAVTSLYQMECAWNEHGKGESNWDHFCHNHPERILDGSNSDIGANSYHMYKTDVRLLKEMGMDAYRFSISWPRILPKGTKEGGINPDGIKYYRNLINLLLENGIEPYVTIFHWDVPQALEEKYGGFLDKSHKSIVEXYTYFAKVCFDNFGDKVKNWLTFNEPQTFTSFSYGTGVFAPGRCSPGLDCAYPTGNSLVEPYTAGHNILLAHAEAVDLYNKHYKRDDTRIGLAFDVMGRVPYGTSFLDEQAKERSMDINLGWFLEPVVRGDYPFSMRSLARERLPFFSDKQQEKLVGSYNMLGINYYTSIFSKHIDISPKYSPVLNTDDAYASQETNGPDGNPIGPWMGNPWIYMYPDGLKDLLMIMKNKYGNPPIYITENGMGDVDHGDLPMEVALDDHKRVHYLQRHIATLKESRDLGANVQGYFAWSLLDNFEWFSGYTERYGIVYVDRNDGCKRYMKRSAKWFKEFNAAKKAAAKKILTPA

SEQ ID NO: 1573 - protein, 255 aa, Zea mays
MISPDAARNVVGIIGNVISFGLFLSPVLTFWRIYKAKDVEEFKPDPYLATLLNCMLWVFYGIPVVHPNSILVVTINGIGLVIEAVYLTIFFLYSDSQKRKKAFAILAVEILFMVAVVLGVILGAHTHEKRSMIVGILCVIFGSMMYASPLTIMSRVIKTKSVEYMPFLLSLVSFLNGCCWTAYALIRFDLYVTIPNALGAFFGLIGHRRVPGRLPPRHRLRQRQADAVRQLHRLQAPRQRVETVARSTHGHASAC

SEQ ID NO: 1574 - protein, 497 aa, Rubrivivax gelatinosus
MDKASGKTLDAALVWCRRDLRAHDHAALYHALRAARRVWVAFVFDTEILDPLPRTDRRVEFIRDSLVDLDAQLHTLGRSHGTEGVGLIVRHGRARDEIPRLAAALHVQAVYANTDYEPAAVARDAQVRGALAQTGIAFHPAKDQVVFDTDEVLTGAGTPYGVFTPYKNAWLKKLEPFYLQAYPVGRHAGALAPRPAGEAAGVPTLAAIGFEPTNLAALKLAPGTAGGRALLEDFGDERIDRYDQTRDFPAVKGPSYLSVHLRFGTLSIRELARLAWDRARAGSRGAEVWLSELIWRDFYHQVLHHHPQVVERSFKPEYDKIKWEHGKHADALFAAWCEGRTGYPLVDAAMLQINQTGYMHNRLRMVVASFLCKDLGLDWRRGERYFAEKLNDYDLAANNGGWQWASSSGCDAQPYFRIFNPVSQSQKFDAQGKFIRRYLPQLAALPDAALHAPWDAKPLDLVAAGLVLGRDYPEPIVRHELARERTLARYAVVKGAR

SEQ ID NO: 1575 - protein, 163 aa, Cucurbita pepo
HWKPTCGVKSMMEEEAIRIGGTNHSHATQDLYESIAAGNFPEWRLYIQTIDYEDQNKYDFEPLDTTITWPEDVVPLQPVGRLVLNKNIDNFFAENEMLAFSMSLVPGIHYSDDKMLQARSFAYADTQRHRLGPNYLQLPVNAPKCPHHNNHHEGFMNFMHRDE

SEQ ID NO: 1576 - protein, 474 aa, Arabidopsis thaliana
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSQGLRQYNLDNMMDGFYIAPAFMDKLVVHITKNFLTLPNIKVPLILGIWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYNKEENARVPIICTGNDFSTLYAPLIRDGRMEKFYWAPTREDRIGVCKGIFRTDKIKDEDIVTLVDQFPDQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKGAQQVNLPVPEGCTDPVAENFDPTARSDDGTCVYNF

SEQ ID NO: 1577 - protein, 765 aa, Unknown
  Nostoc sp. PCC 7120
MRIDVESQNINVTSLKEAPIHLSGQIQPHGVLLVLEEPGLKILQVSNNTWGILGINAENILQKKLEDLLDSFQIERIQSGLSSGNLEFINPTKIWIRKKGDDYAVFDAVFHRNTEGFLILELEPAITQENIPFLSFYHLAKASINQLQKTANLRDFCQIIVQEVRKVTDFDRVMLYKFDDDGHGSVIAEEKLDSLEPYLGLHYPESDIPKPARKLFISNSIRVIPNAQAQAIQMIPALNPVSDRPVDLTNSILRSAANCHLEYLHNMGVGASLTISLIKDNKLWGLIACHHLSAKYVSYELRKACEFLGRVIFAEISAREETEDYDYRMNLTHIQSLLVEYMSQEDNFVDGLIKHQPSLLDLTSAQGAAVCFGDHCTLIGETPKAEDLVFLVQWLKNNVEEEVFYTDSLPQVYPDAERYKNVASGLLAIPISQRNYVLWFRPEVIQTVNWGGDPNQPFEVNKLDGNVRLCPRKSFELWKETVRLTSLPWRYVEIRAALELRKAIVNIVLRQADELAQLAHDLERSNAELKKFAYVASHDLQEPLNQVANYVQLLEMRYQDQLDADANEFITFAVEGVSLMQTLIDDVLAYSKVDTQAIAFQLTEVEKALDKALGNLRQRIAETGANITHDPLPTVMAGSTQLMQLFQNLIANAIKFRSEEAPQIHIGAERLEDEWLFSVRDNGIGIDPQFSDRIFVIFQRLHTRDEYHGTGMGLAICKKIIECHRGRIWVESQLGEGATFYFTIPVGGRERERRNGRKTQNNLFS

SEQ ID NO: 1578 - protein, 1817 aa, Unknown
  Nostoc sp. PCC 7120
MNRQHKHHRCNSVNLLSKQNLLPFLLGIVILLVVVMLWLRLQAEEEIKIQQLIKQQAIATQTELVTQLNTRILALKRIGKHWEMHGNIPQAQWELEAKAYLEDYGGYQAIKLVDPSWQVLRAVSVANNKAAENLEMIPKFPQWTGATSHETTVTRTVNLNQGDRVFFACVPLWMGDKFGGAVLGVFQVKQLFESVLHIAPGYKIRVFDGQELIYDQDRQSSTLPLWQQAVNIDFYGMTWQLQIYPTPELLKDLFSPLPTVVLVAGIFNAGAVTLLIYFAQATKLSNHKIGRINQELADRIEKQTQVEIALRASETRLRELVETVRVIPWEFDLKTQHFTYVGPQVETLLAYPVAQWYEENFWDNHLHTLDRDWAVRFCQEAANKGQNHELEYRMLAADGRVVWLRDVVNVVQVDGTPVMLRGFMFDITDLKRVEETLRLRERALAASSNGIVISDAKLPHYPVIYVNSAFEQITGYKATEVVGRNCRFLLGNDTQQSAIEELRSALKAGKNCKVILRNYRKDGSLFWNQLSVSPIYNDNGQLSHFIGIQTDISDRQQAEASLRRQALTFENIYDGVIITNLQGQILDWNPAAERMFGYSKNHICGQSISTLHKVDEDAALNSAIIAEITKQGRWSGEINFVRQDGSQGICETTIVALQDDQGQSMATISVNRDITERKHAELLLRRSEERFQAFMNHSPTPAWITDIDGTIVYVSETYRRTFQLPTQELIGKNIVDIYPPELTQTFRETIQIVARTRQVMETVESAPCSDGTGRDFLVYKFPISSKPDECLIGCIAIDITERKQAEAALRKSEERWQLVIEGNQDAIWDWNIITNETFRSARWAELIKEQNYQPIADHADCVSRIHPDDYERVMAVKQDCLSRKIPNYVVEYRLRCNDDSYRWVLVHATGQWDEQGNPVRMVGSIKDITERIEAQEALQRQLHRTLLLEKITQKIRQSLDSKEIFETAATQIGQALAVDRCLIHSYISHHDPHIPLVAEYNNVLDYCSMQKWEFTTTGNQHILKMMSQDKAIASANVYTDPLLQTAVPSCCEIGVKSMLAVRTSYQGEPSGAICLHQCGYFRQWTNEEIELLEAVAAQLGIALAQAQLLEQETRQREELTIKNFALEQAKRAAEAANRAKSEFLAMMSHEIRTPMNAVIGMTGLLLDTELTSQQRDFVETVLTSGDALLSIINDILDFSKIESGKLELEEQPFEVRTCVEQVIDLLAAKAAQKDIELAYLIHPQVPMQIAGDLTRLRQILTNLLNNAIKFTPEGEVVVSVRSQPSPNQKNKNCCEIIFTIKDTGIGIAPETMDLLFQPFVQADASMTRKYGGTGLGLVISKRLGEMMGGYLWVESRGCVGGNPPPGWQTKNSISSASVATGSTFYFSMTVPVVAHADLETPITSPVQLSGKRLLIVDDNPTNRQILRLQAEPWQMETYTAPSGAEALALIDQGMAFDIAILDVQMPEMDGLTLARQIRQRPSYQHLPLVILTSWGQPDTDLSDIEFAACLNKPIKQSQLYDVLASTLGNQPIRASVVPDRSTEINSCLAQQIPLRILLAEDIVVNQKVALLILKKMGYRADVVANGLEVLEALQRQFYDVVLMDVNMPEMDGLKASQIICQTWSPSSRPYIIAMTANAMRGDREACLAAGMDHYISKPLQLEELAKALGKCHPSGSAIEKALEKTSSQNQTFTDISDLKFATIDTKILQALRDMLGGDKVAFAELINCYLTESPKLIQNIDVAINTKDTQGIWKTAHKFKSSSGSVGAVFLAQLCKLLETKGRNNNLEGCVELGSQLRQEYELVQTALHREVNKETS

SEQ ID NO: 1579 - protein, 192 aa, Saxegothaea conspicua
DEHGEVISEIRKSDLEPYLGLHYPATDIPQASKFLFMKNRVRMICDYHAPPVGVVEDNRLPRELNLCGSTLSAPHGCHEQYMSNMGSIASFVIIDIVNEKDEEEGDSEGQHQQKGRRLWGLVVCHHSSPRFVPFPLRYACEFLMQVFGIQLNKEVELAAQVREKHILCTQTLLCDMLLRDAPTGIVTQKPNI

SEQ ID NO: 1580 - protein, 813 aa, Kluyveromyces lactis
MKTVLLPLKIKDTESISWTKGLITYLKRSYGSSQWSVFYDGDKTAEIDSCRTTANSDLAPESLLDQNYKYAAILEQIYLRLGAHSGSLQMDFTWYEAEYHSRLSEKKFKQHTVVFEKSSVMYNIGVLLSQIAKKKMSDNYKSAIPYLSKAMACFDYMSNNFLNSPSIDCAAENTSFLSTLLHAEAQEMFLMTLINGPDASKRASLISKLAHTALNLYEKCQEFYEDSSTATFGTTPYGEDKWKDIITLKVHLYRAISTYNHLRVLEEAKKIGEAIAYGKLAVHEIKEAGFYKVYVKDEIDLTGLKAVIEEKLKSLIKDNDFIYNDLIPADVSIESIKTMDAVKPVTWEEQLKVYLEQVVDLCNGAFKGIVPMEVYENESIYSEEKASLLRKEVEETDTADWEYQSFIEFTDLPKLIKDLESRYVHGGNGSSDDPQYEIMKQKITTWSKVVQDSNFKDVRAQMQNILDKRNEILTILSSVSPDQRENALKIKNSLVQASQSDDKIFASINPCLEEVNLLANHQLLWSIMSKFQIRNDEPSLLDLDDSKNQQILDRLHNIKHNQEILRLLKEERTRNLKDFKESLNNDDITQKLILLTGKPKKEMRVIFEEELTKFKPLSTRIEATIFKQNNLINDIKIKLDEVFKLIGVQDKTPEQENTVKERQTFFDKVEKAFNQFVIFSTDLPKGLNFYDTLLKMTRELSHASTPGQSVNLIDSNTLPPNLPQKSTQSTTLTKSFANLNLCNDVNDSVTQSPANLANTNNTGVNPGPPQLPPKPLSTGISGLVSDQKLQNGPTSFYNNPSVFDENLYSKFSK

SEQ ID NO: 1581 - protein, 484 aa, Capsicum annuum
SSAFNSPFCTTNSGAPVWNNNSSLTVGARGPVLLEDYHLVEKLANFDRERIAERVVHARGASAKGFFEVTHDITHLTCADFLRAPGVQTPVIVRFSTVIHERGSPETLRDPRGFAVKFYTREGNFDLVGNNFPVFFIRDGMKFPDMVHSLKPNPKSHIQENWRVLDFFSHHPESLHMFTFLFDDIGIPQDYRHMDGSGVHTFTLINKAGKSTYVKFHWRPTCGVKSLLEEEAIRVGGANHSHATQDLYDSIAAGNYPEWKLFIQTMDPAHEDRFDFDPLDVTKTWPEDIFPLQPLGRLVLNKNIDNFFNENEQLAFCPSIVVPGVYYSDDKMLQTRIFSYSDTQRYRLGPNYLQLPANAPKCAHHNNHYDGSMNFMHRDEEIDYFPSRYDPVRHAENYPIPTTVCSGKREKCIIQKENNFQQPGERYRSFSADRQERFIRRWVEALSDPRITYEIRSIWISYWSQADKSLGQKLASRLNVRPSI

SEQ ID NO: 1582 - protein, 492 aa, Capsicum annuum
MDPYKHRPSSAANSPYWTTNSGAPVYNNNSSLTVGARGPILLEDYHLLEKLANFDRERIPERVVHARGASAKGFFEVTHDITRLTCADFLRAPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGSGVNTYTLINKAGKAHYVKFHWKPTCGVKCLLDDEAVKVGGTNHSHATQDLYDSIAAGNYPKWKLFIQTIDPDHEDKFDFDPLDVTKIWPEDILPLQPVGRLVLNKNIDNFFVENEQLAFCPAIIVPGIHYSDDKLLQTRVFSYADTQRHRLGPNYLQLPPNAPKCAHHNNHHEGFMNFMHRDEEVNYFPSRFDPCRHAEQYPIPPRVLNGKRDRCIIQKENNFKQPGERYRSWAPDRQERFICRWVDALSEPRVTHEIRTIWLSYWSQADKSLGQKLASRLNVKPTM

SEQ ID NO: 1583 - protein, 482 aa, Panicum miliaceum
MAATVAVENLNPKVLKCEYAVRGEIVIHAQHLQQQLQTQPGSLPFDEILYCNIGNPQSLGQQPVTFFREVLALCDHPCLLEKEETKSLFSADAISRAKQILSTIPGRATGAYSHSQGIKGLRDAIAAGIASRDGFPANADDIFVTDGASPGVHMMMQLLIRNEKDGILCPIPQYPLYSASIALHGGTLVPYYLDEKTGWGLEISDLKKQLEDARSKGIDVRALVVINPGNPTGQVLAEDNQCDIVRFCKNEGLVLLADEVYQENIYVDDKKFNSFKKIARSVGYGEDDLPLVSFQSVSKGYYGECGKRGGYMEITGFSAPVREQIYKIASVNLCSNITGQILASLVMNPPKVGDESYAAYKAEKDGILQSLARRAKALEDAFNNLEGISCNKAEGAMYLFPQIHLPKKAIEAAKAANKAPDAFYALRLLESTGIVVVPGSGFGQVPGTWHIRCTILPQEDKIPAVITRFKAFHEAFMAEYRD

SEQ ID NO: 1584 - protein, 125 aa, Cicer arietinum
PKCAHHNNHHEGFMNFIHRDEEVNYFPSRHDPVRHAERFPTPPAALSGKRERCIRPKENNFKQPGERYRTWAPDRQDRFARRWIEALSDPRVTHEVRSIWISYWSQADRSLGQKIASHLNMRPSI

SEQ ID NO: 1585 - protein, 497 aa, Zea mays
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDSVVAKKSVLEIEREVAARWRNAVNKKKTGVC

SEQ ID NO: 1586 - protein, 205 aa, Kluyveromyces lactis
MDTETEAEKQERHNNYLNELAEQDRWLPINNVARLMKNTLPATTKVSKDAKECMQECVSEFISFVTSEACDRCTSGKRKTINGEDILLSLHALGFENYAEVLKIYLAKYRQQQAIKNQMMYPKEDVEGSYTEEESRAEDADHVTQERQQPLHPVPSSASTTTSTEVSASEHVQSSSKSTHNPAQAQPRIVVQQPLGSRHSTADHL

SEQ ID NO: 1587 - protein, 195 aa, Saxegothaea conspicua
DDHGEVISEIRRNDLEPYLGLHYPATDIPQASRFLFMKNKIRMICDACASPVRVIEDNRLSKDLSLVGSTLRAPHDCHAQYMYNMNSVASLVMAVVVNEREEEERDSDGRLQPQEAIRRLWGLVVCHHSSPRFVPFHLRYACEFLMQVFGIQLNKEVELAAQVREKRILRTQTMLCDMLLRGDVPKGIVTTKPNI

SEQ ID NO: 1588 - protein, 215 aa, Corynebacterium diphtheriae
MISVDTMTNASSTEGISLHHISVSDLDNNCYLLTTESDEGTQGLLIDAADNAPALLDLAESAGARITAVVTTHRHFDHVRALEDVLDTTKATHFASLGDSPRLPRSADTTLGEGDTLRWAGHNLRAHILRGHTQEGLALSIKIDGIYHLFVGDSLFPRGVGKTSTPEEFNQLLSDVKTRLFDVYPDTAVVHPGHGKPTTLGTERPHLEQWRQRGW

SEQ ID NO: 1589 - protein, 188 aa, Stangeria eriopus
DEHGEVVAEIRRSDLEPYLGLHYPATDIPQASRFLFMQNRVRMICDCRAKPVRVIQAAKLRQPLCLVGSTLRAPHGCHAQYMVNMGSIASLVMAVVINVNDDAAGSGRGSSMKLWGLVVCHHTSPRAVPFPVRCACEFLMQAFGLQVNMELQLAAQLTEKHILKTQTLLCDMLLRDAPIGIVTQTPSV

SEQ ID NO: 1590 - protein, 262 aa, Bacillus cereus
MPMIGLGVYKAKEGDEVKRAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKVKPMVNQVELHPMLTQFELRNFCQGEQIQMEAWSPLMRGGEVFQHPIIQAIATKYEKTSAQVILRWDIQSGVVTIPKSVTPSRIQENFSIFDFSLTEEEMTQINTLNRNLHVGTNPDKYDTL

SEQ ID NO: 1591 - protein, 196 aa, Pyrococcus furiosus
MIYRIKDGFVNVYIIDRGDHLVLIDTGIEGTCEKILSKIKELKKPLKTIIITHHHLDHTGSLKCVKDATGAKVVAHEEEVEVIEERTRVKVDVPVKDGDVIEGLKVFHMPGHTKGSICLLDEESGALFVGDIMIERDGKLYEVPHRYSEDPMMNRERIKDILNIEFKSIYPAHGEPVLENARKKVKELVEALEREK

SEQ ID NO: 1592 - protein, 429 aa, Arabidopsis thaliana
MESLPQPQNQSSPATTPAKILLGKYELGRRLGSGSFAKVHLARSIESDELVAVKIIEKKKTIESGMEPRIIREIDAMRRLRHHPNILKIHEVMATKSKIYLVMELASGGELFSKVLRRGRLPESTARRYFQQLASALRFSHQDGVAHRDVKPQNLLLDEQGNLKVSDFGLSALPEHLQNGLLHTACGTPAYTAPEVISRRGYDGAKADAWSCGVILFVLLVGDVPFDDSNIAAMYRKIHRRDYRFPSWISKQAKSIIYQMLDPNPVTRMSIETVMKTNWFKKSLETSEFHRNVFDSEVEMKSSVNSITAFDLISLSSGLDLSGLFEAKKKKERRFTAKVSGVEVEEKAKMIGEKLGYVVKKKMMKKEGEVKVVGLGRGRTVIVVEAVELTVDVVVVEVKVVEGEEDDSRWSDLITELEDIVLSWHNDIM

SEQ ID NO: 1593 - protein, 188 aa, Polypodium vulgare
DEHGEVVAEIRRADLEPYMGLHYPATDIPQAARFLFMKNRVRMICDCTLPPVKIIQDKNLAQPLSLTGSTLRAPHGCHAQYMSNMNSIASLVMAVIVNDSDIDSAGHASQGMKLWGLVVCHHTSPRYVPFPVRSACEFLMQVFSLQLNMEVGMAAQVREKHILRTQTLLCDMLLRDAPIGIVSQSPNI

SEQ ID NO: 1594 - protein, 165 aa, Glycine max
  misc_feature (118)..(118): Xaa can be any naturally occurring amino acid
LRGRGLRVRTAHASAHASADAWEKSQYAVRGELYLRASELQKEGKKIIFTNVGNPHALGQKPLSFPRQVVALCQAPFLLDDPNVGLLFPADAIARAKHYLSLTSGGLGAYSDSRGLPXVRKEVAEFILRRDGYPTDPELIYLTDGASKGVMQILNTIIRGQDDGI

SEQ ID NO: 1595 - protein, 332 aa, Shigella flexneri
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 1596 - protein, 486 aa, Listeria innocua
MTEVKKQFPKGFLWGGATAANQVEGAYDVDGKGLSTADMVKFIPKEERTKDHALDVSKAEIEAIIAGKVEGRFPKREGVDFYHRYKEDIALFAEMGFKTFRLSLNWARIFPNGDDKEPNEKGLEFYDKVFDELLKYDIEPLVTLSHYETPLNLTLKYNGWADRRVIGFFTNYAETVFKRYKNKVKYWLTFNEINVISLSAYTGGGVLLEDAKNPLELSYQAGHHQFVASALATKLAHEIIPGSQVGCMLARMATYPATNNPDDILKAQYENQQNLFFTDVHARGEYPSYMNRFFQENDINIVKEVGDDEILKAHTVDFISFSYYMSLSATASPEGDRSAGNLMGGVKNEYLESSDWGWQIDPKGLRWTLNDLYSRYELPLFIVENGLGAYDTVEEDGKIHDDYRIDYLRKHIEQMKEAIADGVDLMGYTSWGPIDLVSASTSEMSKRYGFIYVDQDDWGKGTLERSRKDSFFWYKKVIETNGEDLD

SEQ ID NO: 1597 - protein, 544 aa, Ralstonia eutropha
MPEKTLIFHQSARREMLHGVELLARAVKVTLGPGGRNVIVERRDMVPLVANSGVVVAKSVSLPDPFADMGARLLCEAAVRTSEIAGDGTTTATTLAHAIVAEGVKYVEAGHDPMQLKRGIEAAGKLVSEHLLASAKPCGGTDEMRQIATISASGDHTVGTLVAQAVEHVGKDGAISVEDGSKLDDELDIAEGALIDRGYLSPLFATTESRAVVLESPLVLLCDASISSIAQLLPILEAVTRAGRSLLVIANDVEGEALATLVVNNLRGALKSCAVKSPGFGDSRTEQLGDLAALTGATVVSPQTGTSLEHVGLEQLGEARRVEINKDATTLVGSGADASRVAARIAVLRSRVPDARSDYDREGLQRRIARLTGGVAVIKVGAATESALHERKNRFQDALHATRAAVDEGIVAGGGVALLRARTVLQDWQAPNAEQAAGARIVHAALAAPMRQIVANAGADADAVVHRVCEASGTIGYDAGGERFGDMLELGVIDPVKVVRTALQNAVSIASLLLTTDCMIAIERIPHGSAENAAAGARMFGEEF

SEQ ID NO: 1598 - protein, 328 aa, Trichosporonoides megachiliensis
MSYNKNIPLNDGNSIPALGYGTWQAEPGQVGEGVKLAVKAGYRHLDLAKVYQNQTEIGQALKELFDEGVVKREDLFITSKLWNNRHAPEHVEPALDETLKELGLSYLDLYLIHWPVAFKFTTPDELLPADPTNKDLAYVDDSVKLSDTWKAVVALKKTGKTKSVGVSNFSTRLVDLVEEASGERPAVNQIEAHPLLQQDELVAHHKSKNIVITAYSPLGNNVAGKPPLTENPGIVDAAKRLNHTPAAVLIAWGIQRGYSVLVKSVTPSRIKSNFEQITLSDEEFQRVTNLIKEYGESRNNVPFNYKPSWSIDVFGTQDEAKATHKINA

SEQ ID NO: 1599 - protein, 718 aa, Mannheimia succiniciproducens
MKLNKSKTYLATLVVSAVIGMSGNAFAVHPTLKASDIVIPQPTEENGLATKRATTRLTQSHYRKFQLDDEFSHKIFARYLDFLDYSHNLFIKSDIDELQAKYAALLDDELNEGKLDIAFAMYDLMAKRRYERYEYALSLLDKEPSLKDDDQIEIDRKKAAWPASVEEANKLWAARVKNDIIDLKLKDKKWSEIKKTLTKRYNLAIRRLTQTNADDITQLFLNAFAREIDPHTSYLAPRTAKSFNESMNLSLEGIGATLQQEDDVTTIKSLVPGAPAERSKRIKAGDKIIGVGQAKGEIEDVVGWRLEDVVDKIKGKKGSKVRLEIEPAKGGKSKIITLVRDKVRIEDSAAKLTVEKVNGQNVAVIKIPTFYIGLTADVRKLLEQMKAKKATSLIIDLRENGGGALTEAVELSGLFISDGPVVQVRDAYNRIRVHEDPDNAQVYTGPLLVMTNRFSASASEIFSAAMQDYNRGIIIGQDTFGKGTVQQSRSLNFVYDLDQEPLGFIQYTIQKFYRINGGSTQLKGVTADINFPAIIDTKENGEEKEDNALPWDKIPAATYSQVSHARDAVEVLKSKHLDRISKDPEFIALAEDLKIRDERSERKYLSLNYEKRKAENDKDDARRLKALNERFAREGKKALKDINDLAKDYEAPDFFLKEAEKMASDLAKFETDKESIQAKAMSLENKADTKDVKAESKKTAEVKTETVKSKEDVRPETK

SEQ ID NO: 1600 - protein, 206 aa, Lotus corniculatus
MPSRRRTLLKVIILGDSGVGKTSLMNQYVNRKFSNQYKATIGADFLTKEVQFEDRLFTLQIWDTAGQERFQSLGVAFYRGADCCVLVYDVNSMKSFDNLNNWREEFLIQASPSDPENFPFVVIGNKIDIDGGNSRVVSEKKARAWCASKGNIPYFETSAKGGINVEEAFQCIAKNALKSGEEEELYLPDTIDVGNSSQQRASGCEC

SEQ ID NO: 1601 - protein, 328 aa, Trichosporonoides megachiliensis
MSYNKNIPLNDGNSIPALGYGTWQAEPGQVGEGVKLAVKAGYRHLDLAKVYQNQTEIGQALKELFDEGVVKREDLFITSKLWNNRHAPEHVEPALDETLKELGLSYLDLYLIHWPVAFKFTTPDELLPADPTNKDLAYIDDSVKLSDTWKAVVALKKTGKTKSVGVSNFSTRLVDLVEEASGERPAVNQIEAHPLLQQDELVAHHKSKNIVITAYSPLGNNVAGKPPLTENPGIVDAAKRLNHTPAAVLIAWGIQRGYSVLVKSVTPSRIKSNFEQITLSDEEFQRVTNLIKEYGESRNNVPFNYKPSWSIDVFGTQYEAKATHKINA

SEQ ID NO: 1602 - protein, 673 aa, Vibrio fischeri
MNCRFRVSLIAAGVMLAASAHALEAKVLDAKFSETDLPVLAAETQHATASKRVTSRFTRSHYKHFSLDDDFSVAIYERYLDMLDYNRNVFIQADLASFAPLSTQLDDQLKVGDTKAAFDIYNLSLKRRFERYVYALSLLDKEFDYTVDESIELDRSEAAWPKDEAELNELWRKRVKYDALNLSMAGKDWPEIQEMLGKRYNNALKRLTQSHNEDAFQLYINAFAREVDPHTSYLSPRNAEQFQSEMNLSLEGIGAVLQATDDYTVIRSLVAGGPALTSKKLSEGDRIIGVGQEGEKIVDVIGWRLDDVVQLIKGPKGTKVKLEILPEGKDSKSHTVTIVRDKIRLEDRAVKSEVIEQNGKKIGVLEVPSFYVGLAEDTKKEIAELKEKDISGIIVDLRNNGGGALTEATALSGLFITAGPVVQVRDSYGRVNVNADTDGEISYTGPMTVLVNRYSASASEIFAAAMQDYGRAVILGENSFGKGTVQQHRSLNHIYDLFDKPLGHVQYTIQKFYRINGGSTQNLGVVPDIAFPTAIDPKDTGESVEDNALPWDSIKAADYAKTNQIAETIEPLAKKHVERIKTDEEFGFIQEDIARYKAEKDITSISLNKKVREKESDDADARRLTRVNERQKLLGKEEFKTLDDIPKDYEVPDAYLDEAVSITIDLALMNQKK

SEQ ID NO: 1603 - protein, 370 aa, Saccharum officinarum
MDGAPVAEFRPTVTHGGRFLQYNIFGNLFEITHKYQPPIMPIGRGAYGIVCSVMNFETREMVAIKKIANAFDNHMDAKRTLREIKLLRHLDHENIIGIRDVIPPPIPQAFNDVYIGTELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQFPRRPFASLFPKVQSVAALDLIERMLTFNPLQRITVEEALEHPYLERLHDIADEPICTEPFSFDFEQQALTEDQMKQLIFNEAIEMNPNFRY

SEQ ID NO: 1604 - protein, 548 aa, Legionella pneumophila
MAKELRFGDDARLQMLAGVNALADAVQVTMGPRGRNVVLEKSYGAPTVTKDGVSVAKEIEFEHRFMNMGAQMVKEVASKTSDTAGDGTTTATVLARSILVEGHKAVAAGMNPMDLKRGIDKAVLAVTKKLQAMSKPCKDSKAIAQVGTISANSDEAIGAIIAEAMEKVGKEGVITVEDGNGLENELSVVEGMQFDRGYISPYFINNQQNMSCELEHPFILLVDKKVSSIREMLSVLEGVAKSGRPLLIIAEDVEGEALATLVVNNMRGIVKVCAVKAPGFGDRRKAMLQDIAILTKGQVISEEIGKSLEGATLEDLGSAKRIVVTKENTTIIDGEGKATEINARITQIRAQMEETTSDYDREKLQERVAKLAGGVAVIKVGAATEVEMKEKKARVEDALHATRAAVEEGIVAGGGVALIRAQKALDSLKGDNDDQNMGINILRRAIESPMRQIVTNAGYEASVVVNKVAEHKDNYGFNAATGEYGDMVEMGILDPTKVTRMALQNAASVASLMLTTECMVADLPKKEEGVGAGDMGGMGGMGGMGGMM

SEQ ID NO: 1605 - protein, 639 aa, Rhodopirellula baltica
MCGITGFWNPSRTNERELRFALDPMLDVLDHRGPDERGSRFFQERGLAMGHTRLSIIGLACGHQPIETDDGDYAVTVNGELYDYKRIRTALACENYECNGKSDSAITLPLYLKHDLAMVDHLRGEFAVVLYDDRKERLVLIRDRFGVKPLYYAVNDNGFIWGSEVKSILQHPDVEPRLCPKAAVHQMMQVMVPGSTAFEGVDALLPGHMLVVQRNGDSLEVQTKRWWDFEFPESHDENADPEPFIQGVQDRLIDAVAARLEADVPVGCYLSGGIDSCSILGLANTLQQSPVKAFTIAFDSDEYDESNIAKRMAERTGAEQELLRLTEKELYGPAFERATWHAERTFYNTLAVAKWHMSRRVRACNYKAVITGEGSDELFGGYPFFKRDWLGRDDEGGIFAGAILAEEDLKHSAWQDLCGFTPSWIQPWMLVLKRFEPILSSSLTDLLQEYDPVGEVAGAIDPAQVRGRHRLDVSQYTWSKTMLEGQILTWGGDRMDMANSMEARPAFLDHHVAEYATTIPPNIRIRNGVEKWVLREAMVNVLPRELYERKKFAFMAPPAHTDPVKRAAVQEMIDHWLTPSRVESVGFFQHDKLMQFIDDAWKESDGTIARRNDIVMNHVLQLHMLHGQYVEGLPLPAVD

SEQ ID NO: 1606 - protein, 578 aa, Solanum tuberosum
MGNTCVGPSISKNGIFQSVSAAMWRSRSPDDTASTTNGESARIETPISVKEPDSPLPVQEPPEQMTMPKSEKKEEEKEQPKKPKKPAEMKRVSSAGLRTDSVLQKKTGNLKEFFSIGKKLGQGQFGTTFKCVEKATGKEYACKSIAKRKLLTDDDVEDVRREVQIMHHLAGHPHVISIKGAYEDAVAVHVVMEFCAGGELFDRIIQRGHYTERKAAELTRTIVGVVEACHSLGVMHRDLKPENFLFVDQKEDSLLKAIDFGLSIFFKPGDRFTDVVGSPYYVAPEVLRKRYGPEADVWSAGVILYILLSGVPPFWAENEQGIFEQVLHGDLDFKSDPWPSISEDAKDLMRRMLVRDPRRRLTAHEVLCHPWVQVDGVAPDKPLDSAVLSRMKQFSAMNKLKKMALRVIAESLSEEEIAGLKEMFKMIDTDNSGQITFEELKEGLKRFGSNLKETEIYDLMQAADVDNSGTIDYGEFIAATLHMNKIERQDHLFAAFCYFDKDGSGYITADELQQACEEFGIGDVRMEEMIREADQDNDGRIDYNEFVAMMQKGNPVLGGGKKGLEHSFSIGFREAVKL

SEQ ID NO: 1607 - protein, 403 aa, Kluyveromyces marxianus
MSYMNFDPKPLGDTNIFKPIKIGNNELKHRVVMPALTRMRAIAPGNIPNTEWAEEYYRQRSQYPGTLIITEGTFPSAQSGGYPNVPGIWSKEQLAEWKKIFNAIHENKSFVWVQLWVLGRQAWPEVLKKEGLRYDSATDDLYMGEEEKERALKANNPQHGITKEEIKQYIKEYVDAAKKAIDAGADGVQIHSANGYLLNQFLDPISNNRTDEYGGSIENRARFTLEVVDAVVDAVGAERTSIRFSPYGTFGTMSGGENPGIVAQYAYVIGELEKRARAGKRLAFIDLVEPRVTDPFLPEFEKWFKEGTNEFIYSIWKGPVLRVGNYALDPDQATLDSKKPNTLIGYGRSFIANPDLVYRLEKGLPLNKYDRNTFYTFTKEGYTDYPSYEESVAKGYKKEEKKY

SEQ ID NO: 1608 - protein, 330 aa, Trichosporonoides megachiliensis
MSYKQYIPLNDGNKIPALGFGTWQAEPGQVGASVKNAVKAGYRHLDLAKVYQNQSEIGVALQELFDQGIVKREDLFITSKVWNNRHAPEHVEPALDETLKELGLSYLDLYLIHWPVAFKFTTPQELFPTEPDNKELAAIDDSIKLVDTWKAVVALKKTGKTKSVGVSNFTTDLVDLVEKASGERPAVNQIEAHPLLQQDELVAHHKSKNIVITAYSPLGNNVSGKPPLTQNPGIEATAKRLNHTPAAVLLAWGIQRGYSVLVKSVTPSRIESNYDQITLSPEEFQKVTDLIKEYGESRNNIPLNYKPSWPISVFGTSDEAKATHKINTNL

SEQ ID NO: 1609 - protein, 371 aa, Coxiella burnetii
MKQISKINWLNVSFIILTGLVGITGTILFIVFGLVHWPTWVLAGAMLIACGLSITAGYHRLAAHKSYKAAWPIRLFFALFGAAAFEGSIVEWATDHRKHHRYTDTDQDPYSIKKGFWYAHIGWLFTLDPSKRDFSNVQDLLDDPIYRFQHRFFPIIAILMGFGLPMAIGALWGDPLSALVIAGALRITVVYQMTFFINSLCHMIGKQTYKNSSARDNWVTALLTMGEGFHNFHHQFPIDYRNGVRFFHFDPTKWLIYLLSRMGLVSGLKRVEQRRIIKYRLQTDTQRLALLSAERVEVVKPLYERIHHLLGRLEELEKSYLALKEAQFKAYKNRLREIRQKLKATERELRTFLTLWSKVARPLQTCQLSGS

SEQ ID NO: 1610 - protein, 317 aa, Nicotiana tabacum
MAQNNEQQQQGQGLIEAGVLDDIINRLLEFRNARTVRQVQLSEAEIRSLCSASREIFLQQPNLLDLKPPIKICGDIHGQYGDLLRLFEYGGFPPEANYLFLGDYVDRGKQSLETICLLLAYKIKYPENFFLLRGNHECASINRIYGFYDECKRRFNVKLWKCFTECFNCLPVAALIDEKILCMHGGLSPVLTNLDQIRNLPRPTDVPDSGLLCDLLWSDPSREVKGWGMNDRGVSYTFGPDKVAEFLMQHDMDLVCRAHQVVEDGYEFFAERQLVTIFSAPNYCGEFDNAGAMMSVDESLMCSFQILKPTDRKPRFL

SEQ ID NO: 1611 - protein, 310 aa, Nicotiana tabacum
MAQNGQGIEPAVLDDIINRLLEFRNARTVRQVQLSEAEIRSLCTASKEIFLHQPNLLELEAPIKICGDIHGQYGDLLRLFEYGGFPPEANYLFLGDYVDRGKQSLETICLLLAYKIKYPENFFLLRGNHECASINRIYGFYDECKRRFNVRLWKTNTDCFNCLPVAALIDDKILCMHGGLSPDLTDLDEIRNLPRPTDIPDSGLLCDLLWSDPSREVKGWGMNDRGVSYTFGSDKVAEFLMQHDMDLVCRAHQVVEDGYEFFAERQLVTIFSAPNYCGEFDNAGAMMSVDENLMCSFQILKPTDRKPRFL

SEQ ID NO: 1612 - protein, 449 aa, Vibrio vulnificus
MNKYQLPQDSQLRQADFLFGVATSSYQIEGGAQLGGRTPSIWDTFCNQPGAVDNMDNGDVACDHFHLWQQDIELIQGLGVDAYRLSMAWPRILPKDGQVNQQGLEFYERIIDECHARGLKVFVTLYHWDLPQYLEDKGGWLNRETAYKFAEYAEVVSGYFGNKIDSYATLNEPFCSAYLGYRWGIHAPGKKGEREGFLSAHHLMLAHGLAMPIMRKNAPQSMHGCVFNATPAYPYSEQDVAAAEYSDAEGFHWFIDPVLKGEYPQSVLEHQAHNMPMILDGDLDIIRGDLDFIGINFYTRCVVRFDANGELESMPQPDAEHTYIGWEIYPQALTDLLLRLKQRYPNLPPVYITENGAAGEDACINGEVNDEQRVRYFQSHLLALDEAIRAGVNVQGYFAWSLMDNFEWAYGYKQRFGIVHVDYATQKRTLKQSAIAYRNTLLARAEEKQ

SEQ ID NO: 1613 - protein, 547 aa, Vibrio vulnificus
MAAKDVKFGNDARVKMLEGVNILADAVKVTLGPKGRNVVLDKSFGAPTITKDGVSVAREIELEDKFQNMGAQMVKQVASQANDVAGDGTTTATVLAQAIVNEGLKAVAAGMNPMDLKRGIDKAVAAAVEELKAMSKDCSTSTEIEQVGTISANSDSSVGKIIAEAMEKVGRDGVITVEEGQALHDELDVVEGMQFDRGYLSPYFINNQESGSVELESPFFLLVDKKISNIRELLPALEAVAKASRPLLIIAEDVEDEALATLVVNNMRGIVIVAAVIAPGFGDRRKAMLQDIAILTGGTVISEEVGLELEKATLEDLGQAKRVSITKENTTIIDGVGEEAMIQGRVAQIRQQIEDATSDYDKEKLQERVAKLAGGVAVIKVGAATEVKMKEKKDRVEDALHATRAAVEEGIVAGGGVALIRAASKIVDLQGDNEEQNVGIRVALRAMEAPLRQITKNAGDEESVVANNVRAGEASYGYNAATGVYGDMLEMGILDPTKVTRSALQFAASVAGLMITTEAMVTDLPQKDSGMPDMGGMGGMGGMGGMM

SEQ ID NO: 1614 - protein, 173 aa, Pseudomonas fluorescens
MSLQELNTFPGVTAIPDSATRHFVFNHTMLRVKDITKSLDFYTRVLGFSLVEKRDFPEAEFSLYFLALVDKSQIPADAAARTEWMKSIPGILELTHNHGTENDADFAYHNGNTDPRGFGHICISVPDIVAACARFEELGCDFQKRLTDGRMKSLAFIKDPDGYWVEIIQPAPL

SEQ ID NO: 1615 - protein, 547 aa, Xylella fastidiosa
MAAKEIIFSEKARSRMVYGVNLLANAVKATLGPKGRHVVLDKSFGSPIITKDGVSVAKEIELADKFENMGAQMLKEVASKTNDHAGDGTTTATVLAQALIREGCKAVAAGMNPMDLKRGIDKAVIAAVTELKKISKPTSDDKAIAQVATISANSDESIGNIIAEAMKKVGKEGVITIEEGTTLENELDVVEGMQFDRGYSSPYFINNQQSQIVELDNPYILLHDKKISNVRDLLTVLDAVAKESKQLLIVAEEVEGEALATLVVNNIRGIIKVCAVKAPGFGDRRKAMLEDMAVLTGGTVISEEVGLSLEKATTSHLGKAKKVRVSKENTTIIDGMGDNDAINGRVKQIKTQIEETTSDYDREKLQERVAKLAGGVAVIKVGAATEVEMKEKKARVDDALLATRAAVEEGVIPGGGVALIRVITAISNLKGANEDQTHGIQIALRAMEAPLREIVANAGEEPSVILNKVKEGKGNFGYNAATGEFGDMVNFGILDPTKVTRSALQNAASIAGLMITTEAMIAEAPKKDEPTPPAAGGGMGGMGGMDF

SEQ ID NO: 1616 - protein, 456 aa, Arabidopsis thaliana
MENKPSVLTERYEVGRLLGQGTFAKVYFGRSNHTNESVAIKMIDKDKVMRVGLSQQIKREISVMRIAKHPNVVELYEVMATKSRIYFVIEYCKGGELFNKVAKGKLKEDVAWKYFYQLISAVDFCHSRGVYHRDIKPENLLLDDNDNLKVSDFGLSALADCKRQDGLLHTTCGTPAYVAPEVINRKGYEGTKADIWSCGVVLFVLLAGYLPFHDTNLMEMYRKIGKADFKCPSWFAPEVKRLLCKMLDPNHETRITIAKIKESSWFRKGLHLKQKKMEKMEKQQVREATNPMEAGGSGQNENGENHEPPRLATLNAFDIIALSTGFGLAGLFGDVYDKRESRFASQKPASEIISKLVEVAKCLKLKIRKQGAGLFKLERVKEGKNGILTMDAEIFQVTPTFHLVEVKKCNGDTMEYQKLVEEDLRPALADIVWVWQGEKEKEEQLLQDEQGEQEPS

SEQ ID NO: 1617 - protein, 211 aa, Asarum caudigerum
NRQVTYSKRRNGLLKKAYELSVLCEAEVALIVSSSRGRLYEYANNSVRTTIDRYKKASDSSNPASVSETNSQYYQQEATKLRQQIDILQNANRQLMGESISAMNVKQLKQLETRLEKGISRIRSKKNELLFAEIEYMQKREVELRNDNIYLRGKIVENERAQQNMNMLPGGGGYEVMSQHPSYDSRNYLPVNLLEHNQHFSHQEPTALQLG

SEQ ID NO: 1618 - protein, 830 aa, Triticum aestivum
MLCLTAPSCSPSLPPRPSRPAADRPGPGISGGGNVRLSAVPAPSSLRWSWPRKAKSKFSVPVSAPRDYTMATAEDGVGDLPIYDLDPKFAGFKEHFSYRMKKYLDQKHSIEKHEGGLEEFSKGYLKFGINTENDATVYREWAPAAMDAQLIGDFNNWNGSGHRMTKDNYGVWSIRISHVNGKPAIPHNSKVKFRFHRGDGLWVDRVPAWIRYATFDASKFGAPYDGVHWDPPSGERYVFKHPRPRKPDAPRIYEAHVGMSGEKPEVSTYREFADNVLPRIKANNYNTVQLMAIMEHSYYASFGYHVTNFFAVSSRSGTPEDLKYLVDKAHSLGLRVLMDVVHSHASSNKTDGLNGYDVGQNTQESYFHTGERGYHKLWDSRLFNYANWEVLRFLLSNLRYWMDEFMFDGFRFDGVTSMLYNHHGINMSFAGSYKEYFGLDTDVDAVVYLMLANHLMHKLLPEATVVAEDVSGMPVLCRSVDEGGVGFDYRLAMAIPDRWIDYLKNKDDLEWSMSGIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLADIDHLRYKYMNAFDQAMNALDDKFSFLSSSKQIVSDMNEEKKIIVFERGDLVFVFNFHPSKTYDGYKVGCDLPGKYKVALDSDALMFGGHGRVAHDNDHFTSPEGVPGVPETNFNNRPNSFKILSPSRTCVAYYRVEEKAEKPKDEGAASWGKTALGYIDVEATGVKDAADGEATSGSEKASTGGDSSKKGINFVFLSPDKDNK

SEQ ID NO: 1619 - protein, 371 aa, Kluyveromyces lactis
MGKRIVFNISSEFQLQSLLGEGAYGVVCSAKHKPSGEIVAIKKIEPFEKPLFSIRTLREIKILKHFQHENIISIFDVQKPSSFEQFNEVYIIQELMQTDLHRVIVTQELSEDHVQYFVYQTLRALKVLHGSNVIHRDLKPSNLLLNSNCDLKICDFGLARIVSERATDGDAHVDADDTDDNSPSSAANDGDPAISGMTEYVATRWYRAPEVMLTAAQYSKSMDVWSCGCILAELLGKQPLFPGKDYRDQLILIFQTLGTPTEQELVELVENRRAREYIRSLPKHPKINWRRRFPNASAAALDLLDRMLQFDPRLRITATEALSHPYLVSYHDPDDEPEGTPIPSSFFQFDQWKSRLNTKDLKRLLWNEIVS

SEQ ID NO: 1620 - protein, 451 aa, Zea mays
MVGGGGGGPLRRVGKYEVGRTIGEGTFAKVKFAQNTETGESVAMKVLDRSSILKNKMAEQIKREISIMKLVRHPNVVRLHEVLASRKKIFIILEFITGGELFDKIIRHGRLSEADARRYFQQLIDGVDFCHKKGVYHRDLKPENLLLDSQGNLKISDFGLSAWPAQGSFLLRTTCGTPNYVAPEVLSHKGYNGALADTWSCGVILYVLLAGYLPFDEVDLTTLYGKIESAEYSFPAWFSGGAKSLIRRILDPNPETRIRIEEIRSDEWFQKNYEPIKEIENEEVNLDDVNAAFDDPEDDNEDAFEDETGPLTLNAFDLIILSQGLNLAALFDRRQDCDKLQNRFLSRNPAKVILSSMEVVAQSMGFKTHIRNYKMRVEGLNADKTSHLSVMVEVFEVAPSIFMVELQRAAGDTSEYNTFVNNYCGKLDDIIWKFPTEKGKSRIPRLSKSHS

SEQ ID NO: 1621 - protein, 544 aa, Bacillus cereus
MAKDIKFSEEARRSMLRGVDTLANAVKVTLGPKGRNVVLEKKFGSPLITNDGVTIAKEIELEDAFENMGAKLVAEVASKTNDVAGDGTTTATVLAQAMIREGLKNVTAGANPMGLRKGIEKAVTAAIEELKTISKPIEGKSSIAQVAAISAADEEVGQLIAEAMERVGNDGVITLEESKGFTTELDVVEGMQFDRGYASPYMITDSDKMEAVLDNPYILITDKKISNIQEILPVLEQVVQQGKPLLIIAEDVEGEALATLVVNKLRGTFNVVAVKAPGFGDRRKAMLEDIAILTGGEVITEELGRDLKSATVESLGRAGKVVVTKENTTVVEGIGNTQQIEARIGQIRAQLEETTSEFDREKLQERLAKLAGGVAVIKVGAATETELKERKLRIEDALNSTRAAVEEGIVAGGGTSLMNVYTKVASIVAEGDEATGINIVLRALEEPVRQIAINAGLEGSVVVERLKGEKVGVGFNAATGEWVNMLETGIVDPAKVTRSALQNAASVAAMFLTTEAVVADKPEPNAPAMPDMGGMGMGGMGGMM

SEQ ID NO: 1622 - protein, 365 aa, Escherichia coli
MSSEKLYSPLKVGAITAANRIFMAPLTRLRSIEPGDIPTPLMAEYYRQRASAGLIISEATQISAQAKGYAGAPGIHSPEQIAAWKKITAGVHAENGHMAVQLWHTGRISHASLQPGGQAPVAPSALSAGTRTSLRDENGQAIRVETSMPRALELEEIPGIVNDFRQAIANAREAGFDLVELHSAHGYLLHQFLSPSSNHRTDQYGGSVENRARLVLEVVDAGIEEWGADRIGIRVSPIGTFQNTDNGPNEEADALYLIEQLGKRGIAYLHMSEPDWAGGEPYTDAFREKVRARFHGPIIGAGAYTVEKAETLIGKGLIDAVAFGRDWIANPDLVARLQRKAELNPQRAESFYGGGAEGYTDYPTL

SEQ ID NO: 1623 - protein, 493 aa, Zea mays
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVAVGGANHSHATKDLTDAIAAGNFPEWTLYIQTMDPEMEDRLDDLDPLDVTKTWPEDAFPLQPVGRLVLNRNIDNFFAENEQLAFCPGLIVPGIYYSDDKLLQTRIFSYSDTQRHRLGPNYLLLPANAPKCAHHNNHYDGSMNFMHRTEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 1624 - protein, 706 aa, Candida glabrata
MSLTKIPENVQGAVSIDPWLEPFADVLSERRYLADKWLYDIKHATPDGSEQSLVDFARNAYKTYGLHANQQTKEIVYREWAPNAQRAFLVGEFNNWNEESHEMKHKDEFGVFSITLAPLENGDFAIPHDSKIKVMFVLPDGSKVYRIPAWITRATQPSKETAQKYGPTYEGRFWNPPNSYQFKHQRPKFNLANDSIKIYEAHIGISSPEPKVASYKEFTQNVLPRIKHLGYDAIQLMAIMEHAYYASFGYQVTNFFAISSRYGTPEDLKELIDTAHSMGILVLLDVIHSHASKNSEDGLNMFDGSDHQYFHSLTSGRGEHPLWDSRLFNYGSFEVQRFLLANLAYYIDVYQFDGFRFDGVTSMLYLHHGVGAGGAFSGDYNEYLSRDRSGVDHEALAYLMLANDLVHDLLPESAVTIAEDVSGYPTLCLPRTAGGGGFDYRLAMALPDMWIKLLKTKQDDDWDMGHIVHTLTNRRHGEKVVAYCESHDQALVGDKTLAFWLMDAAMYTDMTVLKEPTLVIDRGIALHKMIRLITHSLGGEAYLNFEGNEFGHPEWLDFPRVGNNDSYHYARRQFNLVDDDLLRYRHLNEFDAAMQNCESKHQWLNTPQAYVSLKHEVDKVIAFERNGHLFVFNFHPTQSFTDYRIGVDVAGTYKIVLNTDRAEFGGHNRIDEAQEFFTTDLEWNNRRNFIQVYIPSRTAIVLTRQM

SEQ ID NO: 1625 - protein, 186 aa, Anabaena variabilis
MIKTEFTLTYFLNMMRTNERLKPGSDSQENLRGVKDMTIIRWNPWQDLNTLQRQLNHLFEEDMLPSTVLERTLTRVPAAEIHETAEAIHLKLELPGIDAKDVDLQVTDKAVYISGERKSETKTEDKGVVKSEFQYGKFQRVIPLPTRIQNTNVKAEYKDGILNLTLPKAEAEKNKVVKVNIESAVG

SEQ ID NO: 1626 - protein, 272 aa, Pisum sativum
FVRQLNTYGFRKVDPDRWEFANEGFLAGQRILLRTIKRRRNVAQSPSMQRESGGACIELGEFGLEGEIERLRRDRSVLVAEIVKLRQQQNNSRDQISAMEARLLITEKKHQQMMAFLARALSNQSFIQQLANNKELKGVEMKRKRRLPASSSLENLQNDSVTMMTVPIESVVDYSSREQQEGLTAIESEIETLLSAYDNESRSEIKDPSANESNLSDWEELLNQKLVGGNPEDEVLIGDFSQIDAPVEDLVEKNDDWTVDLQNLVDEMDFEP

SEQ ID NO: 1627 - protein, 478 aa, Listeria innocua
MEHQKRSPFPKDFLWGSASAAYQIEGAWDADGKGKSVWDEYVRIPGTTFKGTNGDVAVDHYHRYKEDVKLMAEAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 1628 - protein, 1129 aa, Avena sativa
MSSSRPASSSSSRNRQSSQARVLAQTTLDAELNAEYEESGDSFDYSKLVEAQRDGPPVQQGRSEKVIAYLQHIQKGKLIQTFGCLLALDEKSFNVIAFSENAPEMLTTVSHAVPSVDDPPRLGIGTNVRSLFSDQGATALHKALGFADVSLLNPILVQCKTSGKPFYAIVHRATGCLVVDFEPVKPTEFPATAAGALQSYKLAAKAISKIQSLPGGSMEVLCNTVVKEVFDLTGYDRVMAYKFHEDDHGEVFSEITKPGLEPYLGLHYPATDIPQAARFLFMKNKVRMICDCRARSIKVIEAEALPFDISLCGSALRAPHSCHLQYMENMNSIASLVMAVVVNENEEDDEAESEQPAQQQKKKKLWGLLVCHHESPRYVPFPLRYACEFLAQVFAVHVNREFELEKQLREKNILKMQTMLSDMLFREASPLTIVSGTPNIMDLVKCDGAALLYGGKVWRLRNAPTESQIHDIAFWLSDVHRDSTGLSTDSLHDAGYPGAAALGDMICGMAVAKINSKDILFWFRSHTAAEIRWGGAKNDPSDMDDSRRMHPRLSFKAFLEVVKMKSLPWSDYEMDAIHSLQLILRGTLNDASKPKREASLDNQIGDLKLDGLAELQAVTSEMVRLMETATVPILAVDGNGLVNGWNQKAAELTGLRVDDAIGRHILTLVEDSSVPVVQRMLYLALQGKEEKEVRFEVKTHGPKRDDGPVILVVNACASRDLHDHVVGVCFVAQDMTVHKLVMDKFTRVEGDYKAIIHNPNPLIPPIFGADEFGWCSEWNAAMTKLTGWNRDEVLDKMLLGEVFDSSNASCPLKNRDAFVSLCVLINSALAGEETEKAPFGFFDRSGKYIECLLSANRKENEGGLITGVFCFIHVASHELQHALQVQQASEQTSLKRLKAFSYMRHAINNPLSGMLYSRKALKNTDLNEEQMKQIHVGDNCHHQINKILADLDQDSITEKSSCLDLEMAEFLLQDVVVAAVSQVLITCQGKGIRISCNLPERFMKQSVYGDGVRLQQILSDFLFISVKFSPVGGSVEISSKLTKNSIGENLHLIDLELRIKHQGLGVPAELMAQMFEEDNKEQSEEGLSLLVSRNLLRLMNGDVRHLREAGVSTFIITAELASAPTAMGQ

SEQ ID NO: 1629 - protein, 480 aa, Yersinia pestis
MMSKKKGLTTAAGAPVVDNNNVITAGRRGPMLLQDVWFLEKLAHFDREVIPERRMHAKGSGAYGTFTVTHDITQYTRAKIFSEIGKKTDMFVRFSTVAGERGAADAERDIRGFAMKFYTEEGNWDLVGNDTPVFYLRDPLKFPDLNHVVKRDPRTNLRNPVYKWDFFSQLPEALHQLTIDFSDRGLPKSYRHMHGFGSHTFSLINANNERFWVKFHFRCQQGIENLMDDEAEKLIGSDRESSQRDLYEAIERGDFPRWKLQIQVMPEHEASQTPYNPFDLTKVWPHGDYPLIDVGYFELNRNPENYFAEVEQSSFNPANVVPGISFSPDRMLQGRLFSYGDAARYRLGVNHHQIPVNSAKCPFHNYHRDGAMRVDGNSGNGATYEPNSFGLFQEQPDFSEPPLTLEGAADHWNHREDTDYFSQPRALFNLLSEEEHQRMFTRIAGELSQVPEAIQRRQIALFTQVDPAYGAGVKKALGLN

SEQ ID NO: 1630 - protein, 650 aa, Unknown
  Mesorhizobium sp. BNC1
MTSAFKHLLSPIRIGNNLVRNRSMSTAHGTGYAVDGKISDQLIEYHMARARGGIGLIVLEATGVNAAPIGAKGGSYLRNSDDSVLPGYRKLSKALHEEGVVVYTMLSHSGRNTTMGINGTPPRAPSPIPFDRARDIPRPLEIEEIKGIVKAFADAACRAREGGLDGVELSYTHGNLVQQFLSPLTNIREDEYGGSEENRLRLAREILEAVRTALGDDYTLGIRFSADELVPGGYTIDDGERYARMMVEWGKLDYVSVSAGTNGSMWSRSIHYPSISMPEKVLIPYSKRVKQAVDVPVFCIGKITDPAEAEGILAQGEADIVGMTRAHIAEPAIIRKLMDDRIEDIRPCIHWNEGCFARKQRGGDLGCVFNPRTGREADWDPIVPVEDYKTVMIIGGGPAGLEAGRVAAKRGHDVVLHEKLDVLGGQVRQLALTPHRRDYRILTDWLERQARKAGVLIRTGSEMTAEKVLEAAPDVVIIATGAKDTLPRIKGADRPGVITARQLLDGANVGKRVVVGDWDGRNMGMSIAEHLAVRGHEVEIVSTTMYIGEDAELMTWHPAYERLQNLGVKLTALAELVEVRDGAAVVRALNGALTEVACDNVVTCTRGSAAEDLYLGLKGKVPHLYTIGDAFTPRQLEQAVYEGAKVARQI

SEQ ID NO: 1631 - protein, 173 aa, Pseudomonas fluorescens
MSLNELNTFPGVTAQPDAATARFVFNHTMLRVKDITRSLDFYTRVLGFSLVEKRDFPEAEFSLYFLALVDKAQIPADAGARTEWMKSIPGILELTHNHGTENDPAFAYHNGNSDPRGFGHICISVPDIVAACERFEALGCDFQKRLNDGRMKSLAFIKDPDGYWVEIIQPAPL

SEQ ID NO: 1632 - protein, 326 aa, Arabidopsis thaliana
  misc_feature (292)..(292): Xaa can be any naturally occurring amino acid
  misc_feature (319)..(319): Xaa can be any naturally occurring amino acid
MKNFNLTHRIVMAPMARMRSYGNIPQPHVALYYCQRTTPGGLLISEATGVSETAMAYQNMPGIWRKEQIEAWKPIVDAVHSHGGIFFCQLWHAGRVSHQDCQPNGESPVSSTDKPFADDPSNEFTPPRRLRTDEIPTIINDFRLAARNATEAGFDGVEIHGAHGYLIDQFMKDSVNDRTDSYGGSLENRCRFALQVIEAVSKEIGPDRVGIRLSPFADYMESGDTDPKRLGLYMAKSLNRFEILYCHMIEPRMKTVSEIFECRESLTPMRNAFNGTFIVAGGYTREDGNKAXVAEGRTDLVAYGRLFLANPDLPKRFEXLNAPLNK

SEQ ID NO: 1633 - protein, 747 aa, Xanthomonas oryzae
MCLHTLWRSCALTCEHALRMLTHPVNGHAPRLEGIASISARQRGVPMAKSSGKPASAVSVDRSASAPDARGTGDELHQKARGRHPQLTTNQGIPVGDNQNSLRATPRGPTLLEDFILREKITHFDHERIPERIVHARGSAAHGYFKLTKSLSQYTTAKIFTEIGEKTPLFTRFSTVAGGAGSVDTPRDVRGFAVKFYTKEGNWDLVGNNIPVFFIQDAIKFPDLIHAVKMEPDRGFPQAASAHDTFWDFISLTPESMHMIMWAMSDRTIPRSLRMIEGFGIHSFRFLNDKGESTFVKFHWRPKLGLQSTIWDEAVKIAGADQDFHRRDLFEAIQNGDFPEWELGVQLFTEAEADAFPFDHLDSTKIIPEELVPLQIVGRMVLDRWPDNFFAETEQVAYCPGNIVPGIDFSNDPLLQGRLFSYLDTQLSRLGGPNFHQIPINAPKCPFVNNQRDGHMQMDVPKGRVAYEPSSLQADAPREALRGFPSHSTPAEDGAKGRVRAERFADHYSQARLFFRSQTAPEQAHMASALVFELSKVETAHVREAIVGHLRHIDQKLAQRVADGMGMTTLPPAPPAAVAPIDMPLSPALQVIGKMKDTLKGRTVGILIHDGSDASTIKAVRKAAEAEGATVKIVAPKLGGAKLSDGKQLAADGQLAGTPSVVFDAVAVLLSSEAAKLLTRESAALDFVSCAWAHLKAIAFDEGAQLLLKAGNIGKDAGVVPAADTKAFISAAKTRQWAREPKVRMLA

SEQ ID NO: 1634 - protein, 361 aa, Gluconobacter oxydans
MPTLFDPIDFGPIHAKNRIVMSPLTRGRADKEAVPTPIMAEYYAQRASAGLIITEATGISREGLGWPFAPGIWSDAQVEAWKPIVAGVHAKGGKIVCQLWHMGRMVHSSVTGTQPVSSSATTAPGEVHTYEGKKPFEQARAIDAADISRILNDYENAARNAIRAGFDGVQIHAANGYLIDEFLRNGTNHRTDEYGGVPENRIRFLKEVTERVIAAIGADRTGVRLSPNGDTQGCIDSAPETVFVPAAKLLQDLGVAWLELREPGPNGTFGKTDQPKLSPQIRKVFLRPLVLNQDYTFEAAQTALAEGKADAIAFGRKFISNPDLPERFARGIALQPDDMKTWYSQGPEGYTDYPSATSGPN

SEQ ID NO: 1635 - protein, 581 aa, Zea mays
SSSVPLSAEGITVQSFNADLLYEPWEVLDDDGFPFTMFAPFWNRCLCMPDPAAPLLPPKRINSGDLSRCPWDELIFEDESERGSNALLARAWSPGWQNADKALTAFLDGPLVDYSANHKKADSASTSLLSPYLHFGELSVRKVFHQVRMKQLMWSNDGDRAGEESCTLFLRAIGLREYSRYLTFNHPCSLEKPLLSHLRFFPWVVDEVHFKVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQGALSEMWELEAASRAAIENGMEEGLGDSTDEPPIDFPQELRMEVDRQPAQPAIIHTSVVAGWRREDQRVPSMTSSLIRAETELTADFGNTSEDSRPEVPSNIHLQARAEREETVDGATGNTVRVNGNQQQQNLQNNMHRVLGIAPSISEASSSWTGREGGLVPVWSPPAASVHSDPYTADEADISSRSYLDRHQQSNTMMNWSQLSQSLTTGWEVDN

SEQ ID NO: 1636 - protein, 222 aa, Arabidopsis thaliana
MGRGKIEIKRIENTTNRQVTFCKRRNGLLKKAYELSVLCDAEVALIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNAIQALASRSFFNPNMLEGGTVYPHSDKKILHLG

SEQ ID NO: 1637 - protein, 309 aa, Brassica napus
  misc_feature (290)..(290): Xaa can be any naturally occurring amino acid
  misc_feature (296)..(296): Xaa can be any naturally occurring amino acid
MCNPTRDDGSSQSGMVRKEKTPYFQRYWTWADVARAVTVTVVHFLCLLAPFNYKWEALRFGLILVAVTNLLITFSYHRNLAHRSFTLPKWLEYPIAYAAVFALQGDPLDWVSIHRFHHQFTDSDHDQFTDSDRDPHSPKEGFLFSHVMWIFDTLYIKYKCGGRNNVMDLKQQWFYRFLRKTIGFHVLMFWTVLYLYGGLPYLTCGGGVGGVLGYHVTWLVNSACHICGSRSWKTKDTSRNVWWLSIFTMGDSWHNNHHAFQSSARQGLEWWQIDITWYLIRLFEVLGLAXDVKLPXEYQKQKLALACSS

SEQ ID NO: 1638 - protein, 731 aa, Mycobacterium tuberculosis
MSRSEKLTGEHLAPEPAEMARLVAGTHHNPHGILGAHEYDDHTVIRAFRPHAVEVVALVGKDRFSLQHLDSGLFAVALPFVDLIDYRLQVTYEGCEPHTVADAYRFLPTLGEVDLHLFAEGRHERLWEVLGAHPRSFTTADGVVSGVSFAVWAPNAKGVSLIGEFNGWNGHEAPMRVLGPSGVWELFWPDFPCDGLYKFRVHGADGVVTDRADAFAFGTEVPQQTASRVTSSDYTWGDDDWMAGRALRNPVNEAMSTYEVHLGSWRPGLSYRQLARELTDYIVDQGFTHVELLPVAEHPFAGSWGYQVTSYYAPTSRFGTPDDFRALVDALHQAGIGVIVDWVPAHFPKDAWALGRFDGTPLYEHSDPKRGEQLDWGTYVFDFGRPEVRNFLVANALYWLQEFHIDGLRVDAVASMLYLDYSRPEGGWTPNVHGGRENLEAVQFLQEMNATAHKVAPGIVTIAEESTPWSGVTRPTNIGGLGFSMKWNMGWMHDTLDYVSRDPVYRSYHHHEMTFSMLYAFSENYVLPLSHDEVVHGKGTLWGRMPGNNHVKAAGLRSLLAYQWAHPGKQLLFMGQEFGQRAEWSEQRGLDWFQLDENGFSNGIQRLVRDINDIYRCHPALWSLDTTPEGYSWIDANDSANNVLSFMRYGSDGSVLACVFNFAGAEHRDYRLGLPRAGRWREVLNTDATIYHGSGIGNLGGVDATDDPWHGRPASAVLVLPPTSALWLTPA

SEQ ID NO: 1639 - protein, 869 aa, Leptospira interrogans
MNIFKIESQSSGFFAIIHLTIKKELLSKMIKSLRISCIFFILISFLTFLLNCSQFKQNNPIASNGVIDLSTWNPNIESINLKGNWEFCWDQWIPPNAEESQWKENCNGFYPAPAYWKFYNIPGKNLSPFGKATYRLKVILPTSFHDSYGIRWTEILSAFQIFINNKSVAQIGVLGTDFNTMTPKLKPDRTEIGPQNNQMTIVIWVSNFNHQNHGFWQPIYLGKWEIIRNTQVSHLMMDIASFASVALIGFYHLVLFLFRTRSKEYLFFGLFCISMGIRQLSVEDHAFIIFFPDIDFDFYIRFIYFTVLSIGIFMCMFIKSLFPEEVSSFFINSAIGVFGCSSFTLALPVRVFTEFFSIIFVLISFLPLGLTTYLFKAHKMKRKGATLILIAYLIFSTVVLNDILFTLGYISTGYISYIGITVFIFFQAGVLAQQLTQAFNHSEDLALELKSTLQENIETHNELLALKELQNTNLEFQVQSRTRELLKARDDAEFANKVKSQFLASMSHEIRTPLNGIIGLIEQFKSTPLDESQQHIRNLIQKSGENLLKIINDILDFSKLEEDKINLELHEFYWKETVEETIGIFLYQATQKGLVLSVDYSPDFIDKSVGDKRRITQVLSNLISNAVKFTDSGKIQIRAFSEKIETKIEYKIQVIDSGIGIPREKIDLLFQKFFQLDSSISRKYGGTGLGLAISKKLVELMNGKIHVSQNKSKGSTFEFTVLLSEFVSKDHSTYLPEITDLSSLSPDTFILIAEDDSTNIFLLSGILKKLKIKFELAKDGLEAITKVRVSRFDLIFMDINMPHLDGISASNFILTDPMISPKPVIIAVTADVLQEDKIKCRQAGMSDFLGKPYYKKDIEQMIYKWLVIH

SEQ ID NO: 1640 - protein, 838 aa, Streptomyces avermitilis
MIPRPPSDDRANQNGDGSKKTGAKKTGAKKAAAAKKTAGKKATPAAKATAAKGAVTKKTGKGKATAKKAVADKAAAKATVPQQAVPKQAVSKRAVSKKAVPRKAVVKAALDIPEAPVSPAVAPDDRDRLLSGTHHAPHSVLGAHPVPGGVAFRVLRPYALSVTVVTDDLRTELHDDGAGFFTGLLPLRAVPDYRLHVAYEGTVHETEDAYRFLPALGELDLHLINEGRHEELWTALGAEPMTHQGVPGTRFTVWAPNARGVRLAGTFNFWDATAFPLRSLGSSGVWELFVPGVGEGELYKFEITRPDGSKTLRADPVARRTEAPPRTSSIVHASHYAWADEAWMAARGERPVHESPFSVYEVHLPSWRPGLTYRQLAEQLPAYVADLGFTHVELLPVAEHPFGGSWGYQVTGFYAPTARLGTPDDFKYLVDALHRAGVGVLMDWVPAHFPRDDWALAEFDGRPLYEHEDPLRAAHPDWGTLEFDYGRREVRNFLVANAVYWCEEFHIDGLRVDAVASMLYLDYSREEGQWSPNEFGGRENLDAVAFLQEMNATVYRRVPGVVTIAEESTAWEGVTRATHDNGLGFGLKWNMGWMHDSLGYVQHEPVHRRFHHHEMTFSMVYAYSENYVLPISHDEVVHGKGSLVSKMPGDWWQQRATERAYLGFMWAHPGKQLLFMGQEFAQGAEWSETHGPDWWLLDPAYGAEPDHRGMRDLVRDLNTVYRHEPALWERDTDPSGFAWVTGDAVEDNVFAFLRHAADGTPLLAVSNFSPVVRHDYRLGVPDDIPAWHETLNTDGARYGGSDVTNPHPVKPEPQGRHGRPASIRLTLPPLSTLWLRPA

SEQ ID NO: 1641 - protein, 402 aa, Streptomyces anulatus
MEFRQSSKLSEVCYEIRGPVIEHANALEEAGHSVLRLNTGNPALFGFEAPEEIVQDMIRMLPQAHGYTDSRGVLSARRAVAQRYQALGLDEVSVDDVFLGNGVSELVTMAVQALLEDGDEILIPAPDFPLWTAVTTLSGGKAVHYVCDEAADWYPDLDDMASKITDQTKAVEIINPTGAVYPKEILEGILDLARRHGLMVFADEIYDQILYDDAVHHSVAALAPDLVVLTFCGLSKTYRVAGFRSGWLVITGPRQHARDYLEGLTMLASMRLCPNAPAQFAIQAALGGRQSIRELTAPGGALHEQRDRAWEKLNEIPGVSCVKPKGALYAFPRLDPKVHPIHDDEKFVLDLLLQEKIQVVQGTGFNWPRPDHFRILTLPHADDLDAAISRIGRFLSGYRQGR

SEQ ID NO: 1642 - protein, 432 aa, Oryza sativa
  misc_feature (172)..(172): Xaa can be any naturally occurring amino acid
MYRAKRAALSPKVKRRVGKYELGRTIGEGTFAKVRFAKNTENDEPVAIKILDKEKVLKLAVRAQPSGEICTMKLVKHPNVVRLFEVMGSKARIFIVLEYVTGGELFEIIATNGRLKEEEARKYFQQLINAVDYCHSRGVYHRDLKLENLLLDASGNLKVSDFGLSALTEQVXEVIEDRGYDGAAADIWSCGVILYVLLAGFLPFEDDNIIALYKKISEAQFTCPSWFSTGAKKLITRILDPNPTTRITISQILEDPWFKKGYKPPVFDEKYETSFDDVDAAFGDSEDRHVKEETEDQPTSMNAFELISLNQALNLDNLFEAKKEYKREPRFSSQCPPKEIISKIEEAAKPLGFDIQKKNYKMRMENLKAGRKGNLNVATEVFQVAPSLHVVELKKAKGDTLEFQKLYRTLSTQLKDVVWKCDGEVEGNGAAA

SEQ ID NO: 1643 - protein, 396 aa, Kineococcus radiotolerans
MAGLFTPLTIKDVTLRNRIGMSPMTMYRSVDGAMNDFHLMYLGARAAGGFGLVFPEQVAIAPEGRTTVHCAGIYDDAQVEGHARVTAMIKDMGAVAGIQLGHTGRNGSEVPPWEGGLQLPPEHPDGWQVSGPSNIPYGCGKRPYPVHALSVAEIKTLHRQYADAARRALDAGYEWLEMHFAHGYLASEFFSPLANQRTDEYGGSLENRARFLLEALDAVREVWPERLPLTMRLGSDDFHPEGITFEESITAIGWMKEHGLDLADISQGGNTDDMVNPIWNDPSAWVARAARLKDRVDIPVTTSWNLGIPANADAAIRSGDVDLVLLGRPALANPHWPVWAARELGTTEPFDLVPKDWGFWLQNFRGHGPSIGWPEPEVSRPAVVTLPQQGAHLQNV

SEQ ID NO: 1644 - protein, 542 aa, Crocosphaera watsonii
MRTRCCPVLRNSWIPLSSPLLGYRSSSSAFRMTWLTTLMIISTTISYHTVVYLENETKPTGISDFVCSVFWRHLTMFNRKKIDIPRLQPSWRAIIGEFPPNQSSQSLWHCQGFSLVEGVPKLSKNKRFAVVGDVSLSNTDLLLKRLAINPSRWQEDHQTLIAWGWEELGKDCLHYLRGIFSFVVWDTHEKQGWAIRDRVGGRTLYYYQQDSTFYISPRLKNLSPYFKKNLDLIALRDYLCTGFIPGKRTLWQGVKELRPGTILSLPQEKIETYWTPQENISQSPLSFDKSSEILRELLETIIQEYLPPQEPVGVYLSGGLDSSCVTALAKQFHQETVHTYSIHFGEDYPNELEFSSLVAAHCQTKHHILAISPQEMWENLPITMANLDSPIGDPLTVPNYLLAQLAKQDVKVILNGEGSDPCFGGPKNQPMLLHSLYHNSEQKIDLLSSYLTSFKKCFLDLPNLLNPDIFKQVKDAPSVFEADLLSSADYLNRLMLLNIKFKGSDHILNKVNNLTLSGLLEGRSPLFDSRVVDKIFIHSSSL

SEQ ID NO: 1645 - protein, 334 aa, Photorhabdus luminescens
MKTLGEFIVEKQQDFSHATGELTALLSAIKLGAKIIHRDINKAGLVDILGTSGVSNVQGEVQMKLDLYANEKLKAALKARGEVAGIASEEEDDIVIFEGDRAENAKYVVLMDPLDGSSNIDVNVSVGTIFSIYRRITPIGQPVTEKDFLQPGHRQVAAGYVVYGSSTMLVYTTGCGVHAFTYDPSLGVFCLSHEKVQFPPNGNMYSINEGNYIKFPMGVKKYIKYCQEQDEATQRPYTTRYIGSLVADFHRNLLKGGIYIYPSTASHPSGKLRLLYECNPMAFLAEQAGGKASDGANRILDITPSKLHQRVPFFVGSKSMVEKAESFMAEFPDE

SEQ ID NO: 1646 - protein, 672 aa, Unknown
  Shewanella sp. MR-4
MSFPHLLEPLDLGFTQLKNRVLMGSMHTGLEEEKGGFEKLAAFYKERALGGVGLIVTGGISPNLRGRLTPHACQLSFPWQVGKHRIVTQAVHEAGGKICMQILHAGRYGYHPFSQAPSKIKSPITPFTPSAMSSRQVRATIKDYASSAALAKRAGYDGVEVMGSEGYLINQFISSRTNTRTDEWGGSFEKRAQFPIEIVNAIRAKVGKDFIIIFRLSMLDLVDNGSTWDEVVQLAKWLEHAGVSIINTGIGWHEARVPTIATSVPRGAFAWVTEKLKKSVSVPLIATNRINTPEIGEQIIVSGQADMVSMARPFLADPEFVNKAAANTPELINTCIGCNQACLDHTFSLKRATCLVNPRACYETEINFLPTSNKKRIAVMGAGPAGMAFSVYAAMRGHEVVLFEAKSEVGGQFNLARKIPGKEEFNETIRYFLNQIKLHKIDLRLNTRLDAKVLETETFDEIVIASGVVPRELSLPGFDSPKVVDYQQVLTGQATIGNKVALIGAGGIGFDMAHYLCESESSTLNPEKWLKQWGIDKQYQHAGGLAEPEVDNSEHRQVYLLQRKTSKMGQGLGKTTGWIHRLVLKQHDVKMKTGVSYDKFDDAGLHIRVGEQTEVLAVDNVILCAGQESNRTLVDEMKATGIPVHLIGGVDVAAELDAKRAIRQGAELAMRL

SEQ ID NO: 1647 - protein, 541 aa, Glycine max
MRKSAADRFRHLFNRSLLLLRHRHHHNHHPFPYSSSVSSLSPFSRSRFLSSTPFSMASDSPFPVTAQNINPKVLKCEYAVRGEVVTLAQNLQKDLQANPGSHPFDEILYCNIGNPQSLGQQPITFFREVLALCDHPAILDKSETQGLFSTDAIQRAWQIVDQIPGRATGAYSHSQGVKGLRDTIAAGIEERDGFPANPDDIFMTDGASPAVHNMMQLLIRSENDGILCPIPQYPLYSASIALHGGCLVPYYLDEATGWGLEIPELKKQLEAAKSKGINVRALVVINPGNPTGQVLGEANQRDIVEFCKQEGLVLLADEVYQENVYVPEKKFHSFKKVSRSMGYGENDITLVSFQSVSKGYHGECGKRGGYMEVTGFSAEVREQIYKVASVNLCSNISGQILASLVMSPPKVGDESYDSFMAEKENILASLARRAKTLEDAFNKLEGVTCNKAEGAMYLFPQIRLSEKAIKAAEAANATPDNFYCKRLLNATGVVVVPGSGFGQVPGTWHFRCTILPPEEKIPAIVTRLTEFHEKFMDEFRD

SEQ ID NO: 1648 - protein, 215 aa, Oryza sativa
MWSSDSEADLTAAAAAMTTTTTTSSSSSSSSSPSSSPPPPRRRHRHHRRAARRTHPVEAEAEEVWRGAQWEAAWPRRTKPVVVAEDEPPSGGVIVGACTAGGGEEGGGVGRARSLTDDDLEELKGCVDLGFGFSYDEIPELCGTLPALELCYSMSQRFLDDHPQSHHSPPPPPPPMPSPSIPNWKISSPGDSPDEVKARLKYWAQAVACTVRLCS

SEQ ID NO: 1649 - protein, 709 aa, Ustilago maydis
MSHLEALKKPVVFSNGVTAPNATLKSAMTERLCTWSEDDFKKRGWPTPEYINLYKTWGEGEIGTIVLGNIPCDARYPEAKKNACIDPEIGSHQEYVEAYKPVIDAASAHGSLVIAQVTHAGRQTSEEIASIPVSSSDVQCPPGMGMTFGKPRPLTVDEIHDIARRFGFAAKVLYEAKANGIELHAAHGYLLSQFLSPRVNKRTDQYGGNLEGRSRIVFEIIESIRKAVPDPKFIISIKINSADFADGGFDAEESFTMSKKLEAAGVGLIELSGGTYESSGFEHKKESTIARESFFIEFAERIRPHLSTARLAVTGGFRSSKAMAKAVEERSCDIVGLARPLCGEPHLCKHLLSGKQQKARDVHPDLPRQIEIGACVVQLNQIGHGATPCDTSTAEGAKFATDAVMRLREPEHDRMAVITTITVIHDHEAFLDRLQIYSADELLTTASSTTFSGVLDEPLATRLKIFCYFLASDESRTDALLSSDIPRPLLPLCLVLRYLILKEQKRLGESSKRFNWSLKQVHAAVASAFRAYTIHETLKADPTLTHLPSHLTYPDTYSVDPTTRDIHLESSIQLTLLSANRLAQSLLLCPTPFSAPPSAMVLGSLYHTIAQSTDETTREAIAAASSPIENAMLDWILFDTQDHLAIDVEALRKAKRERRKEEKRQQTAAEGEKRRAITAEQNVARSGFGLLQLDQDEAEEESAEEDQEQ

SEQ ID NO: 1650 - protein, 155 aa, Lycopersicon esculentum
MDLRLMGIDNTPLFHTLQHMMEAAGEDSVNAPPKKYVRDAKAMAATPVDVKEYPDSYVFVVDMPGLKSGDIKVQVEEDNVLLISGERKREEEKEGVKFIRMERRVGKFMRKFSLPENANTDAISAVCQDGSLTVTVQKLPPPEPKKSKTIQVKVA

SEQ ID NO: 1651 - protein, 221 aa, Glycine max
MSQESFIYSFVARGTMVLAEYTEFTGNFPAIAAQCLQKLPSSNNKFTYNCDHHTFNFLVEDGYAYCVVAKESVSKQISIAFLERVKADFKKRYGGGKADTAVAKSLNKEFGPVMKEHMKYIIDHAEEIEKLIKVKAQVSEVKSIMLENIDKAIDRGENLTILADKTETLHSQAQEFKKQGTHVRRKMWYQNMKIKLVVLGILLLLVLVIWLSVCHGFNCAN

SEQ ID NO: 1652 - protein, 377 aa, Oryza sativa
VGSRFAFVFVWSPAEAMERAAAGPLGMEMPIMHDGDRYELVKEIGSGNFGVARLMRNRASGDLVAVKYIDRGEKIDENVQREIINHRSLRHPNIIRFKEVILTPTHLAIVMEYASGGELFERICSAGRFSEDEARFFFQQLISGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPEDPKNFRKTIQKILGVQYSIPDYVHISPECRDLITRIFVGNPASRITMPEIKNHPWFMKNIPADLMDDGMVSNQYEEPDQPMQNMNEIMQILAEATIPAAGTSGINQFLTDSLDLDDDMEDMDSDLDLDIESSGEIVYAM

SEQ ID NO: 1653 - protein, 143 aa, Arabidopsis thaliana
  misc_feature (97)..(97): Xaa can be any naturally occurring amino acid
  misc_feature (104)..(104): Xaa can be any naturally occurring amino acid
MASSMLSSTAVVTSPAQATMVAPFTGLKSSASFPVTRKANNDITSITSNGGRVSCMKVWPPIGKKKFETLSYLPDLSDVELAKEVDYLLRNKWIPCXEFELEHXICVPVSTENTSIRLQILEFHCGTFKFLREGKGGPLPLIR

SEQ ID NO: 1654 - protein, 424 aa, Xylella fastidiosa
MSNSPQTPLATRQRLSEVRYEIRGELARRARELEAEGRKLIKLNIGNPGAFGFRAPEHLQRAIADDMGRTDPYTHQQGLPIAREAIAAAYVRRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQIDNLRNAMDLLGALRLCANVPGQYAIDAAVNGPDTITPLCSPGGPLYETRRAVIEACVVSEHLSLVVPAGALYAFPSVVGPAARHFDDYAFALELMNDEGVLVVPGSSFNVPYRDHFRVTLLPDAALIREVFSRIDRALSRRAEVAEKVVPLKSRSAAA

SEQ ID NO: 1655 - protein, 496 aa, Arabidopsis thaliana
MGLPGKNKGAVLSKIATNNQHGENSEYFDGWKAYDKDPFHLSRNPHGIIQMGLAENQLCLDLIKDWVKENPEASICTLEGIHQFSDIANFQDYHGLKKFRQAIAHFMGKARGGRVTFDPERVVMSGGATGANETIIFCLADPGDVFLIPSPYYAAFDRDLRWRTGVEIIPVPCSSSDNFKLTVDAAEWAYKKAQESNKKVKGLILTNPSNPLGTMLDKDTLTNLVRFVTRKNIHLVVDEIYAATVFAGGDFVSVAEVVNDVDISEVNVDLIHIVYSLSKDMGLPGFRVGIVYSFNDSVVSCARKMSSFGLVSSQTQLMLASMLSDDQFVDNFLMESSRRLGIRHKVFTTGIKKADIACLTSNAGLFAWMDLRHLLRDRNSFESEIELWHIIIDRVKLNVSPGSSFRCTEPGWFRICFANMDDDTLHVALGRIQDFVSKNKNKIVEKASENDQVIQNKSAKKLKWTQTNLRLSFRRLYEDGLSSPGIMSPHSPLLRA

SEQ ID NO: 1656 - protein, 656 aa, Burkholderia mallei
MCGITGFVGPVACAPQTARATLARMTDSLAHRGPDDTGLWIDHDAGVALGHRRLSIVDLSEHGHQPMLSACGRYAMTFNGEIYNFRQLRSELEREHRAPEWRGHSDSEVLLAAFCAWGVDRALQKAVGMFALALWNRESRVLTLARDRIGEKPLYYGRIGGSFVFGSELKALRRFPGFDAHPIDRDALCLYLRHASVPAPYTIYEGIRKLPPGTYAQLEDLAEAPAPRRYWSLERAIAAGRANPFDGDANAAVAQLDYVLRDAIAEQSVADVPLGAFLSGGVDSSVIVALMQTQTAQPVQTFTIGFHEAGYDEAGYAKAVARHLGTSHTELYVKPADVLATVPRMPCVYDEPFADSSQIPTLLVSELTRRHVKVSLSGDGGDELFGGYTRYFLTPRLWGRLRRVPAAVRMRIAAALHALRPDHADQIASLVQGAWSASAQRDASPRVGDRLHKLANVMTADSRASLYRLLMSSVHHPERFTLAGHEPQTLIDTPGAWPAGLSFAEQAMAVDTLTYLPTDILTKVDRAAMAVSLETRMPFLDHRVVEFAWRLPEALRIPDGQDKWLLRKLLYRYVPRPLIDRPKQGFCAPVGAWLRGELSDWAAELLRPARLRDEGYLDAARVERLWRQHQSGRMNWQHPLWTVLMFQAWLERQRAE

SEQ ID NO: 1657 - protein, 313 aa, Yarrowia lipolytica
MPIITETFKLNDGRSIPALGLGTASDANVEEVTYAAIKDGYKHIDTAYIYKSEEAIGKGIKRAIADGLIKREELFVTTKVWPTFHGRVKESLDYSLKDLGLDYVDLLLVHWPAALHPDPNDRHAYVPKNADGSAHYTDNNDWISIYEELEKEQAAGRTKSIGVSNVSEKYLKELLKRVKTVPAVNQFENHPYLPQKKEIEFNKKHGILVTAYSPLGSSNGKIKLHENPVVAEIAKKHNATTGSVLINWHISQGRSVIPKTRSVERVKANAQKVDLDSDDLAKLDKIWEQTGTQRAIGLDWLDKAGDNLGFEDK

SEQ ID NO: 1658 - protein, 549 aa, Unknown
  Mycobacterium sp. 'graecum DL049'
IRRNHFAMAKTIAYDEEARRGLERGLNSLADAVKVTLGPKGRNVVLEKKWGAPTITNDGVSIAKEIELEDPYEKIGAELVKEVAKKTDDVAGDGTTTATVLAQALVREGLRNVAAGANPMALKRGIEKAVEKVTETLLKSAKEVETKDQISATAAISAGDSQIGELIAEAMDKVGNEGVITVEESNTFGLQLELTEGMRFDKGYISGYFVTDAERQEAVLEEPYILLVSSKVSTVKDLLPLLEKVIQSGKPLLIIAEDVEGEALSTLVVNKIRGTFKSVAVKAPGFGDRRKAMLQDMAILTGGQVVSEEVGLSLETADVSLLGKARKVVVTKDETTIVEGAGDSDAIAGRVSQIRAEIENSDSDYDREKLQERLAKLAGGVAVIKAGAATEVELKERKHRIEDAVRNAKAAVEEGIIPGGGVALLQASKAAEIEGLEGDELTGAQIVLAACTAPLKQIAINAGLEGGVVAEKVAGLPAGQGLNAANDEYVDMVEAGIIDPAKVTRSALQNAASIAALFLTTEAVIADKPEPVKAPAGGGDMDGMGGMDF

SEQ ID NO: 1659 - protein, 369 aa, Mesorhizobium loti
MFAPFKLRDMKLQNRVVVSPMAQYKAVDGCPTDWHFTHYAERAKGGAGLIYIEMTCVSPEGRITPGCPGFYAPEHEVAWKRLVDFVHSETEAKICAQIGHSGAKGSTRLGWEGTDVPLASGNWPVMAASAVAWSPENQVPKAMDRADMDLVRNQFVVSAEMAERCGFDMLEIHAAHGYLLSSFITPVTNRRTDEYGGSLENRMRYPLEIFHAVRAAWPAEKPISMRISANDWVGIEGVTPADAVEIARLLHEAGVDICDVSAGQTSVSAKPIYGRMFQTPFSDRIRNEVGMATMAVGNIYEPDHVNSILMAGRADLVALARPHLADPYWTLHAAVTLGDRGVKWPDPYLPGRDQIYRLAERDAAAGLKV

SEQ ID NO: 1660 - protein, 349 aa, Pseudomonas syringae
MTTIFDPITLGDLQLPNRIIMAPLTRCRADEGRVPNAMMAEYYVQRASAGLILTEATSVTPMGVGYPDTPGIWSNDQVRGWSNITKAVHNAGGRIALQLWHVGRISHPSYLNGETPVAPSAIAAEGHVSLMRPITPLPVPRALELAEIGDIVEAYRVGAENAKAAGFDGVEVHGANGYLLEQFLLTGTNQRTDEYGGSVENRARLLLEVTDAVIDVWGAGRVGVHLSPRFDMHDMSDANRAETFSYVAKELGKRGIAFICAREHDAEDSLGPQLKKDFGGVYIANEKFTKDSANAWLAEGKADAIAFGVPYIANPDLPERLASDAPLNEAHPETFYAKGPVGYIDYPRL

SEQ ID NO: 1661 - protein, 401 aa, Cryptococcus neoformans
MSTSTRRHVLEDKLANHKADPNAAANAGQVQERTTKGSSSSAPRKVRFNVGNNYHVVDVIGEGAYGVVASAVHRPSGTKVAIKKIAPFDHSMFALRTLRELKLLKYFAEEGVSENIISVLDIIKPPSYDTFKEVYLVQELLETDLHRVIRTQDLSDDHCQYFLYQTCRALKALHSAEIIHRDLKPSNLLLNANCDLKVCDFGLARSTQTAFPAEGNNQGFMTEYVATRWYRAPEVMLSFRMYTKSIDVWSVGCILAEMLSGKPLFPGKDYHNQLALILDVLGTPTIDEFHAITSKRSKDYIRSLPFRKKRTFESIYPSANPLAIDFLRKTLTFDPRKRYTVEQCLAHPYLDAYHDPEDEPSAKPLPPSFFEFDMMKDDISREELKRLLYEEIMGFRPVLEG

SEQ ID NO: 1662 - protein, 541 aa, Clostridium thermocellum
MAKQIKFGEEARRALERGVNQLADTVKVTLGPKGRNVVLDKKFGSPMITNDGVTIAKEIELEDPFENMGAQLVKEVATKTNDVAGDGTTTATLLAQAIIREGLKNVAAGANPMLLKKGIAKAVDAAVEGIKEISQKVKGKEDIARVASISANDEVIGELIADAMEKVTNDGVITVEEAKTMGTNLEIVEGMQFDRGYVSPYMVTDTEKMEAVLDEPYILITDKKISNIQDILPLLEQIVQQGKKLVIIAEDVEGEALATLLVNKLRGTFTCVAVKAPGFGDRRKAMLEDIAILTGGQVITSDLGLELKDTTVEQLGRARQVKVQKENTIIVDGAGDPKEIQKRIASIKSQIEETTSDFDREKLQERLAKLAGGVAVIQVGAATETEMKEKKLRIEDALAATKAAVEEGIVAGGGTALVNVIPKVAKVLDTVSGDEKTGVQIILRALEEPVRQIAENAGLEGSVIVEKVKASEPGIGFDAYNEKYVNMIEAGIVDPAKVTRSALQNAASVASMVLTTESVVADIPEKETSGGPGGAGMGGMY

SEQ ID NO: 1663 - protein, 243 aa, Cucumis sativus
DDVGIPINYRHMEGFGVQAYSLINKSGKARLVKFHWKPTCGVKSMLEEEAIRIGGTNHSHATQDLYESIAAGNFPEWRLYIQTIDYDDQNNFDFEPLDTTIEWPEDVIPLQPVGRLVLNKNIDNFFAENEMLAFSMSLVPGIHYSDDKMLQARSFAYADTQRHRLGPNYLQLPVNAPKCPHHNNHHEGFMNFMHRDEEVNYFPSRYDPCRHAEKFPMPPNVLSGKRERCVIPKENHNFKHAGS

SEQ ID NO: 1664 - protein, 466 aa, Bacillus halodurans
MTKDTVTYRFPEGFWWGSATSATQTEGATHRDGKGKNIWDHWYEVEPSRFFQGVGPQDTSQFYERYKEDIQLMKEVGHNSFRFSISWSRLIPDGRGEVNPKGVEFYNNVIDELLGQGIEPFVNLFHFDMPMELQKIGGWANREVVDAYEAYAKTCFERFGDRVKKWFTHNEPIVPVEGGYLYDFHYPNEVDFEKAIQVGYHTVLSSAKAIRAYKQLNQGGKIGIILNLTPSYPRSNHPADLKAAKIADAFFNRSFLDPSVKGEFPEELVQILKEEGFMPIIEEEDLEIIRQHTVDLLGVNYYQPRRVKAKETLPNPDAPFMPERYFDHYAMPGRKMNVHRGWEIYEKGIYDILINLKEHYGNIECFISENGMGVEGEEKFRDENGVIHDDYRIEFIQDHLKWVHRAIQEGSNVKGYHLWTFMDNWSWANAYKNRYGLVSVNLDKNGERTIKKSGKWYKTLSENNGF

SEQ ID NO: 1665 - protein, 302 aa, Triticum aestivum
MVLSRAASDTDVSVHSTFASRYVRSSLPRYRMPENSIPKEAAYQIINDELMLDGNPRLNLASFVTTWMEPECDKLIMASINKNYVDMDEYPVTTDLQNRCVNMIAHLFHAPLGESETAVGVGTVGSSEAIMLAGLAFKRRWQNKRKAEGKPFDKPNIITGANVQVCWEKFARYFEVELKEVKLREGYYVMDPEQAVEMVDENTICVAAILGSTLNGEFEDVKRINDLLEEKNKQTGWETPIHVDAASGGFIAPFLYPELEWDFRLPWVKSINVSGHKYGLVYPGIGCCVWRTKEDLPDELIF

SEQ ID NO: 1666 - protein, 445 aa, Oryza sativa
NRPLWPARRTTRVGRYELGKTIGEGSFAKVKVARDTRTGDTLAIKVLDRNHVLRHKMVEQIKREISTMKLIKHPNVVQLHEVMASKSKIYMVLEYVDGGELFDKIVNSGRLGEDEARRYFHQLINAVDYCHSRGVYHRDLKPENLLLDSHGALKVSDFGLSAFAPQTKEDGLLHTACGTPNYVAPEVLADKGYDGMAADVWSCGIILFVLMAGYLPFDDPNLMTLYKLICKAKVSCPHWFSSGAKKFIKRILDPNPCTRITIAQILEDDWFKKDYKPPLFEQGEDVSLDDVDAAFDCSEENLVAEKREKPESMNAFALISRSQGFNLGNLFEKEMMGMVKRETSFTSQCTPQEIMSKIEEACGPLGFNVRKQNYKMKLKGDKTGRKGYLSVATEVFEVAPSLHMVELRKTGGDTLEFHNFYNNFSSELKDIVWKSESDAKAAKKR

SEQ ID NO: 1667 - protein, 645 aa, Bacillus anthracis
MSVINCEEVKRDEFHTEKYYESYNIFGAHIVTEDEMRGVRFTVWAPHAKAMSVVGDFNEWDYEQHKMLQVTEEGIWSLFIPHIEEREIYKYAIETMAGDVIFKADPYAVYAEVRPNTASVVFDIKGYEWNDKNWSRKKKKKSVYKEAMTVYELHFGSWKKKEDGTLYSYREMAEELIPYVVEHQFTHIEIMPLVEHPYDRSWGYQGTGYYAATSRFGTPHDLMHFVDECHKYGIGVILDWVPGHFCKDAHGLYLFDGTPTYEYKDKDVQENPVWGTVNFDLGKREVRNFLISNALFWMRYFHIDGFRVDAVANMLYWNKEGQEQSNEHAVSFLRELNEAVFAEDEDFLMTAEDSTAWPLVTAPTYEGGLGFNYKWNMGWMNDVLKYMECAPEYRKYIHDKMTFSLLYAYSENFILPLSHDEVVHGKKSLLNKMPGDYWDKFAQLRLLYGYFFTHPGKKLLFMGGEFGQFDEWKDLEDLDWNLHDFEMHRYMHDYFKELIALYKRSKPLWQLDHSREGFQWIDANNNEQSIFSFIRQGDKQEDALVVVCNFTKATYENYKVGVPDFEYYNEVLNSDAEQYGGSGQVNKKRLKTFQEPYHNQTAHVEITIPPFGVSILRPVKTRKGSKKQDGSKTKVRSNVTSRGKR

SEQ ID NO: 1668 - protein, 337 aa, Thermoanaerobacter tengcongensis
MSILHTPLKIKDITIKNRIMMSPMCMYTASTEGMPNDWHIVHYATRAIGGVGLIMQEATAVESRGRITDRDLGIWNDEQAEELKKIVDICKANGAVMGIQLAHAGRKCNIPYEDVVGPSPIKAGDQYKLPRELTIDEIKSIVKAFGEAAKRANLAGYDVVEIHAAHGYLIHEFLSPLSNKRKDEYGNSIENRARFLIEVIDEVRKNWPQNKPIFVRVSADDYIEGGINIDMMVEYINMIKDKVDVIDVSSGGLLNVDINPYPGYQVKYAETIKKRCNIKTCAVGLITTQELAEEILSNERADLVALGRELLRNPYWVLHTYTSKEDWPKQYERAFKN

SEQ ID NO: 1669 - protein, 115 aa, Zea mays
  misc_feature (98)..(98): Xaa can be any naturally occurring amino acid
  misc_feature (100)..(100): Xaa can be any naturally occurring amino acid
HASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVXAXVYLMLVNDLIHGLYP

SEQ ID NO: 1670 - protein, 775 aa, Schizosaccharomyces pombe
MEKLATPFFYLNKKETKHSDWVEPFTTFVSRIYGNSVDVEDQIKAFNTLRENAADVDDTVAGKDILYSYYGQLDYLSFRFPTGGNGINISFEWSDILDPDADFVKQSSLAFEKASVLFNLVSLLSRMAANHASAYTVDDYKAAANCLQCASGIAKLLRESFIHAPGRDLDSNFLLGIYNLFLGQAQECVLGHMSFSASDSNMNYSLAAKIASSAATLYDSCVHAFESMEPACNPNFIRLASAKKAALEGFSSYFMARAQLEKSKQGLAIGYLQQAKSILSSAQKLFNGIKLSTDFIHKPSLSDYPQTISTFIKSSLSHLLKTAEKDNDFVFHDLVVKEVELPKISPLQALPPLPLEKLYGSQDGFETAKKIVGDDLFKAFVPSAVTTASSLYSEETAKVFRAEQAEVERQNTQMATVFASLDLSRLQEITHSDSKTNFIPKELIEARSQLISFNPTFKIHELFAKSTKLKQIIAKIKSDLEVEANENAKMKAKLGPSWTLSDSLEFAAPYQSELNNYLKTLAEASATDSAISQQYALVKDDVETLCNSSKISALLESSISSTDNSGQSLLDIPIEQEEQERDMKIQLDLLEELQSRVQKLVPERQTTLQALQQKCLQDDISESLMQNSKRKDSALDTNQLFELELKKFDPLRNRLHASYRQQQLLLNEMRNVTQKLKQNPEFLRKMEVYNNQFSKNKELCSNLLSSSLTAKAISEGVSKGLEYYKTVEQRLAEINKTLGEQLLLRRKQGATCLSKLSSSSSSHTSISSNMRNLHI

SEQ ID NO: 1671 - protein, 135 aa, Ananas comosus
MADEQPKKPVPAAEEAPAAEAEAEEEEGLHLEDDQEPREHPIMGGIYDAPLNNENGFDKEDLARFAVREYNNKNNALLEFVRVVKAKEQVVSGMMHYLTVEVNDAGKKKLYEAKVWEQVWMNFRQLQEFTYLGDA

SEQ ID NO: 1672 - protein, 477 aa, Bacillus halodurans
MSKHSFPEGFLWGGAIAANQAEGAYLEDGKGLTLVDLLPTGQKRWDVMLGKLDSFTPLEGEFYPSHEAIDFYHRYQEDVALLAEMGFKAFRLSISWARIFPNGDDPEPNEKGLQFYDDLFDELLKYNIQPVVTMAHFDVPVHLIESYGGWRSRKLVGLFETYAKTILSRYKDKVKYWMTFNEINMLLHLPFVGAGLVFKEGENKKQIQYQAAHHQLVASSLAVKACHELIPDAKIGCMLAAGATYPYTCHPNDVFEAMTKDRESFFFIDVQSRGEYPGYAKRFFRDHNIVIDMEEGDEALLKNHTVDYIGFSYYASRVTSTDPEVLKNITSGNVFGSVENPYLEKSEWGWTIDPKGFRTTANQLYDRYQKPLFVVENGLGAVDDVTLEGEINDEYRIDYLRKHIAEMAEAIADGVDIIGYTSWGPIDVVSASTGEMKKRYGYIYVDRDNEGKGSLKRMKKKSFHWYKKVIETNGEKR

SEQ ID NO: 1673 - protein, 251 aa, Escherichia coli
MNLNSIPAFDDNYIWVLNDEAGRCLIVDPGDAEPVLNAIAANNWQPEAIFLTHHHHDHVGGVKELVKKFPQIVVYGPQETQDKGTTQVVKDSETAFVLGHEFSVIATPGHTLGHICYFSKPYLFCGDTLFSGGCGRLFEGTPSQMYQSIKKLSALPDDTLVCCAHEYTLSNMKFALSILPHDLSINDYYRKVKELRAKNQITLPVILKNERQINVFLRTEDIDLINVINEETLLQQPEERFAWLRSKKDRF

SEQ ID NO: 1674 - protein, 256 aa, Phaseolus vulgaris
MDATTPSELPPGFRFHPTDEELIVYYLCNQATSKPCPASIIPEVDLYKFDPWELPDKTEFGENEWYFFSPRDRKYPNGVRPNRATVSGYWKATGTDKAIYSGSKLVGVKKSLVFYKGRPPKGDKTDWIMHEYRLAESKQPVNRKIGSMRLDDWVLCRIYKKKNTGKTLEHKETHPKVQMTNLIAANNDEQKMMNLPRTWSLTYLLDMNYLGPILSDGSYCSTFDFQISNANIGIDPFVNSQPVEMANNYVSDSGKY

SEQ ID NO: 1675 - protein, 220 aa, Oryza sativa
MALDGKPPVPPPSTPPMDSWACGGRRSKRRGGGGGSSGGSGSSGGGGGGESEEEYLAACLLMLAHGVRDEAEVVGVAAATAKPQHGYECSVCGKVYGSYQALGGHKTSHRKPPSPAAEPAAGEEPSSGGVAGEAKVHRCSICLRTFPSGQALGGHKRLHYEGGAVGDAVKEKNSLKTKAAVATAVLKDFDLNLPAAATTAGDEAESSPPEAKRARLLLLV

SEQ ID NO: 1676 - protein, 544 aa, Neisseria meningitidis
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVDELKNIAKPCDTSKEIAQVGSISANSDEQVGAIIAEAMEKVGKEGVITVEDGKSLENELDVVEGMQFDRGYLSPYFINDAEKQIAALDNPFVLLFDKKISNIRDLLPVLEQVAKASRPLLIIAEDVEGEALATLVVNNIRGILKTVAVKAPGFGDRRKAMLQDIAILTGGVVISEEVGLSLEKATLDDLGQAKRIEIGKENTTIIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIEMGVLDPAKVTRSALQHAASIAGLMLTTDCMIAEIPEDKPAVPDMGGMGGMGGMM

SEQ ID NO: 1677 - protein, 425 aa, Xylella fastidiosa
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAISVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKSRSAAA

SEQ ID NO: 1678 - protein, 555 aa, Unknown
  secondary endosymbiont of Bemisia tabaci
MAAKDLKFGNDARKKMLKGVNILANAVKVTLGPKGRNVVLDKSYGAPSITKDGVSVAREIELEDKFENMGAQMVKEVAFKANDAAGDGTTTATVLAQSIVTEGLKAVAAGMNPMDLKRGIDKAVEAAVEELKIIPKPCKDSKEIAQVGTISANADAKVGKLISDAMKRVTNEGVITVEEASGLEDDLIVVEGMQFDRGYLSPYFINKQESSSIEFDNPYILLVDKKISNIRDMLSILEVVAKEGKPLLIIAEDVEGEALATLVVNTMRGIVKVSAVKAPGFGDRRKEMLQDIAVLTHGHVISEETGDSLEKATKENLGNAKRVVITKDATTIIDGAGEKSKIEARIQNIKKQIENATSDYDKEKLQKRVAKLSGGVAVIKVGAPTEIAMKEKKARVEDALQATRAAVEEGVVPGGGVALIRVASKIANSSLKGDTEDQNVGIRVALRAMESPLRQIVVNAGEEASVIANKIKENKGNDNYGYNAQTEAYGDMIEMGILDPTKVTRSALQYAASIAGLMITTECMVTDLPKEEKASDMGAGGMGGIGGMGGMNGMM

SEQ ID NO: 1679 - protein, 547 aa, Pseudomonas syringae
MAAKEVKFGDSGRKKMLAGVNVLADAVKATLGPKGRNVIIEKSFGAPLITKDGVSVAKEIELKDRFENMGAQLVKDVASRANDDAGDGTTTATVLAQAIVNEGLKAVAAGMNPMDLKRGIDKATIAIVAELKKLSKPCTDTKAIAQVGTISANSDHSIGDIIAEAMEKVTKDGVITVEEGSGLENELSVVEGMQFDRGYLSPYFINKPDTMVAELDSPLLLLVDKKISNIREMLPVLEAVAKAGRPLLIVAEDVEGEALATLVVNNMRGIVKVAAVKAPGFGDRRKAMLQDIAVLTGGTVISEEIGLSLETTTLEHLGNAKRVILNKENTTIIDGAGVKTDIDSRISQIRQQIGDTSSDYDKEKLQERLAKLSGGVAVIKVGAGSEVEMKEKKARVEDALHATRAAVEEGVVPGGGVALVRSLQAIEGLKGDNADQDVGIALLRRAVEAPLRQIVANSGDEPSVVVDKVKQGSGNYGYNAASGEYGDMIEMGILDPAKVTRSALQAASSIASLMITTEAMIADVPEDKPAGGGMPDMGGMGGMGGMM

SEQ ID NO: 1680 - protein, 555 aa, Unknown
  secondary endosymbiont of Bemisia tabaci
MAAKDLKFGNDARKKMLKGVNILANAVKVTLGPKGRNVVLDKSYGAPSITKDGVSVAREIELEDKFENMGAQMVKEVAPKANDAAGDGTTTATVLAQSIVTEGLKAVAAGMNPMDLKRGIDKAVEAAVEELKIISKPCKDSKEIAQVGTISANADAKVGKLIPDAMKRVTNEGVITVEEASGLEDDLIVVEGMQFDRGYLSPYFINKQESSSIEFDNPYILLVDKKISNIRDMLSILEVVAKEGKPLLIIAEDVEGEALATLVVNTMRGIVKVSAVKAPGFGDRRKEMLQDIAVLTHGHVISEETGDSLEKATKENLGNAKRVVITKDATTIIDGAGEKSKIEARIQNIKKQIENATSDYDKEKLQERVAKLSGGVAVIKVGAPTEIAMKEKKARVEDALQATRAAVEEGVVPGGGVALIRVASKIANSSLKGDNEDQNVGIRVALRAMESPLRQIVVNAGEEASVVANKIKENKGNDNYGYNAQTEAYGDMIEMGILDPTKVTRSALQYAASIAGLMITTECMVTDLPKEEKASDMGAGGMGGIGGMGGMSGMM

SEQ ID NO: 1681 - protein, 546 aa, Pseudomonas putida
MAAKDVKFGDSARKKMLVGVNVLADAVKATLGPKGRNVVLAKSFGAPTITKDGVSVAKEIELKDAFENMGAQLVKEVASKANDAAGDGTTTATVLAQAIVNEGLKAVAAGMNPMDLKRGIDKATAAVVAELKNLSKPCADSKAIAQVGTISANSDNSIGEIIAEAMEKVGKEGVITVEEGSGLENELSVVEGMQFDRGYLSPYFVNKPDTMVAELEGPLLLLVDKKISNIRELLPVLEAVAKAGRPLLIVAEDVEGEALATLVVNNMRGIVKVAAVKAPGFGDRRKAMLQDIAVLTGGQVISEEIGLSLETATLEHLGNAKRVILSKENTTIIDGAGADTEIEARVKQIRAQIEETSSDYDREKLQERLAKLAGGVAVIKVGAGTEVEMKEKKARVEDALHATRAAVEEGVVPGGGVALVRALAAIIDLKGDNEDQNVGIALLRRAVESPLRQITANAGDEPSVVADKVKQGSGNFGYNAATGEYGDMIEMGILDPAKVTRSALQAAASIGGLMITTEAMVADLPEDKPAAGMPDMGGMGGMGGMM

SEQ ID NO: 1682 - protein, 551 aa, Kineococcus radiotolerans
MTDVASQSSAPGDERPVLTNRQGHPVYDNQNQRTVGARGPATLENYQFLEKISHFDRERIPERVVHARGTTAFGYFEAYGSFGDEPISKYTRAKLFQEKGKRTDLAIRFSTVAGGRDSAETLRDPRGFAVKMYTEDGNWDLVGNNLGVFFIRDAIKFPDFIHSQKPDPVTFDRQVPNRVFDFASQTPESLHMFTLVFSPRGIPASYRTQQGFGVNTYKWVNSEGETVLVKYHWHPKQGVKSWTSADAAAVQAQDLGPHTRDLYAAIDAGDYPEWELLVQTMSDEEHPELDFDPLDDTKVWPENLFPLTPIGKMVLNRKPVDFFTESEQIAFGTGVLVDGLDFSDDKMLVGRTFSYSDTQRYRVGPNYLQLPVNAAKVPVRTNQRDGQMAYGVDGRGENPTVNYEPSIIGGLREGTYPTHDEQGPVITGRVTRKRIPRTNDYQQAGERFQLSEDWEKDELVANFVDALSQCIRPIQERMVWHMFMADDEYGRRVGEGLGITADDVRHLEPLQTQTLTEEELQRAANLGKNGPRDVTGLVMTHAVPNERDVRA

SEQ ID NO: 1683 - protein, 154 aa, Zea mays
  misc_feature (125)..(125): Xaa can be any naturally occurring amino acid
MSLVRRSSVFDPFSVDLFDPFDSMFRSIVPPSLSSSAASETAAFASARIDWKETPEAHVFKADLPGVKKEEVKVEVEDGNVLLISGQRSREKEDKGDKWHRVERSSGQFVRRFRLPENAKTEEVXAALENGVLTVTVPKAEVKKPEVKSIQISG

SEQ ID NO: 1684 - protein, 682 aa, Pisum sativum
MSSGGCSIVWFRRDLRVEDNPALAAGVRAGAVVGVFIWAPEEEGQYYPGRVSRWWLKNSLSQLDSSLRNLGTPLVTKRSTDSISSLLEVVKSTGATQIFFNHLYDPLSLVRDHRAKEILTAQGITVRSYNSDLLYEPWDVNDEHGQPFTTFDSFWERCLSMPYDPQAPLLPPKRIIPGDVSRCPSDTLVFEDELEKSSNALLARAWSPGWSNANKALTTFINGPLIEYSVNRRKADSATTSFLSPHLHFGEVSVKKVFHLVRIKQVFWANEGNKAGEESVNLFLKSIGLREYSRYISFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRTAAENGTEEGLGDSTESAPIAFPQDIQMEERHEPVRNNPPHGTRRYQDQMVPSMTYSRVRVEDEETSSVRNSAGDSRAEVPTNANTQQNGREPMDQGMLQNVNRNTRQRRNNTTTTFWLRNAAEDSTAESSSSTRRERDGGVVPEWSPQASNFSDQFVDDENGIGATSPYLQRHPQTHQMMSWTRLPQTG

SEQ ID NO: 1685 - protein, 162 aa, Triticum aestivum
  misc_feature (61)..(62): Xaa can be any naturally occurring amino acid
  misc_feature (72)..(72): Xaa can be any naturally occurring amino acid
  misc_feature (87)..(87): Xaa can be any naturally occurring amino acid
  misc_feature (94)..(94): Xaa can be any naturally occurring amino acid
  misc_feature (108)..(108): Xaa can be any naturally occurring amino acid
  misc_feature (117)..(117): Xaa can be any naturally occurring amino acid
QYYQLIRLGFEGYKNIMENCQENATVLKQGLEKTGKFNIVSKDNGVPLVAFSLKDSSRHSXXEISDFLRRFXGWARAGYTIPPNAQXVTVLRRXIREDSNRTSPERLXVLHIEKVLXHQLDPLPPFSQAGTTRVAGRSTKRKWRTTQVFPWKRLPHQEDASL

SEQ ID NO: 1686 - protein, 1390 aa, Cryptococcus neoformans
MSLPDAYPPVIATEGSTAFQSHILSLLSVISQHPSPDYPFPSSGDSTLQDNASVTAKKNATLSTFPGKKTPAEDAIERAIIALGDRVWTSERTQAHLVKDVKRDVPAQPGSDLLTPDWTPPVPTLNDSSPDPVCPTCTRPVSSSETSSFTPQQIASFYHPFTAALSTPPPPLPEQMFFPQSVLAAYVSATSDSESAGDSGMSAEKELELLKAQVQDIARVCKAVATGDLTQKIIVPVKGQTMTELKNIINAMVDRLQTFAVEVERVSLEVGTEGKLGGQAVVPNVEGTWKVLTAVVNKLAANLTNQVRSIAKVTKAVAKGDLSETIDVEASGEIAELKTTVNGMVMSLRTLADEVSRVSLEVGSQGKLGGQANVPDVEGVWKDLTVNVNRMCESLTTQVRSIGSVTTAVARGDLSKMIEIEAEGEMAVLKNTVNSMVRQLTVFAKEVTRVALEVGTHGQLGGQAVVPGVEGVWDDLTTNVNKMARNLTDQVREIAMVTKAVARGDLSKTVNADVQGEILDLKCTVNEMLTNMPCKVAQLTVFAAEVTRVSLEVGTEGKLGGQAVVPNVEGTWMVLTDNVNLMALNLTTQVRSVAEVTTAVAAGDLSKKINVAAFGEILELKNTVNNMVDSLRSFSSEVTRVAREVGTDGRLGGQAKVPGVAGTWKDLTDCVNIMAANLTEQVRTIAHATTAVARGDLTQKVVGVKVSGEILDLVNTINNMIDQLAIFAAEVTRVAREVGTEGKLGVQAEVENIEGTWQEITSNVNTMASNLTSQVRAFAQISAAATDGDFTRFITVEASGEMDSLKTKINQMVYNLRESIEKNTKARQEAEMANRSKSEFLANMSHEIRTPMNGIIGMTVLTLESELTRQQRENLMIVSSLAGSLLTIIDDILDISKIEAGRMTMEQIPFSLRVAVFSVLKTLCVKAAQNKLDLIFDVDPTMPDQLIGDPLRLRQVITNLIGNAVKFTTKGQVALSCRVKRYVTVADAVELEFCVADTGIGIKQDKLDVIFDTFAQADGSTTRKYGGTGLGLTISKRLVNLMSGDLWVESEYGQGSRFYFTTVAEMTSVPRDQIIERLSPWSGRSVLFIDTLGDQTGIVEMLQELGLKPIVIHSVNDVYLLQDQGLTVFDTMIVDSLKAAGELRGIEYLRYIPIVLLAPSNKPSGPSNPSFISLPESRRRLLALPSASEQLLSPIPVKDCLEMGINTYYTTPLSLQELSNAIVPALESHQIQPGDTVKDTILSVLLAEDNLVNQKLAVKLMEVAGHKIEVADNGEIALEKYKRRQLARTPFDVILMDVSMPVMGGMEATGLIREFEANEGVPRTPIIALTAHAMIGDKERCLAAGMDEYVTKPLRRGDLLASIAKVLAPKQSASGLEMPTVPIPANIYGR

SEQ ID NO: 1687 - protein, 682 aa, Pisum sativum
MSSGGCSIVWFRRDLRVEDNPALAAGVRAGAVVGVFIWAPEEEGQYYPGRVSRWWLKNSLSQLDSSLRNLGTPLVTKRSTDSISSLLEVVKSTGATQIFFNHLYDPLSLVRDHRAKEILTAQGITVRSYNSDLLYEPWDVNDEHGQPFTTFDSFWERCLSMPYDPQAPLLPPKRIIPGDVSRCPSDTLVFEDELEKSSNALLARAWSPGWSNANKALTTFINGPLIEYSVNRRKADSATTSFLSPHLHFEEVSVKKVFHLVRIKQVFWANEGNKAGEESVNLFLKSIGLREYSRYISFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRTAAENGTEEGLGDSTESAPIAFPQDIQMEERHEPVRNNPPHGTRRYQDQMVPSMTYSRVRVEDEETSSVRNSAGDSRAEVPTNANTQQNGREPMDQGMLQNVNRNTRQRRNNTTTTFWLRNAAEDSTAESSSSTRRERDGGVVPEWSPQASNFSDQFVDDENGIGATSPYLQRHPQTHQMMSWTRLPQTG

SEQ ID NO: 1688 - protein, 484 aa, Glycine max
MGLMDVDQTQLLSKMVIGDGHGEASPYFDGWKAYDENPFHPKENPNGVIQMGLAENQLTSDLVEDWILNNPEASICTPEGINDFRAIANFQDYHGLPEFRNAVAKFMGRTRGNRVTFDPDRIVMSGGATGAHEVTTFCLADPGDAFLVPIPYYPGFDRDLRWRTGIKLVPVMCDSSNNFKLTKQALEDAYEKAKEDNIRVKGLLITNPSNPLGTVMDRNTLRTVMSFINEKRIHLVSDEIYSATVFSHPSFISIAEILEEDTDIECDRNLVHIVYSLSKDMGFPGFRVGIIYSYNDAVVHCARKMSSFGLVSTQTQYLLASMLNDDEFVESFLVESAKRLAQRHRVFTGGLAKVGIKCLQSNAGLFVWMDLRQLLKKPTLDSEMELWRVIIDEVKINVSPGSSFHCTEPGWFRVCYANMDDMAVQIALQRIRNFVLQNKEIMVPNKKHCWHSNLRLSLKTRRFDDIMMSPHSPIPQSPLVKATI

SEQ ID NO: 1689 - protein, 229 aa, Magnolia praecocissima
MARGKIQIKKIDNVTARQVTFSKRRRGLFKKAEELSILCDAEVALIIFSATGKLFEYSSSSMKEIIERHTMHSKNLQKLDQQPSLELQLENSNYNRLSKQVAEKSHLIRQMRGEDIQGLTVEELQKLEKTLETGLSRVMERKAEQIMKEISGLQIKGVKLMEENMRLRQRIIEMSRGDSKGDRQIIESEIVVNEDGQSSDSVTNACNSGAPQDYESSDTSLKLGVPFSS

SEQ ID NO: 1690 - protein, 503 aa, Zea mays
MEGAGRDANPLGGYRIGKTLGIGSFGKVKIAEHILTGHKVAIKILNRRKIRSMEMEEKVKREIKILRLFMHPHIIRLYEVIDTPADIYVVMEYVKSGELFDYIVEKGRLHEEEARRFFQQIISGVEYCHRNMVAHRDLKPENLLLDSKCNIKIADFGLSNVMRDGHFLKTSCGSPNYAAPEVISGKLYAGPEVDVWSCGVILYALLCGTLPFDDENILNLFKKIKGGIYTLPSHLSPSARDLIPRMLVVDPMKRITIREIREHVWFKIQLPRYLAVPPPDTAQQVKKLDEETLNDVIKMGFDKNQLIESLHNRLQNEATVAYYLLMDNRLRTTSGYLGSEFQESMDPSFSQVHAETPTSATEHRQHVFTESPGSGLRQHFASERKWALGLQSRAHPREIISEVLKALQELNVYWKKIGHYNMKCRWSPGCLESMMHNCDGFSAESAIIETDDLIAKSTRIVKFEIQLYKTRDEKYLLDLQRVSGPQLLFLDLCSAFLTQLRVL

SEQ ID NO: 1691 - protein, 204 aa, Euphorbia esula
MASSLAIKRLVSSNLIPSSLRVIRPCVAAQPSSRLFNTNAVRQVDDIDEDDRRIDGPLYGRGGDFLSDVVNPFWPSTNLSRMLNVMEPFIENPFVSRGMSAGIRRNWDARETEDALNLRVDMPGLDKKDVKVSVEKNTLIIKGEGEKESEDEESGRKYSGRIDLPEKMFKTDEIKAEMKNGVLKVVVPKVKEDERADVFHVKIE

SEQ ID NO: 1692 - protein, 373 aa, Zea mays
MDSSGGGGGGAQIKGMATHGGRYVLYNVYGNLFEVSSKYAPPIRPIGRGAYGIVCAAVNSQSGEEVAIKKVGNAFDNHIDAKRTLREIKLLRHMDHENILALKDVIRPPTRENFNDVYIVTELMDTDLHQIVRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSPGAVDLLERMLVFDPSRRITVDEALHHPYLASLHEINDEPTCPAPFSFDFEQPSFTEAHIKELIWRESLAFNPEPPY

SEQ ID NO: 1693 - protein, 798 aa, Xanthomonas oryzae
MSGARLPHVPPAWPAGGDAARSDAASQRLGRGGQQISLSLRTHRCNRACACDGVMSERQGVQEQDREADGVTTEGISEMSQTLQALADGLPVDAFAVLGPHPLADGRRQVRVLAPGAEAMGLIDSRGKLLARMQASAIDGVFEGILSIEGPYRLRIVWPDMVQEIEDPYAFAVTLDESLLLQIAAGDGQALRRALGAQHVQCGEVPGVRFAVWAPHAQRVAVVGDFNGWDVRRHPMRQRIGGFWELFLPRVEAGPRYKYAVTAADGRVLLKADPVARQTELPPATASVVPGTDTFAWTDAAWMAKRDPSAVPAPLSIYEVHAASWRRDGHNQPLDWPTLAEQLIPYVQQLRFTHIELLPITEHPFGGSWGYQPLGLYAPTARHGSPDGFAQFVDACHRAGIGVILDWVSAHFPDDAHGLAQFDGAALYEHADPREGMHRDWNTLIYNYGRPEVTAYLLGSALEWIDHYHLDGLRVDAVASMLYRDYGRAEGEWVPNAHGGRENLEAVAFLRQLNREIAAHFPGVLTIAEESTAWPGVTAAISDGGLGFTHKWNMGWMHDTLSYMQRDPAERAHHHSQLTFGLVYAFDERFVLPISHDEVVHGTGGLLGQMPGDDWRRFANLRAYLALMWAHPGDKLLFMGAEFGQWADWNHDQSLDWHLLEGARHRGVQLLVGDLNATLRRTPALYRGTHRAKGFDWSVADDARNSVLAFIRHDPDGGGVPLLAVSNLTAQPLHDYGVGVPRAGAWREILNTDSAHYGGSNLGNSGRLATEPMGMHGHAQRLRLTLPPLATIYLQAEK

SEQ ID NO: 1694 - protein, 155 aa, Arabidopsis thaliana
MSLIPSFFGNNRRINNNIFDPFSLDVWDPFKELQFPSPSSSAIANARVDWKETAEAHVFKADLPGMKKEEVKVEIEDDSVLKISGERHVEKEEKQDTWHRVERSSGGFSRKFRLPENVKMDQVKASMENGVLTVTVPKVETNKKKAQVKSIDISG

SEQ ID NO: 1695 - protein, 585 aa, Xanthomonas oryzae
MNQRTAITPVWGAWPAGEGQVRFALWAPAAKNVDVVFDTGARSALQAGQDGFFSAVIDCAPGARYRYSIDGGEPVPDPASRWQPEGVHGPSAVQPTDGHAWQNTRWQGRPWDQAVIYELHVGTCGGYAGVQAQLPQLAAMGITAIELMPLSAFPGAHNWGYDGVLPYAPVEAYGTPDDLKALIDAAHGHGLMVLLDVVYNHFGPDGNYLHSYAAPFFNEDKPTPWGAAIDFRKPPVQRYFLDNALMWLHEYGFDGLRLDAVHAISPNAFLDTLRETIETSLPAGRHVHLVLENEANQASQLQRGYTAQWDDDFHNALHVLLTGEEEGYYAAFADKPTEHLARVLGEGFAYQGEPDPRGHVRGEPSGALPPHKFVVFAQNHDQIGNRARGERLSVLVLPQRLRAALALTALTPMIPLFFMGEPWGAKQPFLFFTDFGPPLDEAVREGRRREFAHFAAFADAAQRATIPDPNSHSTFAASRSPIADATHGDGAQWAAWFKALLDVRRQWLVPGVAQARAVRASVLADGALTGTWQLPGGLWHIAFNVGTQAVPMPPLRGRVAHVENVAADTQELPVDGFIAWYEPQS

SEQ ID NO: 1696 - protein, 463 aa, Lactobacillus plantarum
MTMVEFPEGFVWGAATSGPQTEGNFHKQHQNVFDYWFATEPEQFDAGVGPDTASNFYNDYDHDLALMAQAGVQGLRTSIQWTRLIDDFETASLNADGVAFYNHVIDSMLAHHITPYINLHHFDLPVALYDKYHGWESKHVVELFVKFAEQCFKLFGDRVDHWYTFNEPKVVVDGQYLYGWHYPQVINGPKAVQVAYNMNLASAKTVARFHELCVRPEQQIGIILNLTPAYAASDDPADLAAAEFAELWSNNLFLDPAVLGHFPEKLVERLTMDGVLWDATPTELAIIAANPVDCLGVNYYHPFRVQRPDISPKSLQPWMPDIYFKEYDMPGRMMNVDRGWEIYPQAMTDIARNIQKNYGNIPWMISENGMGVAGEERFLDKQGVVQDDYRIDFMKEHLTALAKGIAAGSNCQGYFVWSGIDCWSWNHAYHNRYGLIRNDIHTQTKTLKKSAKWFAELGERNGF

SEQ ID NO: 1697 - protein, 305 aa, Bordetella parapertussis
MGHGVIIRENVLQECRIFHPVRFVNTREGFMAQVPVLKLNDGNAMPQLGLGVWQVPNDQAAASVKAALAAGYRSIDTAAIYGNEAGVGEGLRAAGVARKDLFVTTKLWNDRHGYDEAQRAMDESLRKLGLAYVDLFLIHWPVAGSDKFVDAWRAMVAMKEDGRARSIGVSNFTIANLRRLVDETGVVPAVNQVELHPGFAQRELRAFHAEQGIATESWSPLGQGAVMHDATLAGIAARHGKSAAQVTLRWHLQNGLIVIPKSVTPARIQANIDVFDFELSADEMADIDALPEGPRLGPDPATFTG

SEQ ID NO: 1698 - protein, 720 aa, Xanthomonas oryzae
MATRKFTQRSRIREGRPNSLGATWDGLGVNFALYSRNATRVELCLFDDRGREQERIALPEYTDEVWHGYLPDARPGQLYGYRVHGPYAPDAGHRFNHNKLLLDPYAKQIVGELKWAPHLFGYIIGHRDKDLSFDRRDSAAFMPKSAVIDPAFTWGQDRPPQTPWNRTVIYEAHVRGLSMLHPAVPPEERGTFSALKTDELIDHISSLGVTAVELLPVHAFVDDQYLLENGLRNYWGYNTLGFFAPQARYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFNHSGRRPTASVNFVTAHDGFTLRDLVSYEGKHNLANGEDGRDGSDHNISCNYGVEGETNDPTIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPDGHEMDEAGWHDPEARALMLRLDGRSPATGLREIAANVTLLMLINAASTSVSFTLPAMHDEHWRVLVDTARHGGRVVAGGSEWKASAHSLTLLAVERDRIISSARIVSEGAR

SEQ ID NO: 1699 - protein, 555 aa, Unknown
  secondary endosymbiont of Bemisia tabaci
MAAKDLKFGNDARKKMLKGVNILANAVKVTLGPKGRNVVLDKSYGAPSITKDGVSVAREIELEDKFENMGAQMVKEVASKANDAAGDGTTTATVLAQSIVTEGLKAVAAGMNPMDLKRGIDKAVEAAVEELKIISKPCKDSKEIAQVGTISANADAKVGKLISDAMKRVTNEGVITVEEASGLEDDLIVVEGMQFDRGYLSPYFINKQESSSIEFDNPYILLVDKKISNIRDMLSILEVVAKEGKPLLIIAEDVEGEALATLVVNTMRGIVKVSAVKAPGFGDRRKEMLQDIAVLTHGHVISEETGDSLEKATKENLGNAKRVVITKDATTIIDGAGEKSKIEARIQNIKKQIENATSDYDKEKLQERVAKLSGGVAVIKVGAPTEIAMKEKKARVEDALQATRAAVEEGVVPGGGVALIRVASKIANSSLKGDNEDQNVGIRVALRAMESPLRQIVVNAGEEASVIANKIKENKGNDNYGYNAQTEAYGDMIEMGILDPTQVTRSALQYAASIAGLMITTECMVTDLPKEEKASDMGAGGMGGIGGMGGMNGMM

SEQ ID NO: 1700 - protein, 545 aa, Sodalis glossinidius
MAAKDVKFGNDARVKMLRGVNVLADAVKVTLGPKGRNVVLDKSFGAPVITKDGVSVAREIELEDKFENMGAQMVKEVASKANDAAGDGTTTATVLAQSIVNEGLKAVAAGMNPMDLKRGIDKAVIAAVEELKKLSVPCSDSKAIAQVGTISANADETVGTLIAEAMAKVGKEGVITVEEGSGLQDELDVVEGMQFDRGYLSPYFVNKPETGAVELESPFILLADKKISNIREMLPVLEAVAKAGKPLLIIAEDVEGEALATLVVNTMRGIVKIAAVKAPGFGDRRKAMLRDIAILTAGTVISEEIGLELEKATLEDMGQAKRVVITKDTTTIIDGEGDKALIDSRVTQINQQRDEATSDYDREKLQERVAKLAGGVAVIKVGAATEVEMKEKKARVEDALHATRAAVEEGVVAGGGVALIRVANRIAELRGDNEDQNVGIKVARRAMEAPLRQIVANAGEEPSVIANKVKAGEGNTGYNAATEEYGNMIDMGILDPTKVTRSALQYAASIAGLMITTECMVTDLPKEDKPDLGGAGGMGGMGGMM

SEQ ID NO: 1701 - protein, 555 aa, Unknown
  secondary endosymbiont of Bemisia tabaci
MAAKDLKFGNDARKKMLKGVNILANAVKVTLGPKGRNVVLDKSYGAPSITRDGVSVAREIELEDKFENMGAQMVKEVASKANDAAGDGTTTATVFAQSIVTEGLKAVAAGMNPMDLKRGIDKAVEAAVEELKIISKPCKDSKEIAQVGTISANADAKVGKLISDAMKRITNEGVITVEEASGLEDGLIVVEGMQFDRGYLSPYFINKQESSSIEFDNPYILLVDKKISNIRDMLSILEVVAKEGKPLLIIAEDVEGEALATLVVNTMRGIVKVSAVKAPGFGDRRKEMLQDIAVLTHGHVISEETGDSLEKATKENLGNAKRVVITKDATTIIDGAGEKSKIEARIQNIKKQIENATSDYDKEKLQERVAKLSGGVAVIKVGAPTETAMKEKKARVEDALQATRAAVEEGVVPGGGVALIRVASKIANSSLKGDNEDQNVGIRVALRAMESPLRQIVVNAGEEASVIANKIKENKGNDNYGYNAQTEAYGDMIEMGILDPTKVTRSALQYAASIAGLMITTECMVTDLPKEEKASDMGAGGMGGIGGMGGMNGMM

SEQ ID NO: 1702 - protein, 728 aa, Escherichia coli
MSDRIDRDVINALIAGHFADPFSVLGMHKTTAGLEVRALLPDATDVWVIEPKTGRKLAKLECLDSRGFFSGVIPRRKNFFRYQLAVVWHGQQNLIDDPYRFGPLIQEMDAWLLSEGTHLRPYETLGAHADTMDGVTGTRFSVWAPNARRVSVVGQFNYWDGRRHPMRLRKESGIWELFIPGAHNGQLYKYEMIDANGNLRLKSDPYAFEAQMRPETASLICSLPEKVVQTEERKKANQFDAPISIYEVHLGSWRRHTDNNFWLSYRELADQLVPYAKWMGFTHLELLPINEHPFDGSWGYQPTGLYAPTRRFGTRDDFRYFIDAAHAAGLNVILDWVPGHFPTDDFALAEFDGTNLYEHSDPREGYHQDWNTLIYNYGRREVSNFLVGNALYWIERFGIDALRVDAVASMIYRDYSRKEGEWIPNEFGGRENLEAIEFLRNTNRILGEQVSGAVTMAEESTDFPGVSRPQDMGGLGFWYKWNLGWMHDTLDYMKLDPIYRQYHHDKLTFGMLYNYTENFVLPLSHDEVVHGKKSILDRMPGDAWQKFANLRAYYGWMWAFPGKKLLFMGNEFAQGREWNHDASLDWHLLEGGDNWHHGVQRLVRDLNHTYRHHKAMHELDFDPYGFEWLVVDDKERSVLIFVRRDKEGNEIIVASNFTPVPRHDYRFGINQPGKWREILNTDSMHYHGSNAGNGGAVHSDEIASHGRQHSLSLTLPPLATIWLVREAE

SEQ ID NO: 1703 - protein, 254 aa, Ipomoea batatas
MRVRFFFYFAYFLITLVFFPSVTLQSYSGGHRQEATGFCGEEGEREDNLIRMATTTLGGISDSASAENSVEIESLARFAVEEHNKKENAMIELVRVVKAEEQVVAGKLHHLTLEVIDAGKRKLYEAKVWLKPWMNFKELQGFNHIEDIPTLTSSDLGARRDCPNTGLKSVPVNDPVVQEAAQHAVKTIQQRSNSLLPYELQEIVHANAEVIDDSAKVHMLIKTKRGEKEEKFSVEVHKNNEGAFLLHHMAPANS

SEQ ID NO: 1704 - protein, 396 aa, Lycopersicon esculentum
MDGSVPQTDTMMSDVAAPPAQQPPPPSQPLAGMDNIPATLSHGGRFIQYNIFGNIFEVTAKYKPPIMPIGKGAYGIVCSALNSETNESVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVNPAAIDLVEKMLTFDPRRRITVEDALAHPYLTSLHDISDEPICMTPFSFDFEQHALTEEQMKELIYRESIAFNPEYQRM

SEQ ID NO: 1705 - protein, 466 aa, Shigella flexneri
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 1706 - protein, 629 aa, Pisum sativum
MGSNRTIVWFRRDLRIEDNPALAAAARDGSVFPVFIWCPKEEGQFYPGRVSRWWLKQSLAHLDQSLKSLGAKLVLIKTDSTLNALLECVNAIQATKVVFNHLYDPVSLVRDHNIKEKLVELGISVKSYNGDLLYEPWELYDEKGHAFTTFDPFWERCLHKQMEPVSLIPPWQLIPAKGKVERCSIEDLGLENELEKPSNALLGRAWSPGWGNANKALTEFMDKQLLNYSKNRQKVGGDSTSLLSPYLHFGELSVRKVFQMARVKQISWGNEGNSVGKESVTLFLRAIGLREYSRYLCFNFPFTHERALLGHLSFFPWNADPSNFKTWRQGRTGYPLVDAGMRELWATGWMHNRIRVIVSSFAVKMLLLPWKWGMKYFWDTLLDADLECDILGWQYISGCLPDGHELERLDDPEILGAKFDPEGEYVRQWLPELARMPTEWIHHPWNAPLSVLRASGVELGQNYPNPIIDIDLAREKLTQAIFKMWEIQAASKASGSEARDEVVVDNENQDIPKVILKDKGPCVTISANDQKVPALPDPKNELPVRKRKKGMEEKGKEQESSVNNEKDSKVSSPDQETCSTADSSACKKQCSTSTYTFSVPQQCSSSSNLKWSWQEQIDMEQSSGKDGPT

SEQ ID NO: 1707 - protein, 496 aa, Nicotiana tabacum
MVLSKTASESDVSIHSTFASRYVRTSLPRFKMPENSIPKEAAYQIINDELMLDGNPRLNLASFVTTWMEPECNKLMMDSINKNYVDMGEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITAAWKKFVADKKKKTNGVC

SEQ ID NO: 1708 - protein, 181 aa, Coxiella burnetii
MTKKQKPSQNEDLNLTTAQGTPISDDQNSLKIGDRGPLLLEDFPFREKLFHFDHERIPERVVHARGFGVHGYFETDVSLSEITMAHLFQKKGEKTPVFVRFSTVVGSQGSPDLARDVRGFAVKFYTKEGNWDLVGNNIPVFFIQDPIKFPDLIHAAKAEPDRGFPQAQTANDNFWENFRYQ

SEQ ID NO: 1709 - protein, 208 aa, Magnolia praecocissima
NRQVTFCKRRNGLLKKAYELSVLCDAEVALIVFSSRGRLYEYANNSVRNTIDRYKKACADSSSLGCVSEANSQYYQQESSKLRQQIALLQNANRHLMGEALSSMTVKELKQLENRLEKGISRIRSKKNELLFAEIEYMQKREVDLQNDNMYLRAKITENERAQQQMGMLPAPEYDVMPGFDSRNFLQVNLMDSSHHYSHQEQTALQLG

SEQ ID NO: 1710 - protein, 598 aa, Pisum sativum
MGMNRTIVWFRRDLRIEDNPALAAAARDGSVFPVFIWCPKEEGQFYPGRVSRWWMKQSLVHLDQSLKSLGAGLVIIKTDSTLKALLECVNAVQATKVVFNHLYDPVSLVRDHNIKEKLVEQGVSVQSYNGDLLYEPWEIFDESGHAFTTFDPFWNTCLHMQMKTYSPIPPCQLILAQGKVEKHSIEQLGLEDELEKSSNSSLGRSWSPGWSKSDKALAEFIENYLLHYSGNRLNLGGDSTSLLSPYIHFGELSVRKVFQLARTKQILWTHEGNIIGEESATLFLRAIGFREYSRYLCFSFPFTLERPLLGNLKFFPWNNDPSNFKAWRQGRTGYPLVDAGMRELWATGWIHNKMRVIVSSFAVKMLLIPWKWGMKYFWDTLLDADLESDILGWQYISGSLPDGHKLERLDDPEVLGRKYDPAGEYIRQWLPELARMPAEWIHHPWDAPLTVLTASGVELGQNYPKPIIDIDLAREQLTQAILKMWETEAATEASSSQDRHEVVDENEKLLIPKVFLKDKVPRGATSANDQTVPILQNLKSDDPPNKRQKCTAEEDRKPDKSRNRSDHTEVSCIDQEDCSTAESSSKRQSSSTSSFSVP

SEQ ID NO: 1711 - protein, 494 aa, Brassica juncea
MVLSRAATESGENVCSTFGSRYVRTALPKHKIGESSIPKEAAYQIIKDELMLDGNPRLNLASFVTTWMEPECDKLIMESINKNYVDMDEYPVTTELQNRCVNMIARLFNAPLEETETAMGVGTVGSSEAIMLAGLAFKRNWQNKRKAEGKPYDKPNIVTGANVQVCWEKFARYFEVELKEVKLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRTQQDLPDELIFHINYLGADQPTFTLNFSKGSSQIIAQYYQLIRLGFEGYKNVMENCRENMVVLREGIEKTERFNIVSKEVGVPLVAFSLKDHSFHNEFEISEMLRRFGWIVPAYTMPADAQHITVLRVVIREDFSRTLAERLVADIVKVLHELDTLPSKISKKMGAEDFGNVKGKKVDRDVLMEVIVGWRKFVKDRKKMNGVC

SEQ ID NO: 1712 - protein, 223 aa, Fusobacterium nucleatum
MMESLDDPHSVYFTKEEMRSFQEDIKGKYVGVGMVIQKKVGEPLTVVSPVEDGPAYKAGIKPKDKIIEIDGESTYNLTSEEASKRLKGKANTTVKVKVFREVNKMTKIFELKRETIELKYVKSKMLDGGIGYLRLTQFGDNVYPDMKKALEDLQAKGMKGLIFDLRSNPGGELGQSIKIASMFIEKGKIVSTDKKGRRKYIYKRRPLLWEILLWYSKTGVVMP

SEQ ID NO: 1713 - protein, 482 aa, Pseudomonas aeruginosa
MEEKTRLTTAAGAPVVDNQNVQTAGPRGPMLLQDVWFLEKLAHFDREVIPERRMHAKGSAAYGTFTVTHDITPYTRAKIFSQVGKKTDMFLRFSTVAGERGAADAERDIRGFSMRFYTEQGNWDLVGNNTPVFYLRDPLKFPDLNHVVKRDPRTNLRNATFKWDFFSHLPESLHQLTIDFSDRGLPKSYRHIHGFGSHTFSFINANNERFWVKFHFKTQQGIENLTNAEAAEVIAQDRESSQRDLYESIEKGDFPRWKMYVQIMPEKEAATYRYNPFDLTKVWPHGDYPLIEVGFFELNRNPDNYFAEVEQAAFTPANVVPGIGFSPDKMLQGRLFSYGDAHRYRLGVNHHQIPVNAARCPHQVYHRDGGMRVDGNNAHQRVTYEPNSFNQWQEQPDFSEPPLSLEGAADHWNHRVDDDYYSQPAALFHLFTDEQKQRLFANIAEDIRDVPEQIQRRQIGLFLKVDPAYGKGVADALGLKLD

SEQ ID NO: 1714 - protein, 132 aa, Zea mays
  misc_feature (69)..(69): Xaa can be any naturally occurring amino acid
  misc_feature (114)..(114): Xaa can be any naturally occurring amino acid
RIVSFVAVILELLALTTLRCTHNAQRESITNNTDMLASCIKDVPMNKNKLQLQELARFGGYDHNQTANXALMGIEKLVNAKTQIGACTMYYLTIETKDGVGKKLYETNVWEKPXENFKQLQEFKPVDKGASA

SEQ ID NO: 1715 - protein, 533 aa, Propionibacterium granulosum
MAKLIEFNIEARRALEQGMNTLADAVKVTLGPKGRNVVLEKSWGAPTITNDGVSIAKEIELEDPYEKIGAELVKEVAKKTDDVAGDGTTTATVLAQAMVREGLRNVTAGANPMGLKKGIEAAVEVISARLSEMAIDIETKEHIAATATISAGDPSVGETIAEAMDKVGKEGVITVEESNTFGIDLELTEGMRFDKGYISPYFVTDTESMEAVLEDPYILIVNSKISSLKDILPVLEQVMKSSKPLLVIAEDVEGEALAGLIVNKIRGTFKSVAVKAPGFGDRRKAMLADIAILTGGQVISEEVGLSLDAVTLDLLGKARSVRVTKDECTIVDGAGDAEQIAGRVTQIRKEIENSDSDYDREKLQERLAKLAGGVAVIKVGAATEVELKERKHRIEDAVRNAKAAVEEGIIPGGGVALMQASKAATIEGLEGDEATGAQIVLSACSAPLKQIATNAGLEGGVIAEKVANLPAGEGLNAATGEYVDMVKAGIIDPAKVTRSALQNASSIAALFLTTEAVIADKPEPAPAPAGDPG

SEQ ID NO: 1716 - protein, 400 aa, Candida glabrata
MPFKHDFTPVALKDTNLFKPLKVGNTEVLQRVAMAPLSRFRADPQGNVPNKNWTEEYYRQRSQRPGTMIITEATFISAQAGGYDAAPGIWTEEQMEQWKKIFKAIHDNKSFVWVQMWALGRQAFPNNMARDGLRLDAPSADLYMSDKQKEVAKENNIAQHELTKEDIKQYIKDYVKAAKNSVESGADGVEIHSANGYLLNQFIDPKSNRRTDEYGGSIENRCRFALEVVDAVVDAIGAERTGIRLSPYGLFGNMSGGFEPSIVAHYAYLIGELEKRGIAGKRLAYIHLVEPSVTDLMLVEDQGEYKEGTNDFAYSIWKGPIIRAGNYALHPELVKEQVKDPRTLIAYGRYFISNPDIIDRLENGLPLNEQDRPTFYTPTAEGYIDYPNYNDALQLGWDKQ

SEQ ID NO: 1717 - protein, 228 aa, Sorghum bicolor
KVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAAASRQQQQGAVGPADTDPGPDKLIIVLLHDEAGSAGSAASTKHMLPAADNRRER

SEQ ID NO: 1718 - protein, 394 aa, Lycopersicon esculentum
MDGSAPQTDTVMSDAAAGQQPAMPPLPMAGMENIPATLSHGGRFIQYNIFGNIFEVTAKYKPPIMPIGKGAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLLMELIGTPSEAEMEFLNENAKRYIRQLPLYRRQSFVEKFPHVNPAAIDLVEKMLTFDPRRRLTVEDALAHPYLTSLHDISDEPVCMTPFSFDFEQHALTEEQMKELIYREGLAFNPEYQHM

SEQ ID NO: 1719 - protein, 490 aa, Candida glabrata
MSRVETRNVTTEFQKDGLDEVDLVQANILAAGLDKKTVRVVNGLGKLMGSKEMVQVEFNKDKPTSKISASTPHISEQPWTLNNWHEHLNWLNLVLVCGLPMIGWYFVVSGKAKLTWQMALFATFYYALGGISITAGYHRLWSHRAYSARLPLKIFFAFFGAASVQGSIKWWGHSHRIHHRYTDTLRDPYDARQGLWYSHMGWMLLKPNPKYKARADISDLTDDWVVRFQHKHYIPMMLLSGFVLPCLLGGYLLNDYLGGLIYGGFIRIFVIQQATFCINSMAHYLGTQPFDDRRTPRDNWITAIVTFGEGYHNFHHEFPSDYRNAIKWYQYDPTKVFIYLTSLFGLSYDLKTFSQNIIQQALIQQRQKKIDRDSKSVNWGPKLADLPAWTKEEFLEKNRENDGLVIVGGIVHDVSGYITEHPGGEKLLKNALGKDATKAFSGGVYRHSNAAHNTLATMRVAVMKDNKETAMRFAQKRGERAERVERAHMN

SEQ ID NO: 1720 - protein, 546 aa, Wigglesworthia glossinidia
MAAKDVKFGNDARSKMLRGVNVLADAVKVTLGPKGRNVVLDKSFGSPMITKDGVSVAREVELEDKFENMGAQMLKEVASKANDAAGDGTTTATVLAQSIVNEGLKAVAAGMNPMDLKRGIDKAVIGAVAELKKLSVPCSDSKSIAQVGTISANADKTVGTLIAEAMEKVGKEGVITVEEGSGLQDELDVVEGMQFDRGYLSPYFVNKPEARSVELDNPFILLSDKKISNIREMLPILESVAKAGKPLLIIAEDVEGEALATLVVNNMRGIVKVAAVKAPGFGDRRKAMLQDIAILTSGTVISEEMGLDLEKSTLEDMGQAKRVVITKDTTTIIDGTGNKSMISSRVSQINQERDEATSDYDKEKLQERVAKLAGGVAVIKVGAATEVEMKEKKARVEDALHATRAAVEEGVVAGGGVALIRVANRIVNLRGENEDQNVGIRVARRAMEAPLRQIVANAGEEPSVIANKVKAGEGNTGYNAATEVYGNMIDMGILDPTKVTRSALQYAASIAGLMITTECMITDLPKEEKPDLSGAGAGMGGMGGMM

SEQ ID NO: 1721 - protein, 464 aa, Zea mays
MVNGEQRADAECTRASLLGRYEIGRTLGEGNFGKVKYARHIATGGHFAIKILDRSKILSLRIDDQIRREIGTLKLLKHPNVVRLHEVAASKTKIYMVLEFVNGGELFDKIAIKGKLSEHEGRRLFQQLIDGVSYCHDRGVYHRDLKPENVLVDRKGTIKISDFGLSALPQHLGSDGLLHTTCGSPNYIAPEVLQNRGYDGSLSDLWSCGVILYVMLVGCLPFDDRNLVVLYQKIFKGDCQIPKWLSPAAQDLLKRILQPNPMKRINVAGIREHEWFKKDYVPAVPHDDDEDVLPSPAPSIKEPIDEPAQEKCTPINAFQLIGMASSLDLSGFFEEEDAAQRKIRFTSTHPPKDLFDKIESVVMEMGFKVHRGAGKLKVLKNSKCSRNSRNPSSLLVCTEVFELGPSLYVVELRKSHGDSTLYRQLCERLSDELGACKTDQIARTESSSDDLSSLDGEAFPLSGF

SEQ ID NO: 1722 - protein, 252 aa, Neisseria meningitidis
MKITPVKALTDNYIWMIQHGNHAVCVDPSEPSPVLEFLVRNRLMLAQTWVTHPHPDHEGGAAALWRGYMESPVYGESDIEAATHTVTAGTQFTFGDGQVTVWATPGHTDRHTSYLLETSDGIHVFCGDTLFSAGCGRVFTGTIEQLYDSFQRFNRLPENTLFYPAHEYTAANLRFAAHIEPDNADIQTALKAAAHTPTLPVTLAHERRVNPFLRVDLPHVRDRAEALSGKTLNSSLDTFVALRELKNQYRTK

SEQ ID NO: 1723 - protein, 493 aa, Brassica juncea
MVLSKTASESDVSIHSTFASRYVRTSLPRFEMPENSIPKEAAYQIINDELMLDGNPRLNLASFVTTWMEPECDKLMMESINKNYVDMDEYPVTTELQNRCVNMIARLFNAPLGDGEAAVGVGTVGSSEAIMLAGLAFKRQWQNKRKAQGLPYDKPNIVTGANVQVCWEKFARYFEVELKEVKLREGYYVMDPEKAVEMVDENTICVAAILGSTLTGEFEDVKLLNDLLVEKNKQTGWDTGIHVDAASGGFIAPFLYPELEWDFRLPLVKSINVSGHKYGLVYAGIGWVVWRTKSDLPDELIFHINYLGADQPTFTLNFSKGSSQVIAQYYQLIRLGFEGYRNVMDNCRENMMVLREGLEKTGRFNIVSKENGVPLVAFSLKDSSRHDEFEVAETLRRFGWIVPAYTMPADAQHVTVLRVVIREDFSRTLAERLVADFEKVLHELDTLPARVQAKMANGNANGVKKTEEETTREVTAYWKKFVEAKKSNKNRIC

SEQ ID NO: 1724 - protein, 465 aa, Oryza sativa
  misc_feature (94)..(94): Xaa can be any naturally occurring amino acid
  misc_feature (287)..(287): Xaa can be any naturally occurring amino acid
  misc_feature (299)..(299): Xaa can be any naturally occurring amino acid
  misc_feature (317)..(317): Xaa can be any naturally occurring amino acid
EGSFAMVKVARDTRTGDTLAIKVLDRNHVLRHKMVEQIKREISTMKLIKHPNVVQLHEVLCYLCRNNSVITTHTLLFFFISSHSMRILHSMCVXQVLASKSKIYMVLEYVDGGELFDKIVNSGRLGEDEARRYFHQLINAVDYCHSRGVYHRDLKPENLLLDSHGALKVSDFGLSAFAPQTKEDGLLHTACGTPNYVAPEVLADKGYDGMAADVWSCGIILFVLMAGYLPFDDPNLMTLYKLICKAKVSCPHWFSSGAKKFIKRILDPNPCTRITIAQILEDDWFNXVDPRAAGYKPPXFEQGEDVSLDDVDAAFDXSEENLVAEKREKPESMNAFALISRSQGFNLGNLFEKEMMGMVKRETSFTSQCTPQEIMSKIEEACGPLGFNVRKQNYKMKLKGDKTGRKGHLSVATEVFEVAPSLHMVELRKTGGDTLEFHNFYNNFSSELKDIVWKSESDAKAAKKR

SEQ ID NO: 1725 - protein, 493 aa, Brassica juncea
MVLSKTASGTDVSVHSTFASRYVRNSLPRFEMPENSIPKEAAYQIINDELMLDGNPRLNLASFVTTWMEPECDKLMMESINKNYVDMDEYPVTTELQNRCVNMIARLFNAPLGDGEAAVGVGTVGSSEAIMLAGLAFKRQWQNKRKAQGLPYDKPNIVTGANVQVCWEKFARYFEVELKEVKLREGYYVMDPEKAVEMVDENTICVAAILGSTLTGEFEDVKLLNDLLVEKNKQTGWDTGNHVDAASGGFIAPFLYPELEWDFRLPLVKSINVSGHKYGLVYAGIGWVVWRTKSDLPDELIFHINYLGADQPTFTLNFSKGSSQVIAQYYQLIRLGFEGYRNVMDNCRENMMVLREGLEKTGRFNIVSKENGVPLVAFSLKDSSRHNEFEVAETLRRFGWIVPAYTVPADAEHVTVLRVVIREDFSRTLAERLVADFEKVLHELDTLPARVRAKMANGKAKVVKQTEEETTREVTAYWKKFVETKKTNQNKIC

SEQ ID NO: 1726 - protein, 430 aa, Oryza sativa
MESGGAGGEGETAGWRFGAANPALAVAGSQSIRAAVTRIYRCLDGSGDARPVAPLAHGDPSAFACFRAAPAATDAVAAAAASGKYNYYSPAVGIAPACSAVAAHLSRELPYAVSPADVVLTAGCNHAVEIMMSVLASPGANVLLPRPGYPLYASRAALSGLEFRHFDLLPDSEWEVDLAGVEALADANTVAMVIVNPNNPCGCVYSRDHLAKIAETARKLGIMVISDEVYDHFAFGSKPFVPMGVFGDVAPVMTLGGISKRWMVPGWRLGWIAATDPNGILRNKKIIDSVIDYRAISVDPVTFVQGALPDILAKTDDAFFTNALGVVKKAAEICYEKLKEIDCITCPHKPEGSMFVMAKLDLSSLDGIEDDVDFCSKLAKEESVVICPGSGLGMKNWLRITFAVDPQLLEDGLERTKCFCKRHGKIKEAS

SEQ ID NO: 1727 - protein, 262 aa, Brassica juncea
MVLSHAASDSDVSVHSTFASRYVRTSLPRFKMPENSIPKEAAYQIINDELMLDGNPRLNLASFVTTWMEPECDKLIMASINKNYVDMDEYPVTTELQNRCVNMIAHLFNAPLGRDETAVGVGTVGSSEAIMLAGLAFKRKWQNKRKAEGKPFDKPNIVTGANVQVCWEKFARYFEVELKEVKLSEGYYVMDPEKAVEMVDENTICVAAILGSTLNGEFEDVKLLNDLLVLKNKENGWDTPIHVDAASGGFIAPFLYPELEWD

SEQ ID NO: 1728 - protein, 825 aa, Oryza sativa
MAAPASAVPGSAAGLRAGAVRFPVPAGARSWRAAAELPTSRSLLSGRRFPGAVRVGGSGGRVAVRAAGASGEVMIPEGESDGMPVSAGSDDLQLPALDDELSTEVGAEVEIESSGASDVEGVKRVVEELAAEQKPRVVPPTGDGQKIFQMDSMLNGYKYHLEYRYSLYRRLRSDIDQYEGGLETFSRGYEKFGFNHSAEGVTYREWAPGAHSAALVGDFNNWNPNADRMSKNEFGVWEIFLPNNADGSSPIPHGSRVKVRMETPSGIKDSIPAWIKYSVQAAGEIPYNGIYYDPPEEEKYIFKHPQPKRPKSLRIYETHVGMSSTEPKINTYANFRDEVLPRIKKLGYNAVQIMAIQEHAYYGSFGYHVTNFFAPSSRFGTPEDLKSLIDKAHELGLVVLMDVVHSHASNNTLDGLNGFDGTDTHYFHSGSRGHHWMWDSRLFNYGNWEVLRFLLSNARWWLEEYKFDGFRFDGVTSMMYTHHGLQVAFTGNYSEYFGFATDADAVVYLMLVNDLIHGLYPEAITIGEDVSGMPTFALPVQDGGVGFDYRLHMAVPDKWIELLKQSDESWKMGDIVHTLTNRRWSEKCVTYAESHDQALVGDKTIAFWLMDKDMYDFMALDRPATPSIDRGIALHKMIRLITMGLGGEGYLNFMGNEFGHPEWIDFPRAPQVLPNGKFIPGNNNSYDKCRRRFDLGDADYLRYRGMLEFDRAMQSLEEKYGFMTSDHQYISRKHEEDKMIIFEKGDLVFVFNFHWSNSYFDYRVGCLKPGKYKVVLDSDAGLFGGFGRIHHTAEHFTADCSHDNRPYSFSVYSPSRTCVVYAPAE

SEQ ID NO: 1729 - protein, 416 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKGQRSCSCK

SEQ ID NO: 1730 - protein, 741 aa, Neurospora crassa
MNDISDNSSNSLANGGTVANSDIPKDGTGVLSIDPWLEPFKDTLKSRYSKAQSWIDTINKTEGGLEKFSRGTEIFGFNVDKDNTITYREWAPNAKQASLIGEFNNWDRNAHRMKKNEFGVFEITIPPTANGQPAIPHNSKIKITLELPDGQWVDRLPAWIKYVTQDLSVSPAYEARFWNPPQSERYTFKHKRPSKPESLRIYEAHVGISSPECKVATYKEFTKTMLPRIKNLGYNAIQLMAIMEHAYYASFGYQVNSFFAASSRYGPPEDLKELVDTAHAMGIAVLLDVVHSHASKNVLDGLNEFDGTDHQYFHGGGRGKHDLWDSRLFNYGHHEVMRFLLSNLRFWMDEYAFDGFRFDGVTSMLYLHHGIGTGFSGGYHEYFGPDVDEEAVVYLMLANEMLHQLYPNVITVAEDVSGMPALCLPLSLGGVGFDYRLAMAIPDMWIKILKEKKDEEWDMANITWTLTNRRHGEKTIAYCESHDQALVGDKTLMMHLCDAELYTNMSILTPLTPVIDRGMALHKMIRLLTHSLGGEGYLNFEGNEFGHPEWLDFPREGNQNSFWYARRQLNLTEDGLLRYQYLNNFDRSMNLTEDKYGWLHAPQAYISLKHEGDKVIVFERAGLVFVFNFHPSNSYTDYRIGIEQAGTYRIVLDSDTKEHGGFNRLDPQTRFFTSDLPWNNRKNSTHVYIPARTAFRPGEGHKRRKASLCKSSAFVVIVALICVLLKPAAAKVLVEMVGDDV

SEQ ID NO: 1731 - protein, 189 aa, Magnolia praecocissima
ELTVLCDAEVALIVFSSRGRLYEYSNNSIKATIERYKKACADSSNTTSITQANSQYYQQEASKLRQQIQILQNANRHLMGDALSSLTVKELKQLENRLERGITRIRSKKHELLFAEIEYMQKREVELQNDNLYLRAKIAENERAQQANVLPAPEFDTLPSFDSRNYFEANMLEAASHYSHQDQTALHLG

SEQ ID NO: 1732 - protein, 249 aa, Rosa rugosa
MEFPKQITPADDPESSSQKKLGRGKIEIKRIENTTNRQVTFCKRRNGLLKKAYELSVLCDAEVALIVFSTRGRLYEYANNSVRATIERYKKACDSSNTGSVTETNVQFYQQEASKLRRQIREIQNSNRHILGEALSTLNVKELKNLEGRLEKGISRIRSKKNEMLFAEIEYMQKREIELQNHNNFLRAKIAENDRAQQQQANMMPGTLSAYDQSMPPPQSYDRSFLPVILESNHHYNRQGQNQTPLQLV

SEQ ID NO: 1733 - protein, 994 aa, Ralstonia solanacearum
MATMLRRALPAPAHLWRRGRTALLLCATAIALLTTSDRAQADRTTRALPPMGHPLMPSAAAQMASGTPAAAIALWTLAVLSMRHVQLRRENRRRRRAEADLARQLDFHHRLLESLPFPLAAQDTQHRYVAVNAAFCHLFGQPREALLGRTPAHLGWRCAHTAARAQDIDRRATAASQGACEALTITAADGRERHVLYWVAPVHGPDGRPGGTVASLIDIDGIRDAQAPAEQRAQRLHELTESLPALVCQFEMRPGTAARGRMRHLAGNASETLGAPAGKARGRLPSPARLVHRDDRQRMRGAALQSAAQLTLLDQQFRHGNGDGPVRWLHIRARPRRGADGCTVWNGYLRDVTAERAQADALVSARQAAESALRAKDRFLATMSHEIRTPMNGVLGLVELLLQTRLEREQQRMMTLVQESSRALLHVLDDILDYAKIEADRLSITPAPTDLRALLDSTVGLLASRAHERSLAVRVDVDAAVPATVSVDGMRLRQVLCNLLSNAIKFTEHGSVRLSAKCMETAADTVHLIIRVTDTGIGIAPEAQATLFTPFVQADSTITHRQCGTGLGLAISRQLARLMGGSLDMDSTPNVGTTLTLRLEVPVVDARYRLPRLASATVRVAVDDDTCRHGLEQFAVAAGLRVVHTGTADLTLVDSVRAPADAPRIVPVTGDAPYTGPGRSIPRPEALSTNPLNWQAFVQACDTALARPADGHAANGMPKSRTVPEPAPAAETPGMHILVAEDHPINRELITRQLRLLGYRVTLAEDGAAALQRLCETRFDALLTDCCMPRLDGFDLARQIRQREQQAPGGRRLPILAITATTLAEEHARCRTVGMDGYVLKPTTLATLQDALSRLGNAAVSPDAAKAPATAPDNALAFRLDDLRQTLGDGPAAVSLIRVFTTALGDDARQLGGLLATADRPALRKWTHRTGGALALLHHTAIDAEMSAFRHAVHSADDTGLRQAGARMLQLLAHLQGVMRLAETPSPGTAPTCQ

SEQ ID NO: 1734 - protein, 248 aa, Rosa rugosa
MAYENKPNTVLDSDAQRRLGRGKIEIKRIENTTNRQVTFCKRRNGLLKKAYELSVLCDAEVALIVFSNRGRLYEYSNNSVRETIERYKKACADSSNNGSVSEATTQYYQQEAAKLRAQITTLQNSNRGYMAEGLSNMSIKELKGVETKLEKAISRIRSKKNELLFAEIEYMQKRELDLHNNNQLLRAKIAENERHQQSINAIAGGHGSYDIMQPTQPFHEARNYFQVNALQPNIHQYSRHDQISLQLV

SEQ ID NO: 1735 - protein, 807 aa, Triticum aestivum
MLCLTAPSCSPSLPPRPSRPAADRPGPGISAKSKFSVPVSAPRDYTMATAEDGVGDLPIYDLDPKFAGFKEHFSYRMKKYLDQKHSIEKHEGGLEEFSKGYLKFGINTENDATVYREWAPAAMDAQLIGDFNNWNGSGHRMTKDNYGVWSIRISHVNGKPAIPHNSKVKFRFHRGDGLWVDRVPAWIRYATFDASKFGAPYDGVHWDPPSGERYVFKHPRPRKPDAPRIYEAHVGMSGERPEVSTYREFADNVLPRIKANNYNTVQLMAIMEHSILCFFWYHVTNFFAVSSRSGTPEDLKYLVDKAHSLGLRVLMDVVHSHASSNMTDGLNGYDVGQNTQESYFHTGERGYHKLWDSRLFNYANWEVLRYLLSNLRYWMDEFMFDGFRFDGVTSMLYNHHGINMSFAGNYKEYFGLDTDVDAVVYMMLANHLMHKILPEATVVAEDVSGMPVLCRSVDEGGVGFDYRLAMAIPDRWIDYLKNKDDLEWSMSAIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLSDIDHLRYKYMNAFDQAMNALDDKFSFLSSSKQIVSDMNEEKKIIVFERGDLVFVFNFHPSKTYDGYKVGCDLPGKYKVALDSDALMFGGHGRVAQYNDHFTSPEGVPGVPETNFNNRPNSFKVLSPPRTCVAYYRVEEKAEKPKDEGAASWGKAAPGYIDVEATRVKDAADGEATSGSKKASTGGDSSKKGINFVFGSPDKDNK

SEQ ID NO: 1736 - protein, 204 aa, Capsicum annuum
MKVGNSKCNGVNNNKDVHYRGVRKRPWGRYAAEIRDPGKKSRVWLGTFDTAEEAAKAYDAAAREFRGCKAKTNFPLPSENQNGSDSGSPDESFSGENRAHAPSEFELTRCLGAGGEGVGNGGRLAEVGLVRNGDTIVHAPTELDLTRLLGAGGEGGDNSGYSAEVGLVRNGFPIFHHQPPIEAPMMSNRSSPAESYSGETIINT

SEQ ID NO: 1737 - protein, 280 aa, Listeria monocytogenes
MTLSFSDTYRLNNGIEMPRHGFGVYKLTDEARMRTALETAVDVGYRLFDTASFYHNEKELGDFFASSGLKRDEFFVTTKMWNTEQGYDETLWAFEKSQKKLQLDQIDLYLVHWPKQDTFFDTWRAVEKLYDEGLVRAIGVSNFEAHHLDRLRTSANVLPVVDQLETHPHFPNHLLHRYLEELHIVHQAWSPLGRGGVLQEQILIDLAEKHGKSPAQIVLRWHLQNNISIIPKSETPSRIRENAAIYDFELSEADMRQVERLNTGERVSHAPDVMYVRSEI

SEQ ID NO: 1738 - protein, 249 aa, Rosa rugosa
MAYENKPNTVLDSDAQRRLGRGKIEIKRIENTTNRQVTFCKRRNGLLKKAYELSVLCDAEVALIVFSNRGRLYEYSNNSSVRETIERYKKACADSSNNGSVSEATTQYYQQEAAKLRAQITTLQNSNRGYMAEGLSNMSIKELKGVETKLEKAISRIRSKKNELLFAEIEYMQKRELDLHNNNQLLRAKIAENERHQQSINAIAGGHGSYDIMQPTQPFHEARNYFQVNALQPNIHQYSRHDQISLQLV

SEQ ID NO: 1739 - protein, 867 aa, Yarrowia lipolytica
MIPLALKTTESTDWSRAIHRYIASSYGPDYAEQFREEISSFQRLRQDIRGAGRDATGRDILFRYFAQLDSLERRINAAESGMKPDFTWSDSLSQEKVTQHSISFEKANVLYQLGAILSCMGEEMSRDDSCDPKASFHAFQNAAGVFAFIADKFLHAPLPDIGQDVVRAFNKLMLAQAQEMFCQDSIAKSVSVLTDVNQEQAGKVSALTAKLCAGVGALYKAAFESFTAIQEEQKWGDKNWPLECQGKNKYFTALGSLLYAKSLQNKPSTQKFGESIGYIQKSINEFNEASMLPLPNGANKKDFNKWYRDLVSTALDLARSTLKSSEHDNDLIYHSLVPAPATLGAVEPKEVVTATPLQDMYKEEDHVRVVGRDLFTRLVPMHVLQQTSVYSEEKASLLRSEGERIEVADQKLNSALEYMGLPGELYALKKDLQSGRDSGSSAQVPAVVLGYASEVKTLDLSPLKTSRDQILTQIRDSQALIASEETESTKMKDYYKDGWTQAPSAQVNASLLSDIRRVQESLVAAGASDEKLQAQYDGVKPDIELLSRGINNPELEKLFDADSSSSKSSSGPSESLIDLDFSQGAASRDPAASSTLDKLLPSCETSFRKLQNCQKDRQAIFYEFKDKVHRDDISGVLVNSKGADDNLIFEQELEKFQPYQQRLTATINTQALLIKDLADSWEKITRDPVVKNKVTDRKRALDHSHVIVERFRKAFESWKQVKTGLDKGLEFYRDLQNMADKVNVSATQFVNARRQEGKSILSAIQSNTTNELQSQLGRLSFGSGSSSAAPTSGGAPTLPPKPQQHTGDNYGQPSTYDPSVYGPNSPFMQQPPQHQQYGQPPHHQQYGQNPPPPPQGANQNQFWNQYR

SEQ ID NO: 1740 - protein, 250 aa, Rosa rugosa
MAYENKPNTVLDSDAQRRLGRGKIEIKRIENTTNRQVTFCKRRNGLLKKAYELSVLCDAEVALIVFSNRGRLYEYSNNSVRETIERYKKACADSSNNGSVSEATTQYYQQEAAKLRAQITTLQNSNRGYMAEGLSNMSIKELKGVETKLEKAISRIRSKKNELLFAEIEYMQKRELDLHNNNQLLRAKGQIAENERHQQSINAIAGGHGSYDIMQPTQPFHEARNYFQVNALQPNIHQYSRHDQISLQLV

SEQ ID NO: 1741 - protein, 231 aa, Sorghum bicolor
MGRGRVELKRIENKINRQVTFAKRRNGLLKKAYELSVLCDAEVALIIFSNRGKLYEFCSGQSITKTLERYEKHMRPDTAVQNKENELVQSSRNEYLKLKARVDNLQRTQRNLLGEDLGSLGIKELEQLEKQLDSSLRHIRSTRTQHMLDQLTDLQRREQMLCEANKCLRRKLEETSNQVHSKCGARCQLTRLRAATPPHSRPHHILAMDCSFIPWKLQQSQPCRSGSLLNI

SEQ ID NO: 1742 - protein, 434 aa, Neurospora crassa
MADFTQKKTSSPAAPGVPFYTPAQVPAAGTPLPSTPGDVPTLFTPLKIRGVELQNRFAVAPMCTYSADDGHMTDWHLVHLGSFALRGVPLTIFEATGVLPNGRITPECSGLWQDSQIAPLKRIVDYIHSQGQKAGIQLAHAGRKASTKAPWHYQRGKSELAGPEQGGWPENVWAPSAISYNEETFPFPKEMTVEQIHELVEAWKASAQRALKAGFDLIEIHAAHGYLISEFLSPISNQRTDQYGGSFENRTRVLREIISAVRSVIPEDMPLFVRVSATEWMEYTGQPSWDLQQTIELAKILPDLGVDLLDVSSGGNNKDQKINVHTYYQIDMAEQIRAAVHEAGKQLLVGAVGLVTSAEIAKETVQEKEDGRVTIQRENGAKTRADMVLVARQFLKEPEFVLTVADELGVDVKAPVQYLRGPLSSRPKKLTTVP

SEQ ID NO: 1743 - protein, 1123 aa, Lycopersicon esculentum
MSSSRPSQSSTTSSRSKHSARIVAQTSIDAKLHADFEESGDSFDYSSSVRVTSVAGDEEKPKSDKVTTAYLHQIQKGKFIQPFGCLLALDEKTLKVIAFSENAPEMLTMVSHAVPSVGEHPVLGIGTDIRTIFTGPSGAALQKALGFGEVSLLNPVLVHCKNSGKPFYAIVHRVTGSLILDFEPVKPYEVPMTAAGALQSYKLAAKAITRLQSLPSGSMERLCDTMVQEVFELTGYDRVMGYKFHEDDHGEVVSEITKPGLEPYLGLHYPATDIPQAARFLFMKNKVRMICDCRAKHVKVVQDEKLPFDLTLCGSTLRAPHYCHLQYMENMNSIASLVMAVVVNDGDEEGESSDSSQSQKRKRLWGLVVCHNTTPRFVPFPLRYACEFLAQVFAIHVNKELELENQFLEKNILRTQTLLCDMLMRDAPLGIVSQSPNIMDLVKCDGAALLYKNKIHRLGMNPSDFQLQDIVSWLCEYHTDSTGLSTDSLYDAGFPGALALGDAVCGMAAVRISDKDWLFWFRSHTAAEVRWGGAKHEPGEKDDGRKMHPRSSFKAFLEVVKTRSIPWKDYEMDAIHSLQLILRNAFKDAEVVNSNTNSIYKKLNDLKIDGMQELESVTAEMVRLIETALVPILAVDVDGQVNGWNTKIAELTGLPVDEAIGKHLLTLVEDSSVDTVNKMLELALQGKEEKNVEFEIKTHGPSRDSSPISLIVNACASKDVRDNVVGVCFMAHDITGQKSIMDKFTRIEGDYRAIIQNPHPLIPPIFGTDQFGWCSEWNTAMTKLTGWRRDDVMDKMLLGEVFGTQAACCRLKNQEAFVNFGVVLNNAITGQESEKIPFGFFARYGKYVECLLCVSKRLDKEGAVTGLFCFLQLASHELQQALYVQRLSEQTALKRLKVLAYIRRQIRNPLSGIIFSRKMLEGTSLGEEQKNILHTSAQCQRQLNKILDDTDLDSIIDGYLDLEMLEFKLHEVLVASISQVMMKSNGKNIMISNDMVEDLLNETLYGDSPRLQQVLANFLLVSVNATPSGGQLSISGRLTKDRIGESVQLALLEFRIRHTGGGVPEELLGQMFGSEADASEEGISLLVSRKLVKLMNGEVQYLREAGQSTFIISVELAVATNSS

SEQ ID NO: 1744 - protein, 348 aa, Gloeobacter violaceus
MDTTPLTPLTKGITLYQHILSQQALNPDATGEFSGLMVQISLAAKLISRQLAQAGLVENVLGFTGETNVQGEAVRHLDQYANETFIRVFQNTNLVCLLVSEELEDPLPLSNQCPIGSYALVIDPVDGSSNIDVNVSVASIFSVQRRNPRATDETSSLLQKGTGQVAAGYVLYGPNTMFVYTSSQGVHGFTLDAGLGEFVLSHPNIRIPERGDYYSINDAYSAEWQPGTRAFIDYLKQAKSRGEKAYSARYIGSLAADVHRTLLTGGIFLYPGTVAKPKGKLRLLYEAQPLALIAEQAGGKASTGTERILDIEPKTLHQRVPLVIGSPYEVDLAVAFARGEKQTVVAGS

SEQ ID NO: 1745 - protein, 192 aa, Sequoiadendron giganteum
DDHGEVISEIRRSDLEPYLGLHYPATDLPQASRFLFMKNKVRMICDCYATPVKVVEDNRLPRELILCGSTLRAPHGCHAEYMSNMGSIASLAIAVTINAKEEDGDTDGQQQQQKGRRLWGLVVCHHTSPRFVPFPMRYACEFLMQVFAIQLNKEVELADQLREKHILRTQTLLCDMLLRDAPMGIIRQKPNI

SEQ ID NO: 1746 - protein, 255 aa, Neurospora crassa
MSDSPQSNSKDVEQGAPSPGEEPQMNDPQDPHSSGLNQYEFEVKEQDRWLPIANEHFQNKRCAYSLYTSMSHHSSSKSPEAPRASSSSSKADRCDAYDANIRNFAPVARIMKNALPENAKIAKEAKECMQECVSEFISFITSEASEKCQQEKRKTVNGEDILFAMTSLGFENYAEALKIYLSKYREQQQNQTNRSENQQNRPSSQGYGAPQGQNQPGQGGFSSNDLGGQQESGDASGYNLYGAQTGHNGGGAEGY

SEQ ID NO: 1747 - protein, 251 aa, Salmonella typhimurium
MNLNSIPAFQDNYIWVLTNDEGRCVIVDPGEAAPVLKAIAEHKWMPEAIFLTHHHHDHVGGVKELLQHFPQMTVYGPAETQDKGATHLVGDGDTIRVLGEKFTLFATPGHTLGHVCYFSRPYLFCGDTLFSGGCGRLFEGTPSQMYQSLMKINSLPDDTLICCAHEYTLANIKFALSILPHDSFINEYYRKVKELRVKKQMTLPVILKNERKINLFLRTEDIDLINEINKETILQQPEARFAWLRSKKDTF

SEQ ID NO: 1748 - protein, 474 aa, Streptococcus pyogenes
MGIFPKDFLWGGAVAANQVEGAFEADAKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKGKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTAWGCIDCVSMSTAQLSKRYGFIYVDRNDDGTGQLTRYKKKSFDWYRQVIQTNGRYLEDNFS

SEQ ID NO: 1749 - protein, 551 aa, Unknown
  Candidatus Legionella jeonii
MAKELRFGDDARQQMLAGVNALADRVKATMGPSGRNVVLERSFGAPTVTKDGVSVAKEIEFENRFKNMGAQMVKEVAAKTSDTAGDGTTTATVLARSIVVEGHKAVAAGMNPMDLKRGIDKAVTAITKELQKMSKPCKDGKAIAQVGTISANSDQAIGSIIAEAMEKVGKEGVITVEDGNGLENELSVVEGMQFDRGYISPYFINNQQNMSAELEHPFILLVDKKIATIRDMLSVLEAVAKSGRPLLIVAEDVEGEALATLVVNNMRGIVKVCAVKAPGFGDRRKAMLQDIAILTNGQVISEEIGTSLETASLESLGTAKRIVVTKENTTIIDGEGKATEINARIAQIRAQMEETSSDYDREKLQERVAKLAGGVAVIKVGAATEIEMKEKKARVEDALHATRAAVEEGIVAGGGVALIRAQKVLDGLKGDNADQDMGINILRRAIESPLRQIVANAGYESSVIVNKVAEHKDNFGFNAATGQYGDMVEMGILDPTKVTRTALQNAASVRSLMLTTECMVADLPKKDEGMAGAGDMGGMGGMGGMGGMGMM

SEQ ID NO: 1750 - protein, 341 aa, Arabidopsis thaliana
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 1751 - protein, 570 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQCQAAEATDEPVKVKVKVKCSNQIRRRRRQV

SEQ ID NO: 1752 - protein, 83 aa, Arabidopsis thaliana
  misc_feature (53)..(53): Xaa can be any naturally occurring amino acid
AMYSFPQIRLPTGALQAAKQAGKVPDVFYCLKLLEATGISTVPGSGFGQKEGXDEMPEIMDSFKKFNDEFMTQYDNNFGYSKM

SEQ ID NO: 1753 - protein, 231 aa, Magnolia praecocissima
ENKINRQVTFAKRRNGLLKKAYELSVLCDAEVALIIFSNRGKLYEFCSSSSMLKTLERYQKCNYGAPELPVSTRETQSYHQEYLKLKARVEALQRSQRNLLGEDLGPLSGKELETLERQLDISLRQIRSTRTQCMLDQLGDLQRREHMLSEANKTLTRRLEEGAQANQNQVWEPNAHAVDSYNRQQPQQQGDGFFHPLECEPTLHIGYQPDQITIAAPGPSVNNYMPGWLV

SEQ ID NO: 1754 - protein, 485 aa, Arabidopsis thaliana
MSGVVRSSPGSSQPPPPPPHHPPSSPVPVTSTPVIPPIRRHLAFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQLQAEIENLALEEQALDNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 1755 - protein, 274 aa, Crocosphaera watsonii
MTVAASKKLSYDWTIIIYMASIHLVALLAFLPGNFSWQAVGVTLLLYWVTGALGITLGFHRLVSHRSFKSPKWLEYLLVFFGTLACQGGPIQWVGLHRIHHKYSDTEPDPHDSNKGFWWSHMAWMLHQIPADNDVPRYTKDINEDPFYNFCQSFMIPIQIVLGLALYFLGGWSFVIWGIFVRLVMVFHFTWFVNSATHKFGYQSHESNDNSRNCWWVALLTFGEGWHNNHHAYQYSARHGLAWWEIDITWMTIQVLQFLGLAKNVKLAPVADKK

SEQ ID NO: 1756 - protein, 823 aa, Triticum aestivum
MATFAVSGATLGVARPASAGGGLLRSGSERRGGVDLPSLLLRKKDSSRAVLSRAASPGKVLVPDGESDDLAATPAQPEELQIPEDIEEQTAEVNMTGGTAEKLESSEPTQGIVETITDGVTKGVKELVAGEKPRVVPKPGDGQKIYEIDPTLKDFRSHLDYRYSEYKRIRAAIDQLEGGLEAFSRGYEKLGFTRSAEGITYREWAPGAHSAALVGDFNNWNPNADTMTRDDYGVWELFLPNNADGSPAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLDEYKFDGFRFDGVTSMMYTHHGLQMTFTGNYGEYFGFATDVDAVVYLMLVNDLIHGLYPDAVSIGEDVSGMPTFCIPVPDGGVGFDYRLHMAVADKWIELLKQSDESWKMGDIVHTLTNRRWLEKCVTYAESHDQALVGDKTIAFWLMDKDMYDFMALDRPSTPRIDRGIALHKMIRLVTMGLGGEGYLNFMGNEFGHPEWIDFPRGPQTLPTGKVLPGNNNSYDKCRRRFDLGDADFLRYRGMQEFDQAMQHLEEKYGFMTSEHQYVSRKHEEDKVIIFERGDLVFVFNFHWSNSFFDYRVGCSKPGKYKVALDSDDALFGGFSRLDHDVDYFTTEHPHDNRPRSFSVYTPSRTAVVYALTE

SEQ ID NO: 1757 - protein, 379 aa, Glycine max
MGKTAYKRLKGSQSFRQRLLLSTLSSTPILIEDIRADETWPGLRNHEISLLRLFETVCDDCHVEINETGTKLKYKPGTIMGGRQHSPHDCGVSRSIGYFLEPLIVLCLFAKQPLTIRLKGITNDSKDPSVDTFKSTTLPILKRFGVPSEGLEIKVESRGLPPNGGGEVLLSVPVVQSLTAVSWIDEGFVRKIRGTSFSTRVSVQFEYGMIKAARGIINPLVSDVHIFSDHRSGPEAGNSPGYGISLVAETTSGCFISVDTAVSQVRDDDTSGLADDAKRDLMPPDDIGVGIASALLGEIAQSGVVDSTHQGLLFLLCALCPQDVSKVRVGKLSQHGVETLRNLRDFLDLKFIIKPDPNSQSVFLKCIGYGMKNLSRKVS

SEQ ID NO: 1758 - protein, 816 aa, Arabidopsis thaliana
MASSSLSNLMLAIHEKKTSSVDLYRPLRNYVTFTYSEREAQLIDDDLETLKQLRSDIERVSDPSPAARRDLLISYYKVLCLVETRFPISPDKDHVNAVSFVWYDAFKQKHKATQQNIHLEKAAVLFNLGASYSQIGLGHDRTTVDGRRQASHAFMAAAGAFAHLRDNESIKATIGPSTTVDVSVECVGMLERLMVAQAQECVFENTIAKGSTPGVSAKIARQLKAALFYGEACFRYGKELHEKEEIAEEIARLRSGASRLAEAKKSSRGAPAQLIEAMNTLESSINGNLDRAVKENDRVYLMRVPSPSSLSPLPAFSMVKPMNMTDILDASKEKMFSILVPDSSAKALSRYTEMVDDVIRTQAERLQQASELTRVRLKEMDLPDSILAVDGNSALPVDLKEDVEAVQISGGPAGLEAELQQLRDLKRVNQELLVHTEELLQKEATEDSQFRSQFGTRWTRPQSSTLTKNLQDRLNRFAANLKQAGESDVKIERSVRDNSALMSILDRRPIESAVPTLARPIMSLDATEDAIVGTLKQSLRQLENLGAQRAGLEDMLKEMKRKDDILPKLMTITGSYEDMFRKEISKYDHICEDISQNIEVQEQLLMQIQAQNEEFSTIFNLEDYKASKEKCYKQIQAAIMKYREIKENINEGLKFYVTLQDAITNVKQQCSDFVMTRSIQCRDMIEDVQRQMSGLSFQDHRSSGPYPSVHQPTASSPPPPPETQNPSHPHPHAPYYRPPEQMSRPGYSIPPYGPPPPYHTPHGQAPQPYPPQAQQQPHPSWQQGSYYDPQGQQPRPPYPGQSPYQPPHQGGGYYRQ

SEQ ID NO: 1759 - protein, 282 aa, Saccharomyces cerevisiae
MVPKFYKLSNGFKIPSIALGTYDIPRSQTAEIVYEGVKCGYRHFDTAVLYGNEKEVGDGIIKWLNEDPGNHKREEIFYTTKLWNSQNGYKRAKAAIRQCLNEVSGLQYIDLLLIHSPLEGSKLRLETWRAMQEAVDEGLVKSIGVSNYGKKHIDELLNWPELKHKPVVNQIEISPWIMRQELADYCKSKGLVVEAFAPLCHGYKMTNPDLLKVCKEVDRNPGQVLIRWSLQHGYLPLPKTKTVKRLEGNLAAYNFELSDEQMKFLDHPDAYEPTDWECTDAP

SEQ ID NO: 1760 - protein, 405 aa, Mycobacterium avium
MPTPPDVFSPAKLGPITLRNRIIKSATFEARTPDALVTDDLIEYHRLPAVGGVGMTTVAYCAVSPGGRTEGNGIWMRPEAVPGFRRLTDAIHAEGAAVSAQIGHAGPVANARSNKAQALAPVRFFNPIGMRFAKKATRDDIDEVIAAHANAARLAIEAGFDAVEIHLGHNYLASSFLSPLINRRNDEFGGSLQNRAKVARGMVMAVRRAVEKEGTPIAVTAKLNMADGVRGGISTEESLTTAKWLESDGGLDAIELTAGSSLVNPMYLFRGDAPLKEFAGAFKPPLRWGMRMTGKKFLREYPYRDAYLLRDAKLFRAELKMPLILLGGITNRETMDLAMAEGFEFVAMARALLAEPDLINRIAADGAAHRVHSACTHCNQCMPTIYSRTHCVVTGAPDRHTSAAT

SEQ ID NO: 1761 - protein, 617 aa, Armoracia rusticana
MTTNKKTIVWFRRDLRIEDNPALAAAAHEGSVFPVFIWCPEEEGQFYPGRASRWWMKQSLAHLSQSLKALGSELTLIKTHNTVSAILDCIRITGATKVVFNHLYDPVSLVRDHTVKEKLVELGISVQSFNGDLLYEPWEIYFEKGKPFTNFSSYWKKCLDMSIESVMLPPPWRLMPISTAAEAVWACSIEELGLENETEKPSNALLTRAWSPGWSNADKILNEFIEKQLIDYAKNSKKVVGNSTSLLSPYLHYGEISIRRIFQCARMKQIIWARDKNSEGDESADLFLKGIGLREYSRYICFNFPFTHEQSLLSHLRFFPWDTDVDKFKAWRQGRTGYPLVDAGMRELWATGWMHNRLRVIVSSFAVKFLLLPWKWGMKYFWDTLLDADLECDILGWQYISGSLPDGHELDRLDNPAIQGAKYDPEGEYIRQWLPELARLPTEWIHHPWDAPLTVLKASGVELGTNYAKPIVDIDTARELLTKAISRTREAQIMIGAAPDEIVVDSFEALEGNTVKEPGLYPSVSSNDQQVPSAVRYNGSKRVKHVEEEERDMKKSRGFDEVMREERDLFSTAESSSSSTTVRFLVSHSCSLVSEGKSLEGIQDPSDQITTSLGKNC

SEQ ID NO: 1762 - protein, 570 aa, Euglena gracilis
TMNRAGVLARRGYSSKGKDILFGVDARVKMLAGVNRLSQAVSVTLGPKGRNVVIEQPFGAPKITKDGVTVAKAIEFKDSFENLGAQLVRQVANTTNEIAGDGTTTSTVLANAIFSEGYKAVTQGTSPVDMKRGIDRAVEVVLQSLTEQSKTIVSKEEVTQVATISANGDVEIGQLIGHAMEKVGKAGVITVSDGKTLDTELEVVEGMSLDRGYISPYFVTNAKTQKVEIEDAFILLCQKKVSTIQQILPVLEHIAKANRPLVIIADDVDSEALATLIINKINGKLKVCAVKAPGFGDNKTNMLHDVAIFTGGEVYNEELGMNLEQHFDHRILGFAKKVSVGKDQTIILNGAGDPKAVEERKELIQGMLGKTDSSYEKEKLNERLAKLSGGVAVIKVGGASDVEVGEKKDRVTDALNATRAAVSEGIVPGGGAALLYASSALAELAADPTLTEDQKTGVRIVMSAIKLPAITIVKNAGGEGAVVIHQLLAEKKMQQGYDAQQGKYVNMFEAGIIDPAKVVKTALVDAASVAGLMITTEAAITDIPAPAPAAGGGMDGMGGMGGMGGMGGMY

SEQ ID NO: 1763 - protein, 617 aa, Armoracia rusticana
MTTNKKTIVWFRRDLRIEDNPALAAAAHEGSVFPVFIWCPEEEGQFYPGRASRWWMKQSLAHLSQSLKALGSELTLIKTHNTVSAILDCIRITGATKVVFNHLYDPVSLVRDHTVKEKLVELGISVQSFNGDLLYEPWEIYFEKGKPFTNFSSYWKKCLDMSIESVMLPPPWRLMPISTAAEAVWACSIEELGLENEAEKPSNALLTRAWSPGWSNADKILNEFIEKQLIDYAKNSKKVVGNSTSLLSPYLHYGEISVRRIFQCARMKQIIWARDKNSEGDESADLFLKGIGLREYLGIYVSISRLLTSNLCGVIFVFSLGMADVDKFQGLETRQDWLSVGGCRNERALGYGCMHNRLRVIVSSFAVKFLLLPWKWGMKYFWDTLLDADLECDILGWQYISGSLPDGHELDRLDNPAIQGAKYDPEGEYIRQWLPELARLPTEWIHHPWDAPLTVLKASGVELGTNYAKPILDIDTARELLTKAISRTREAQIMIGAAPDEIVADSFEALEGNTVKEPGLYPSVSSNDQQVPSAVRYNGSKRVKHVEEEERDMKKSRGFDEVMREERDLFSTAESSSSSTTVRFLVSHSCSLVSEGKSLEGIQDPSDKITTSLGKNG

SEQ ID NO: 1764 - protein, 753 aa, Zea mays
HQLQTSEKRRVGGKLLLYDSCAHSSTVLGNLGGEEEESSGSQRTTHYSWLHGFLTSLCGGDPAMRIVVWFRRDLRVEDNPALAAAARAGGEVVPAYVWSPEEEGPYYPGRVSRWWISQSLNHLDASLRRLGAGKLVTRRSADAAVALLQLVRDTGATHVYFNHLYDPISLVRDRRLKEMLAAEGIVVQSFNSDLLYEPWEVVDDEGQPFTMFDPFWNRCLSMPYDPPAPLLPPKRINSGDLSMCPSEDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVDESYFKIWRQGRTGYPLVDAGMRELWATGWLHDRIRVVVASFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPIVELDAAKGRLQAALSEMWQLEAASRATMNNGTEEGLGDSSEVLFPQELQMEVDRQPAPAEAAANVHVHVHVPMPARRRGDQMVPTMTTSSLNRAGTEVSADLVVANSEEEDTRAQVPFHAHLHLHPRAEAPPAARRTNNGARQHDVFQQPRNHRRDALLAPSASEASSSWTGREGAVVPVWSPPAASGHSDAFAADEADVSSRSYLGRHPQSHRLMNWSQLSQSS

SEQ ID NO: 1765 - protein, 99 aa, Carica papaya
MEPGIVIGGLQDVEGDANNLEYQELARFAVDEHNKKTNAMLQFKRVVNVKQAVVEGLKYCITLEAVDGHKTKVYEAEIWLKLWENFRSLEGFKLLGDAH

SEQ ID NO: 1766 - protein, 389 aa, Unknown
  Acinetobacter sp. ADP1
MNPPLPQAPINWIAVFALIFLPVLAIIAIPLYAYHHDFSIGAWVSMFVLLGMSSLGITAGYHRLWAHRAYEATLPLKIMLMIMGTFAVQNSILFWASGHRTHHRHVDDIEKDPYSIKNGFWYAHFGWMLRNYPAAEPDFKNAPDLLNDKLVMFQHKYYVALVIATHVVILTAVGWAVGDIWGVVLLGGLLRLILSHHVTFFINSLCHMWGKRPYTDENTARDNFWLAIATWGEGYHNYHHIFQYDYRNGVKWWQYDPTKWLIWSCSKLGLAKNLRRIPSFNIKKAELAMKFKYAEQDLAIYGHDVNSDLAQMKQRIAQEYDAFTHTLNDWAKLKEQELQSKKAAVAEKLHQMDHKLKVDFQLLEHRLSHHRECLETLMRNVKKRNTVSE

SEQ ID NO: 1767 - protein, 617 aa, Armoracia rusticana
MTTNKKTIVWFRRDLRIEDNPALAAAAHQGSVFPVFIWCPEEEGQFYPGRASRWWMKQSLAHLSQSLKALGSELTLIKTHNTVSAILDCIRVTGATKVVFNHLYDPVSLVRDHTVKEKLVELGISVQSFNGDLLYEPWEIYCEKGKPFTSFSSYWKKCLDMSIESVMLPPPWRLIPITAAVEAVWACSIEELGLENDAEKPSNALLTRAWSPGWSNADKILNEFIDKQLIYYAKNSNKVVGNATSLLSPYLHYGEISVRRVFQCARMKQIIWARDKNSEGEESTDLFLKGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSLPDGHELDRLDNPAIQGAKFDPEGEYIRQWLPELARLPTEWIHHPWDAPLTVLKASGVELGTNYVKPIVDIDTARELLTKAISRTREAQIMIGAAPDEIVADSFGALEGNTVKETGLCPSVSSNDQQVPSAVRYNGSKRVKHVEEEERDMKKSRGFDEVMREERDLFSTAESSSSSTTVRFLVSHSCSLVSEGKNLEGIQDPSDQITTKLGKNG

SEQ ID NO: 1768 - protein, 495 aa, Medicago truncatula
MKKVSLYACLLLNLSLLVIFPYSKASQADKFNEFILSRKSQNPPKTLSWEEGDALKTHSFSAAYVAPPQEELRLADKIVTLPGQPYGVNFDQYSGYVTVDPEAGRELFYYFVESPHNSYTKPLILWLNGGPGCSSLGYGAFEELGPFRVNSDGKTLYRNPYAWNEVANVLFLESPAGVGFSYSNTSSDYDNSGDKSTAKDAYVFLINWLERFPQYKTRDFYITGESYAGHYVPQLASTILYNNKLYNNTIINLKGISIGNAWIDDATNLKGIYDNLWTHALNSDQTHELIEKYCDFTKENVSAICNNATDKAFVETGKIDIYNIHAPLCHDSSLKNGSSTGYVSNDFDPCSDYYVTAYLNRPEVQKALHAKPTNWTHCTHLLTTWKDSPATVLPTVKYLIDSGIKLWIYSGDTDVVVPTTSSRYLINTLKLPINSAWRPWYSGKEIGGYVVGYKGLTFVTVRGAGHLVPSWQPERALTLISSFLYGILPSGSPSN

SEQ ID NO: 1769 - protein, 647 aa, Unknown
  Bradyrhizobium sp. BTAi1
MCGLAGVWCWDTPIDRPAIARALGLLDHRGPDGNGLWISEDGKVALGHTRLSIIDLVTGEQPLSHPNGKLQLVVNGEFYDYERIRNDLTARGARFRTRSDSEIALWLYDESGTRCFADLNGEFAFILWDAGAGRLIAARDRFGIKPLFYAVQSGRILLASEIKALLAMGVPAQWDVEGYLDAAHVLQNGTLFSGIRQVPPGCYLSATRHGITIQRYWDAPFASALSPIEDEHGALDQIRAQMSRATRWRMRADVPVAAYLSGGIDSMSVLALAAATTNRAPDAFTIAYEDAAYDESHRAESFATQLGTRFHRVPVNGAALADHFATSLWHSETACFNPHGTAKFILSKAVRDAGYKVVLTGEGADEIFAGYAPSRVDALGGSAAMQAMIATRDRATYAVTPQHTATDQLPLIAQRFGTVPTWLRHQMAHLLGVADLLRDDLRTAWSTDRPLAAFLKYLEPWTVPALDTVDLGIALMLKTTLPNYVLVTLGDRMEMAHSIEGRLPFLDHQVVELAWRLPSHLKIRDGVEKFALRQAMRNLLPADAVDRQKHPFIAPPTATDAKHPFGAMIRDVLHGPALAALPFFEPRKVRKLIDRLTSLPPEDRLRLEPLLVEIASLCIIHDLFKMSSSSDPSAQLSIQMPSTEALA

SEQ ID NO: 1770 - protein, 446 aa, Triticum aestivum
SLQLSHTLRHQITVGSSIPINLPVVNQVFSSNRAIIIPHTSPLARIRPLAGRYVPPEVAAVRVPLLNLSNFQINDWPELSAKSYAIMVLMLPSDSARNWHVHELELVEVVADQVAVALSHAVILEESMRARDLLMEQNVALDLARREAEMAIRARNDFLAVMNHEMRTPMNAIIALSSLLLETELTPEQRLMVETVLKSSNLLATLINDVLDLSKLEDRSLELEIRAFNLHAVFKEVMGFIRPIAAIKRLSMSVMLTPDLPLCAIGDEKRLMQTILNISGNAVKFTKEGHITLLASVLKPDSLREFRTPDFHPAASDDHFYLKVQLKDTGCGISPQDLPHVFTKFAQTQPGGNQGYSGSGLGLAICRRFVTLMGGHIWLDSEGAGRGCTATFIIRLGVSDNTDAYQQQLAPLAWPGSANVESAGPKALHEETWPPSSLKPRYQRSV

SEQ ID NO: 1771 - protein, 345 aa, Oligotropha carboxidovorans
MAQGQTLHQHLTGFAATDPAHGPVADVVAAFAIAATEISELISGGLLSGITGEGQTRNSDGDVQKDLDIKADQIIRAALAGTSVAALASEEAEEIEICDPAGAVSVAFDPLDGSSNINTNMSVGTIFSIVRTPSHARAAFTQPGSAQLAAGFVVYGPQTSLVLTLGDGVDVFTLDRKAKVFQKVRSRVQIPAQTPEYAINASNRRFWDPLIVAFIEDCLAGKDGVMQADFNMRWIGSMVAEAYRILVRGGIFLYPGDTREGYGEGRLRLLYEAHPIAFIMEQAGGGATTGRQRILDITANTPHQRVPLIMGSIDSVRRIERMHGSPDIKFERNPPLFATRGLFRI

SEQ ID NO: 1772 - protein, 573 aa, Candida albicans
MCGIFAAYRQPEVEDFKSKALQYSKLIRHRGPDWSGNVVQNSTILCHERLAIVGLDSGAQPIVSPDGNFTLAVNGEIYNHIQLREQFPDYKFKSLSDCEPIIPLFTKYDIDAPKHLDGMFAWVLYDKKNDRIVAARDPIGITTLYMGKSSKSPKTRYFASELKCLIEECDEIFAFPPGHVYDSNTDEITRYFQPSWWDASKVPEQHVDFKKVRETLELAVRKRLMAEVPYGVLLSGGLDSSLIASIASRETKKAAQASFNPEGIDANKELSGVDDKGSLHSTGVFNQLHSFAIGLPGAPDLLAAEKVAHFIGTIHHSHTFTLEEGLDALDDVIYHLETYDVTTIRASTPMYLLSRKIKAQGVKMVLSGEGSDEIFGGYLYFANAPSAKEFHEECVKRVKNLHYADCLRANKSTMAWGLEARVPFLDKQFLEVCMNINPEDKLIQPGKIEKYILRKAFDTSDEPDVKPYLPEEILWRQKEQFSDGVGYSWIDGLKDTAEKMVSDEEFAHPKPEWGDDIPTTKEAYWYRCKFDKMFNGSKAAASTVMRWIPKAEWGCHADPSGRYAATHDHKVAQ

SEQ ID NO: 1773 - protein, 480 aa, Pseudomonas putida
MHLTWLRSDLRIDDNTALSASTERGPTIALWLVSPGQWQAHDDADCKVDFWLRNLHDLRQSLEKLNIPLLIRTIDTWDQAPQAVLDICRQHQVQSVHWNEEYGINEQRRDDATRAMLEKSAIQAHSHLDQLFFRPGTVLTRSGDYFQVFSQFKKTCLEHLHRSLPALARRVKRQAPLNIGSDPIPQHVEGFGKTTPALRDHWPAGEAEAQSRLSRFLDETIDDYHHLRDLPAKPGTSQLSPYLAAGVISPRQCLHGALAGNRGEFDSGSTGVQTWINELLWREFYKHILSGYPQVSRHRAFRAQTEALPWRDAPADLAAWEQGRTGFPIIDAAMRQLLHTGWMHNRLRMVVAMFLSKNLLIDWRKGERHFMRHLIDGDLAANNGGWQWSASTGTDAVPYFRIFNPVSQSQRFDPQGRFIRHWVPELQELDEKAIHQPIKSTDLFGNTSYLSPIVDLSSSRQRALEAFKGLPRRQNQGITS

SEQ ID NO: 1774 - protein, 222 aa, Triticum aestivum
MGQQSLIYAFVARGTVVLAEYTEFTGNFTTIASQCLVKLPASNNKFTYNCDGHTFNYLVEDGFTYCVVAVESVGQQMPIAFLVRVKDDFSKRYAGGKAATAAPSSLNREFGSKLKEHMQYCVDHPEEINKLAKVQAQVSEVKNVMMENIEKVLDRGEKIELLVDKTENLRSQAQDFRQQGTQVRRKMWLQNMKIKLIVLGIIVALILIIILSVCHGFNCGKK

SEQ ID NO: 1775 - protein, 705 aa, Pseudomonas fluorescens
MRYQLSPRRISMKHLLPSTALALFIGIGLLPVSGTTFAANSWDKLQPDRDEVIASLNVVELLKRHHYSKPPLDDARSVIIYDSYIKLLDPSRSYFMASDIAEFDKWKTQFDDFLKSGDLNAGFTIYKRYLDRVKARLDFALAELNKGVDKMDFTTKETLLIDRKDAPWLKSTAELDDLWRKRVKDEVLRQKIAGKEPKQIQETLTKRYKNQLARLDQTRAEDIFQAYINTFAMSYDPHTNYLSPDNAENFDINMSLSLEGIGAVLQSDNDQVKVVRLVPAGPADKTKQVAPADKIIGVAQGNKEMVDVVGWRLDEVVKLIRGPKGTVVRLEVIPASNAPNDQTSKIVPITREAVKLEDQAVKKSVLNLKQDGKDYKLGVIEIPAFYLDFKAFRAGDPDYKSTTRDVKKLLTELQKEKVDGVVIDLRNNGGGSLQEATELTSLFIDKGPTVLVRNADGRVDVLEDENPGAFYKGPMALLVNRLSASASEIFAGAMQDYHRALIIGGQTFGKGTVQTIQPLNHGELKLTLAKFYRVSGQSTQHQGVLPDIDYPSIIDTKEIGESALPEAMPWDTIRAAIKPASDPFKPYLAQLKSEHDTRSAKDAEFVFIRDKLALAQKLLEEKTVSLNEAERRAQHADIDAKQLAMENIRRKAKGEEPLKELKKEDDDALAAAEPDKVKPEDDAYLSETGRVLLDYLKLSNQVAKK

SEQ ID NO: 1776 - protein, 88 aa, Kluyveromyces lactis
ARPAFVNKLWSMVNDKSNEKFIHWSTSGESIVVPNRERFVQEVLPKYFKHSNFASFVRQLNMYGWHKVQDVKSGSNDSRWEFENERHA

SEQ ID NO: 1777 - protein, 633 aa, Unknown
  Phalaenopsis hybrid cultivar
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDKEMGLIRTQEETGRHVRMLTHEIRSTLDRHTILRTTLVELGRTLDLAECALWMPSRTGLNLQLSHTLNNQIPVGSVVSINLPVVNQVFNSSRAVRIPHTCQLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVSLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNLMKGHIWLESEGIGKGCTTIFIVKLGISEDPAHRYQHKLLPPIRAGQSEADAFGSKRMPTDLIPLKNRYQRSL

SEQ ID NO: 1778 - protein, 257 aa, Coxiella burnetii
MPHNILAIPALNDNYIWTIVHPQKQAAVIIDPGEAKPVLDFLKQQKLNLAAILVTHHHWDHTNGIQGILQKHPAPVYGSVESAIPFCDHPIVDGQTFSIPYAELTFNVLAIPGHTLDHVAYYADQWVYTGDTLFAGGCGRIFEGSPDQFYHSLQKLASLGPTTRVYCGHEYTVKNLEFAETVEPDNPKLKQRIVETGQKASQNLPTLPSTLQVELDTNPFLRCHQKNIQRRVQEYCGYPLADTVAVFSALRRWKDEF

SEQ ID NO: 1779 - protein, 542 aa, Listeria monocytogenes
MAKDIKFSEDARRAMLRGVDQLANAVKVTLGPKGRNVVLEKKFGSPLITNDGVTIAKEIELEDPFENMGAKLVSEVASKTNDVAGDGTTTATVLAQAMIQEGLKNVTAGANPVGVRRGIEKAVATAIEELKAISKPIESKESIAQVAAISSGDEEVGKLIAEAMERVGNDGVITIEESKGFATELDVVEGMQFDRGYTSPYMVTDSDKMEAVLEKPYILITDKKINNIQEILPVLEQVVQQGRPMLIIAEDVEGEAQATLVLNKLRGTFNVVAVKAPGFGDRRKAMLEDIAILTGGQVITEDLGLELKTATVDQLGTANKVVVTKDDTTIVEGAGDSTQISARVNQIRAQMEETTSEFDREKLQERLAKLAGGVAVVKVGAATETELKERKLRIEDALNSTRAAVEEGIVAGGGTALVSIYNKVAALEAEGDVETGINIVLRSLEEPVRQIAHNAGLEGSVIVERLKHEAVGVGFNAANGEWVNMIDAGIVDPTKVTRSALQNASSVAALLLTTEAVVADKPDENGPAAVPDMGMGGMGGMM

SEQ ID NO: 1780 - protein, 526 aa, Cyanidioschyzon merolae
MSKRILYQEQARRALSQGMDILAEAVAVTLGPKGRNVVLEKKYSCPQIVNDGVTIAKEIDLANHMQNTGVCLIRQAASKTNEVAGDGTTTATVLAHAMIKQGLKYVASGANPMALKTGMSLATQWLVSQIRDLAQPISDHLAIKQVASLSAGNDDQVGEMISQAFEQVGADGVISLEEGKSSQTQLQITQGMRFEKGYISPYFATAGDTVVLDQPYILLTDKKITLVKQDLLPVLTLVSRTNRALLIIADDVEKEALATLILNKLRGIIQVVAVRAPGFGDRKKALLEDMAVLTGGQVITQEAGLSLETITLDLLGEARRIEVGKSYTTIVADSNKQQVKARCEQIKQQWARSDSSYEKQQLQERLAKLSSGVAVIQVGGATEAEMKDKKLRLDDAINATRAAIEEGIVAGGGSTLVHFIKPLIEWSHHLKPEEQLGAQIVAKALSAPLHRIATNAGQNGSLIVEQVQNQPNLGYDAANHRFVNMIEAGIIDPAKVTRCALQNATSIAAMVLTTECMIVDKPSGDK

SEQ ID NO: 1781 - protein, 617 aa, Armoracia rusticana
MTTNKKTIVWFRRDLRIEDNPALAAAAHEGSVFPVFIWCPEEEGQFYPGRASRWWMKQSLAHLSQSLKALGSELTLIKTHNTVSAILDCIRVTGATKVVFDHLYDPVSLVRDHTVKEKLVELGISVQSFNGDLLYEPWEIYCEKGKHFTIFSSYWKKCLDMSIESVMLPPPWRLRPITAAADAVWACSIEELGLENDAEKPSNALLTRAWSPGWSNADKILNEFIDKQLIYYAKNSKKVVGNSTSLLSPYLHYGEISVRRVFQCARMKQIIWARDKNSEGEESTDLFLKGIGLREYSRYICFNFPFTHEQSLLSHLRFFPWDTDVDKFKAWRQGRTGYPLVDAGMRELWATGWMHNRIRVIVSSFAVKFLLLPWKWGMKYFWDTLLDADLECDILGWQYISGSLPDGHELDRLDNPAIQGANFDPEGEYIRQWLPELVRLPTEWIHHPWDAPLTVLKASGVELGTNYAKPIVDIDTARELLTKAISRTREAQIMIGAAPDEIVADSFGALEGNTVKETGLCPSVSSNDQQVPSAVRYNGSKRVKHVEEEERDMKKSRGFDEVMREERDLFSTAESSSSSTTVRFLVSHSCSLVSEGKNLEGIQDPSDQITTKLGKNG

SEQ ID NO: 1782 - protein, 715 aa, Streptomyces coelicolor
MTRARPNWKGSPVWSGHPYPLEAAYDGQGTNFALFSEVAERVDLVLVDDDGNHSTVPLPDVDGFVWHCYLPGVGPGQRYGYRVHGPWAPAVGHRCNPAKLLLDPYTRAVDGLVDNHASLFERARGKADPGDSAGHTMLGVVTDPFFDWGDDRPPRRPYSESVIYEAHVRGLSRTHPDVPEELRGTYAGLAHPAVVDHLTSLGVTAVELMPVHQFVHDGVLLDRGLSNYWGYNTIGFFAPHNGYAALGTRGQQVSEFKSMVKTLHEAGLEVILDVVYNHTAEGNERGPTLSFRGIDNASYYRLVDGDWQHYYDTTGTGNSLLMRHPYVLQLIMDSLRYWVTEMHVDGFRFDLAATLARQFHEVDRLSAFFDLIQQDPVISRVKLIAEPWDVGEGGYQVGNFPQLWSEWNGKYRDAVRDFWRAEDHSLGEFASRLTGSSDLYQHSRRRPRASVNFVTAHDGFTLRDLVSYNDKHNEANGEDNRDGESHNRSWNCGAEGGTKDPAVRELRGRQQRNFLATLLLSQGIPMICHGDELGRTQRGNNNAYCQDNEISWIDWRLDGEQRALLDFARRLIALRADHPVLRRRRFFHGETLTHADQPLPDLVWLLPDAREMTDDDWQRSDAHTVGVFLNGDAIAEPDPRGRPVVDDSFLLLLNSHWEPADFRLPDAGYGERWTALVDTGDPDGVPDEAEHKAGTRLTVEQRSLVLLSRPSRTGR

SEQ ID NO: 1783 - protein, 275 aa, Schizosaccharomyces pombe
MLGSFVKLNNGLKCPQFAYGSYMVNRTKCFDSVYAALQCGYRHIDSAQMYHNEADCGRAILKFMEETGTKREDIWFTSKLNDLSGYKSTLSSIDASVKACGLGYIDLFLLHSPYGDRIESWKALEKGVEEGKLRAIGVSNFGPHHIQELLDSHPKIIPCVNQIELHPFCSQQKVVDYCESKGIQLAAYAPLVHGEKFGNKQLLAIASKYNKSEAQIMIRYCLQRGFIVLPKSSTPRRIKENGDVFDFEISKEDMEKLYNLDEDYHSDWNPCVSPL

SEQ ID NO: 1784 - protein, 164 aa, Lupinus polyphyllus
MARPQQRYRGFRQRHWGSWVSEIRHSILKTRIWQGTFESAEDAARAYDEAARLMCGTRARTNFPYNPNASQSSSSKLLSATLIAKLHRCYMASLQMTRPSSLPEAPRIIASPNNAVKGIGADAMLLPKKREQEEQETGGNLDFKKVKVECSQQFKPLEEDHIAQ

SEQ ID NO: 1785 - protein, 263 aa, Burkholderia fungorum
MNALEYVPVPAFDDNYIWVVSDGHSAVVVDPGEAAPVQAYLAKRGWRLSAILLTHHHQDHVGGVADLLNGQAVPVYGPAGEAIEHLTHRLKNGDHVSIAAPALELSVLDVPGHTSGHIAYFQAADPRGTPHVFCGDTLFACGCGRLFEGTPKQMLASLDALAALPGATEVHCAHEYTLSNIRFALACEPANAELQAWRDKAGELRARGVPTLPTTIAHERAVNPFLRAGNPAVQASLREQLHEKVPDRLTAFTLMREWKNRFR

SEQ ID NO: 1786 - protein, 308 aa, Neurospora crassa
MADHTEVDLDSIIDRLLEVRGSRPGKQVQLLEAEIRYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKFGRR

SEQ ID NO: 1787 - protein, 494 aa, Neisseria meningitidis
MSKPVFKKIALYTLGAISGVAVSLAVQGFAAEKDRRDNEVLPVQSIRTMAEVYGQIKANYYQDKPDADLFEGAMKGMVAGLDPHSEYMDKKGYAEIKESTSGEFGGLGMEIGQEDGFVKVVSPIEDTPAERAGVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDRMVLKAVPEDYVYGMGGDSLAGIPAELKTIPMTVLVNSGSASASEIVAGALQDHKRAVIVGTQSFGKGSVQTLIPLSNGSAVKLTTALYYTPNDRSIQAQGIVPDVEVKDKERIFESREADLVGHIGNPLGGEDVNSETLAVPLEKDADKPAVKEKGKKKKDEDLSSRRIPNPAKDDQLRKALDLVKSPEQWQKSLGLAAKKPVSNKDKKDKKDKK

SEQ ID NO: 1788 - protein, 146 aa, Unknown
  Magnetococcus sp. MC-1
MRFLHTMVRVADLEASLHFYRDLLGLVETQRKESQAGRFTLVYLAAPEDLERAKGEQAPEIELTYNWESECYSGGRNFGHIALLVEDIYAVCARMQQGGVTILRPPRDGHMAFFRSPDGISIELLQKGEALPMQEPWASMVNSGSW

SEQ ID NO: 1789 - protein, 185 aa, Brassica napus
RVIFHINYLGADQPTFTLNFSKGSSQIIAQYYQLIRLGFEGYKNVMQNCRENMLVLKEGIEKTERFNIVSKDVGVPLVAFSLKGQSFHSEFEISEMLRRFGWIVPAYTMPADAQHITVLRVVIREDFSRTLAERLVADILKVLHELDTLPSKISRKMGAEDFGNVKGKKVERDILMEVIVGWRKV

SEQ ID NO: 1790 - protein, 150 aa, Zea mays
PDQLNFLFRSSGLRFSNLYCDPLIIPGGHKITARQRWQPTPMQLQILESIFDQGNGTPSKQKIKEITAELSQHGQISETNVYNWFQNRRARSKRKQAAASLPNNAESEAEADEEPLADKKPKSDRPPPPPPPIQDNTKATGASSRIPSFV

SEQ ID NO: 1791 - protein, 594 aa, Unknown
  Frankia sp. CcI3
MCGLSGELRFDGRGANVDAVVRMTATMVPRGPDGVGVWSAGPVAFGHRRLKIIDLSECGAQPMVDNELGLTTVFNGCIYNYQELRDELIAAGYRFFSTSDTEVIGKAYHRWGRRCVDHFAGMFAFAIAERDSGRLILARDRLGIKPLYLTGNSERLRFASTLPALLAGGGVSSDIDLVAFHHYLSFHSVVPAPHTILAGVRKLPAATVRVVEPDGTSTDDLYWRPSFTRDPAHADWTARDWQDAIAERLRLAVRRRMVADVPVGVLLSGGLDSSLIVALLAEAGQKDLATFSVGFEAVGGEPGDEFVYSDVIARYFDTDHHQIRVPGTRLLPAVDAAVAAMSEPMVSHDCVAFYLLSQEVSRHVKVVQSGQGADEVFAGYSWYPPLAGVGRTDAVDAYLRVFADRPHRDLPAMVEPHHLIEADASRHFVASHFARPGAETAVDAALRIDSTIMLVDDPVKRVDNMTMAAGLEARTPFLDHELVELAAACPPELKLASGGKGVLKNIGRPLMPVDVIDRPKGYFPVPAIRHLDGPFLDRVREALTDPAAKARGLFRPVWVQTMLAAPNDNRTALGANALWQAALLEMWLQTHTVA

SEQ ID NO: 1792 - protein, 157 aa, Brassica oleracea
MSLIPSFFGGRRTNVFDPFSLDLYDPFEGFLTPSGMTNTTSKDVAAFTNAKVDWRETAEAHVFKADLPGLKKEEVKVEVEDGNILKISGERSSENEEKSDKWHRVERSSGKFMRRFKLPENAKVDEVKASMENGVLSVTVPKMPERKPEVKSMDISG

SEQ ID NO: 1793 - protein, 250 aa, Arabidopsis thaliana
  misc_feature (64)..(64): Xaa can be any naturally occurring amino acid
  misc_feature (93)..(93): Xaa can be any naturally occurring amino acid
MGRGRVELKRIENKINRQVTFAKRRNGLLKKAYELSVLCDAEVALIIFSNRGKLFAVVNASDTXRGRVELKRIENQNNRQVPFAKRRNGLLKXRQQDLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 1794 - protein, 469 aa, Glycine max
KVYYARNIKTGEGVAIKVIDKEKILKGGLVAHIKREISILRRVRHPNIVQLFEVMATKSKIYFVMEYVRGGELFNKVAKGRLKEEVARKYFQQLISAVGFCHARGVYHRDLKPENLLLDENGNLKVSDFGLSAVSDQIRQDGLFHTFCGTPAYVAPEVLARKGYDGAKVDLWSCGVVLFVLMAGYLPFHDQNVMAMYKKIYRGEFRCPRWFSPDLSRLLTRLLDTKPETRIAIPEIMENKWFKKGFKQIKFYVEDDRLCNVVDDDGLMDNDDDTASIVSVASFSDYSVSESDSEIETRRRINAPLPRPPSLNAFDIISFSPGFNLSGLFEEKEDETRFVTAAPVNRIISKLEEIAQLVRFSVRKKDCRVSLEGTREGVRGPLTIAAEIFELTPSLVVVEVKKKGGDRAEYERFCNDELKPGLQNLMVEESATSSELSTPIQPSLLRGLSEPVPDISSDIETPLCIPSDD

SEQ ID NO: 1795 - protein, 332 aa, Dechloromonas aromatica
MQRTQFTVPVLALAALIPHATMAADPTPDASQVVAAVEGVFGVTPGERRNHIKGTCAAGEFVGTKEAAKLSRSPLFSGKPVPVVARFSLSGGNPKAPDVAKSARGMALQFQLPKGQLHHITMLNTPMFGAANPQTFLDLMQALQPDPATGKPDPEKMKAFKASHPDNQAQAQYLASNNPPASYASSSYWGIHTFKFVDKKGKATLVRWQFVPQDGEKRLSDDELKTAGANFLESALIERAKQGAVRWDMMVSIGQPGDSETDPTVLWPAERPRIKAGTLTIRSAEAQKGAPCEPINFDPLVMAPGIQPTDDPVLRFRSPAYAVSFGKRLSER

SEQ ID NO: 1796 - protein, 119 aa, Brassica rapa
EWVLCRIYKKRGAGKLLDEKEGFMDDVQIDETLAAVTNEADRRNEEEIMMMTSTKLPRTCSLAHLLEMDYMGPISHILTPFDLQHFDLNGMNESGWFGDLQVNQDEILNHHRQASMFQF

SEQ ID NO: 1797 - protein, 441 aa, Arabidopsis thaliana
MASNYVFSVLRSLLLLIHTVFLGQHHVSSATIIKSLPGFEGPLPFELETGYIGVGEEEEVQLFYYFIKSERNPKEDPLLLWLSGGPGCSSISGLLFENGPLAMKLDVYNGTLPSLVSTTYSWTKASSMIFLDQPVGAGFSYSRTQLLNKPSDSGEAKRIHEFLQKWLGKHQEFSSNPFYVGGDSYSGMVVPATVQEISKGNYECCNPPINLQGYVLGNPLTDFVYDYNSRIPFAHGMALISDELFESLKKTCKGDYRNVHPRNTECLKFIEEFNKCTNSICQRRIIDPFCETETPNCYIYRFLLAAYWANDETVRKALQIKKETIGEWVRCHYGIPYNYDIKSSIPYHMNNSINGYRSLIYSGDHDFEVPFLGTQAWIRSLNYSVIDDWRPWMIKDQIAGYTRTYANKMTFATIRGGGHTIEFKPEEASIMFQRWIKGQPL

SEQ ID NO: 1798 - protein, 185 aa, Brassica rapa
FGFQLNMELQLALQMSEKRVLRTQTLLCDMLLRDSPAGIVTQSPSIMDLVKCDGAAFLYHGNYYPLGVAPTEAQIKDVVEWLLANHADSTGLSTDSLGDAGYPGAAALGDAVCGMAVAYITKRDFLFWFRSHTAKEIKWGGAEHHPEDKDDGQRMHPRSSFKAFLEVVKSRSQPWETAEMDAIHS

SEQ ID NO: 1799 - protein, 677 aa, Mycobacterium leprae
MDDRRLRTLPNEAYWIAVCGLLAFVVASARADSRGSGGTNNILQADHSMARAVHLMRHRGPDELSTWSDPDIDGFSGGVAFGFNRLSIIDIAHSHQPLRWGPPETPNRYILVFNGEIYNYLELRDELVIRHGAAFATDGDGESIVAGFHYWGTEILTRLRGMFAFALWDTIAHELFCARDPFGIKPLFMATGTNGTAVASEKKCLLELAEVIRFDTQIDTRALQHYTVLQYVPEPETLHRGVHRLESGCYARIRPEQLDPATTRYFVPQFAATPITSSTEQTRYGEITAVLADSVAKHMRADVTVGSFLSGGIDSTAIAALAIRHNPRLITFTTGFEHEGFSEIDVAAASAEAIGARHIVKVVTPNEFVAALPEIVWYLDEPIADPALVPLFFVAREARKHVKVVLSGEGADELFGGYRIYREPLSLKPFDYLPGPLRRSMGKVSKSLPEGMRGKNLLHRGSLTLEERYYGNARNFSEAQLQAVLPRFHTGWTHTDVTAAVYAESVGWDPVARMQHIDLFTWLRGDILAKADKMTMANSLELRVPFLDPEVFAVASRLPMQAKITRTTTKYALRRALESIVPAHVLHRPKLGFPVPIRHWLRAGELLEWAYALVNSSQAEHLVNLAAVHRMLDEHRGGISDHSRRLWTVLIFMLWHAIFIEHSVVPQISEPQYPVQP

SEQ ID NO: 1800 - protein, 466 aa, Bacillus pumilus
METNKQSYTLPEGFWWGSSASATQTEGSVPGDGKGPNIWDHWFEQEPTRFFDGVGPDVTSQFYRKYKEDIRLMKEIGHNSFRLSISWSRLLPEGTGAVNEEAVSFYNDVINELIAHDIEPFVNLYHFDMPMALQEKGGWVNRQVVDDYVSYAALCFQLFGDRVKKWFTHNEPIVPVEGGYMYSFHYPNEVDFQKAVQVGFHEILSNAKAIAAYKKLQQGGKIGIILNLTPSYPRSQHPRDVEAAEMADAFFNRSFLDPAVKGHFPEKLVEVLKKEGFMPSMEEGDLELIRENTIDLLGINYYQPRRVKAKEHMPHPQAPFMPNHYFDSFEMPGRKMNVYRGWEIYEKGIYDILKKVQTDYDNIECFISENGMGVEGEERFKDEEGMIHDDYRIDFISEHLKWVHRAIQEGSNVKGYHLWTFMDNWSWSNAYKNRYGFVSVDLQKDGKRTIKKSGYWFQSVSKNNGF

SEQ ID NO: 1801 - protein, 533 aa, Xylella fastidiosa
MKGHMRIKTGIKKALILILSVVLVSLVAIAAHRFYIRLPQSRLFYAWKKVDEVYYDRTFAGFDWPAVLATYKKQLPRFDSDGQKTSPIINDMLSLLEVSHLQHFPAFLVPEEKKKTAVLASYFPELRDISGMVMVMDMLPRISRVLSLETWSPLYAHGVRVGDRILLDTLDTDISDKNKPVRLYCYHINTAGVKKEFEFDLPAPPLGAQQTAVPSGDHVLHIARFDQGEIQALKHVSEDRNSSITQLHYISLGAVTTALHLPKNKVIDVVKDSEADKAGVEIGSFIGNGTNIKAGPENIGGKKVIKTDSRYEVVLPDGRKVTFSINKIIPKLNDIEGIRSAQLIGKTLVITFNEMSDENTQWALQQIKNTPATAILLDLRYNTGGSGIAGEKLLAGFLASGTRIATEIRGKKTNEINVPAGYTPTDKPTAVLISLLSASGAELAARTLQFHHRARIYGAQSSGQVLTSRFYKLTDGTYMQIADTNLLDPAGKPIEWYGVMPDVKKWKTLSDVRAGRDPVLECALTDLSGGQCH

SEQ ID NO: 1802 - protein, 535 aa, Xylella fastidiosa
MTGHMRIKTGIKKALILMLSVVLVSLVAIAAHRFYIRLPQSRLFYAWKKVDEVYYDRTFAGFDWPAVLATYKKHLPRFDWDGRETSPFIHNMLSLLEVSHLRHIPGFMAPEKIKEEAVLANYFPELRDISGMVLVQETLFKMSKVLSLETWSPLYAHGVRVGDRILLDTLDTDISDKNKPVRLYCYHINTAGVKKEFEFDLPAPPLGAQQTAVPAGDHVLHIARFARFDQGEIQALKHVIEDRNSPMTQLHYIPLGAVTTRPHLIRTKVIDVVKDSEADKAGVEIGSFIGDGTDPKTESKNIGGKTVVKSNGIYKMILPDGKKVTFSINKEITLSNFEGIRSAQLIGKTLVIAFNEMTDENTQWALQQIKNTPATAIVLDLRDNTGGSSIAVPKLLAGFLASGTRIATEIRGKKTNEINVPTGYTPTDKPMAVLIGLVSASGAEVTARTLQFHRRARIYGAQSSGQVLMSRFYKLTDGSYIQIPHANLLDPAGKPLEWYGVMPDVKKWKTLSDVRAGRDPVLECALTDLSGGQCH

SEQ ID NO: 1803 - protein, 231 aa, Zea mays
  misc_feature (198)..(198): Xaa can be any naturally occurring amino acid
  misc_feature (221)..(221): Xaa can be any naturally occurring amino acid
MVGFFRSGNLASRVFDRQFLSPRPGATVNTVRQFYENLVPSYTIYDIDCPDYSFRKFTDDGKYLVAFSRNHQDLIVYRPIWLTFSCHEECDSHDLPANAERFESFFKQLYSISLASSNEYICKDFFLYMECHQYGLFATSTAQSNDSSVTDGAIHGVPSIEKITFYLVRLEDGAILDEKAFCNDFINLAHSIGAYLYXDLVCIVSLRYQTIHVLQIRDSGXLVEVRRNWCI

SEQ ID NO: 1804 - protein, 372 aa, Arabidopsis thaliana
MSGESSSGSTEHCIKVVPTHGGRYVQYNVYGQLFEVSRKYVPPIRPIGRGACGIVCAAVNSVTGEKVAIKKIGNAFDNIIDAKRTLREIKLLRHMDHENVITIKDIVRPPQRDIFNDVYIVYELMDTDLQRILRSNQTLTSDQCRFLVYQLLRGLKYVHSANILHRDLRPSNVLLNSKNELKIGDFGLARTTSDTDFMTEYVVTRWYRAPELLLNCSEYTAAIDIWSVGCILGEIMTGQPLFPGKDYVHQLRLITELVGSPDNSSLGFLRSDNARRYVRQLPRYPKQQFAARFPKMPTTAIDLLERMLVFDPNRRISVDEALGHAYLSPHHDVAKEPVCSTPFSFDFEHPSCTEEHIKELIYKESVKFNPDH

SEQ ID NO: 1805 - protein, 315 aa, Glycine max
MGDTKERSGFCVWPDARQLCLGKGLLYGFMRLFSIPLKTLRGASRSLRVNQFCSVVNLSSSLQIELVPCLRDNYAYLLHDVDTGTVGVVDPSEAAPIIDALSKKDLNLTYIMNTNHHPDHTGGNAELKERYGAKVIGSEIDKERIPGIDIYLSDGDNWMFAGHEVHILATPGHTEGHVSFYFPGSGAIFTGDTLFSLSCGKLLEGTPKQMLSSLKRIMSLPDDTSIYCGHEYTSSNSKFALSIEPENEELQSYAAQVAYLRSKGLPTIPTTLKMEKACNPFLRTSSAAIRQSLNIAATANDAEALGGIRQAKDNF

SEQ ID NO: 1806 - protein, 545 aa, Aquifex aeolicus
MAAKAIIYNEEARAKLKAGVDKLANAVKVTLGPKGREVILGKNWGTPVVTKDGVTVAKEIELKDKFENIGAQLVKEVASKTADVAGDGTTTATVLAQAIFHEGLRVAASGANVMEVKRGIDKAVKKIVEELKKLSKDVKERKEIEQVATISANNDPEIGKIIADAMEEVGKDGVITVEESKSAETTLEVVKGMQFDRGYLSPYFVTDPEKMECVLENPYILIYEKKITNVKELLPILEQVVRSGRPLLVIAEDVEGEALATLVVNHIKGVLKACAVKAPGFGQRRKDYLGDIAVLTGGQAITEDLGIKLESVTLDMLGQAEKVVVDKEHTTIIGGKGDPEQIKARIEQIKRQIQETTSDYDREKLQERLAKLSGGVAIIRVGAATEAELKEKKYRVEDAVHATKAAVEEGIVPGGGVALVRASEALEDLKGDNHDQQLGIDIIKKAVRTPLKQIAYNAGYDGSVVLEKVIELGKEKGVSWGFNAATGEYVDMYEAGIIDPTKVVRTAIENAASVAGTMLTAEALIADLPEEKKKDITPTDMPELD

SEQ ID NO: 1807 - protein, 394 aa, Pseudomonas syringae
MLYNGLLDLSVWQLIAVTLVMTHITIIGVTVYLHRYSAHRSLELNAGLKHFFRFWLWLTTAQNTREWTAIHRKHHAKCETVDDPHSPVVKGLSTVLRKGAELYREEAQNQDTLRIYGKNCPEDWIERNLYSRYKLLGIALMAVIDVALFGVLGITVWAVQMMWIPFWAAGVVNGLGHAVGYRNFECRDAATNLVPWGIVIGGEELHNNHHTYPNSAKLSVKPWEFDMGWAWIKVFSFLRLAKVQRVAPIAHRVEGKGHMDMDTAMAILNNRFQIMAQYRKLVIAPLVAQELAKADESVRHQFRRAKRLLSRETSLLDDKHHLRIQTMLEHSHALKVIYEKRLALQQIWVKTSSNGHDMLSAMKEWIHEAEASGIQSLREFADQLKTYSLRPAHA

SEQ ID NO: 1808 - protein, 358 aa, Unknown
  Polaromonas sp. JS666
MLFEAFPLRATQLSNRTVMSPLTRSRASENNTPNSLMATYYAQRASAGLIITEGTSPSPNGLGYARIPGLFNDAQVQGWKLVTDAVHAKGGKIVVQLMHTGRVTHQANLPAGAEVLGPSPETCPGEMWTDAQGSQPHTPPRAMTEADIQAVIGEYTTAARLAIQAGFDGIELHAANGYLLEQFLNANVNRRTDSYGGTAEGRNRLVLEVARAAVKEIGAERVGIRLSPHGVVNSTGAFEGVDEQYLALVKELSALGLMYVHVLDHSAMGAPPVPAKLKSDLRAAFDGPFILAGGQNKASAQQALSEGRADLIAIGRPFIANPDLVERMRQDAPLIAPVPDTFYTPGAKGYTDYPMFAG

SEQ ID NO: 1809 - protein, 128 aa, Brassica oleracea
DPFEGLLTPSSARDMAAFTNARVDWKETPEAHVFKADLPGLMKEEVKVEVEDKNILQISGERSKENEEKNDKWHRLERASGKFMRRFKLPENAKMEEVKATMENGVLTVTVPKAPEKKPEVKSIDISG

SEQ ID NO: 1810 - protein, 466 aa, Triticum aestivum
FRRWRDCRYRMPSGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAIEMVDENTICVAAILGSTLTGEYEDVKLLNDLLVEKNKKTGWNVPIHVDAASGGFIAPFLQPELEWDFRLPLVKSINVSGHKYGLVYPGVGWVIWRSKDDLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIVRELDAHAVHAIKLSNAAAAEGASQSTVDAVTEAFKGLAGNKKAGVC

SEQ ID NO: 1811 - protein, 193 aa, Oryza sativa
VNATLMNIADNPTNVQLPGMYNKEDNPRVPIIVTGNDFSTLYAPLIRDGRMEKFYWAPTRDDRVGVCKGIFRTDNVPDEDIVKIVDSFPGQSIDFFGALRARVYDDEVRKWVSDTGVENIGKRLVNSREGPPEFEQPKMTIEKLIEYGYMLVKEQENVKRVQLAEQYLSEAALGDANSDAMKTGSFYGSAPSS

SEQ ID NO: 1812 - protein, 339 aa, Sulfolobus tokodaii
MIEIDGSFGEGGGQILRTSLTLSALTKKPFRIYKIRANRPKPGLQRQHLTAVEAVKKLTNAKVKGDFVGSTELVFEPEDIVEKGDFEFDVGTAGSVTLILQTILPLLINRNIKVTIKGGTDVPKSPSIDYIRLTFLSLLEKIGIRVNLILIRRGHYPEGGGEIKITEVKGNPSSFSLMERGELLMIKGISHVSSLPSHIAERQAKSAKEFLLSKIKIPVEIEIDVRENERSKGSGIALTAIFEKTFLGSDSLGEKGKRAEIVGEEAAKSIYEEIISNATVDRHMSDMLMLYASLYYGEYIGSELTSHARTNSEIIKKFLNVNIQISGEKPFIFRAKKEL

SEQ ID NO: 1813 - protein, 197 aa, Raphanus sativus
MGRKKLEIKRIEKKSSRQVTFSKRRSGLIEKARQLSVLCDASVALLVVSSSGKLYSFSSGDNLVRILHRYEKQHADDLKALLDLQSKSLSYGSHNELLELVESKLVESNVGVSVDALVQLEGHLETALSLTRARKTELMLKLVDSLKEKEKLLKEENKVLASQMEKNNLAGAEADNMEIARAQISDINLPVTLPLLN

SEQ ID NO: 1814 - protein, 1005 aa, Staphylococcus epidermidis
MSKEIFDTFKFKCGAELKNRVLMAPMTIQAGYFDGSVTSEMIDYYQFRAGDASAIIVESCFVENHGRGFPGAIGIDNDDKIPGLKRLAEAIQAKGSKAILQLYHAGRMANPKFNEGEQPISASPIAALRPDAVPPREMTHAQINQMIDDFGEATRRAIEAGFDGVEIHGANTYLLQQFFSPHSNRRQDSWGGSREKRTRFPIEVLTKVQHVVAEKEASHFIIGYRFSPEEIEEPGIRFEDTMFLLNTLAEYEPDYFHISANSYQRTSIVNQEDTEPLINKYIKMQSAQLAKIPLIGVGSIAQRQDAEHALELGYDLLSVGKAYLVEPQWTDKISQNEEVEQFVDIHDQKVLHIPSPLWKVMDFMILDKEEEHRKYEKLKALQNKKVKFNKGTYHVYAKGHNGNLPMKVQLSEDKIVSIEVDDSGESEGIANPVFERLPQDIINGQTLNVDVISGATVTSEGIVQGIADAIEQAGEDPDILRARPKPVVQWSDEVVEETTDVVVIGTGGAGLSAAATVLDEGKEVIMLEKFAAIGGNTIRTGGQVNAAEPKWQNAFPALAGEKETLIQLLNHDENDIDEAYIEDFNTLKRQIKDYLENSSNEDEYLFDSVELHRIQTYLGGKRKDRNNVEISGDYDLVKTLTDNVLESVYWLKDKGVHFDRSFVDMPVGALWRRGHKPMKAQGLEYIENLGDYVKHNHGRIFTETTAEKLIKEGNQVVGIEARKANGAKVKIHTRHGVVLATGGFGANTKMLQQYNTYWDNIPDDIKTTNSPAITGDGIRLGVQAGADIVGMGFSQMMPISDPKTGALFTGLIVTPSNFVFVNKEGQRFVNEFESRDVLSKAALEQKDGIFYIIADANIKALAMNTTEDKINQELEDGTLVKADTLEALAQKLNIDTTTFVNTIERYNTFVEQGQDEDFNKNAFDLKIEKAPFYATPRKPAIHHTMGGLKINTHAQVIDVEGHIIEGLYAAGEVAGGIHAGNRLGGNALADIFTFGRIAGQSAVTK

SEQ ID NO: 1815 - protein, 197 aa, Brassica oleracea
MGRKKLEIKRIENKSSRQVTFSKRRSGLVEKARQLSVLCDASIALLVVSSSGKLYSFSAGDNLVRILDRYGKQHADDLKALDLQSKALSYGSHNELLELVDSKLVESNVGGVSVDTLVQLEGVLENALSLTRARKTELMLKLVDSLKEKEKLLKEENQALASQKEKKNLAGAEADNMEMSPGQISDINLPVTLPLLN

SEQ ID NO: 1816 - protein, 221 aa, Cucumis sativus
MGRGKIEIKRIENTTNRQVTFCKRRNGLLKKAYELSVLCDAEVVLIVFSSRGRLYEYANNSVKATIDRYKKASSDSSNTGSTSEDNTQFYQQEAAKLRVQIGNLQNSNRNMLGESLSSLTAKDLKGLETKLEKGISRIRSKKNELLFAEIEYMRKREIDLHNNNQMLRAKIAVSERNVSMMGGEFELMQSHPYDPRDFFQVNGLQHNHQYPRQDNMALQLV

SEQ ID NO: 1817 - protein, 92 aa, Ambrosia artemisiifolia
MSILGGITEVKDNDNSVDFDELAKFAIAEHNKKENAALEFGKVIEKKQQAVQGTMYYIKVEANDGGEKKTYEAKVWVKLWENFKELQELKLV

SEQ ID NO: 1818 - protein, 146 aa, Treponema denticola
MNSLSLFSPSFTDSVFDALDRSLGPNFGVFAPIKNASCGMPSVDIRETEKAYVMEVDLPGYSEKDVEISLKDRLMTISSSKKEEKEDKGAEYIIKERSSRHFMRRFTLPEDINSDEVSAKFENGVLVVNIPRKPDTQPKQIEIKTA

SEQ ID NO: 1819 - protein, 277 aa, Glycine max
  misc_feature (232)..(232): Xaa can be any naturally occurring amino acid
MEGSTTSSELPPGFRFHPTDEELIVYYLCNQATSKPCPASIIPEVDLYKFDPWELPDKTEFGENEWYFFSPRDRKYPNGVRPNRATVSGYWKATGTDKAIYSGSKNVGVKKSLVFYKGRPPKGAKTDWIMHEYRLAESKIPASRKIGSMRLDDWVLCRIYKKKSMVKALEHKEAHPEVQIANLAPANHDVEQKMMNLPRTWSLTYLLDMNYLGPILSDGSYCSTLDFQINNXGLDPFVKSQPVEMNNYVADSGKYQVKQSSTIDQPIYVKQMYDLLG

SEQ ID NO: 1820 - protein, 549 aa, Unknown
  Frankia sp. EAN1pec
MPKILTFNEDARRSLERGVNALADAVKVTIGPRGRNVVINKSYGAPTITNDGVTIAREVELDDPYQNLGAQLAKEVATKTNDVAGDGTTTATVLAQEMVRQGLRQVTAGAAPLSLKIGIEAAVAAVSSALLEAAIEIGSKETIAQVAAISAQDAQVGELIAEAMDKIGKDGVITIEESQTMGLDLELTEGMQFDKGYISPYFVTDQESMEAVLEDAYVLLHPGKISALNDILPILEQVVQERKPLLIIAEDVEGEALSTLVVNAVRKTFQVVAVKAPGFGDRRKAMLQDLAVLTGGQVVATEVGLKLDSITLAELGRARRIVVDKDLTTIVDGAGDADAVAERVRQMKAEIELSDSDWDREKLQERLAKLAGGVAVIRVGAATEVELKEKKHRLEDAVSATRAAVEEGIVAGGGSALVHAAKVLDGDLGLTGDERSGVRVVRAALDAPLTWIARNAGLEGAVIVSKVREGDVGRGFNAATGEYVDLVAAGVVDPVKVTRSAVANAASIAALLITTESLVAEKPEEAEAGHGHDHSHGGHGHGHSHGPGF

SEQ ID NO: 1821 - protein, 165 aa, Mesorhizobium loti
MGDEERRWPCSRKSEGVAGRLSEDETMIARMLFGADPYRNMRRLQDEVSRLEFPAVNAFVNQDGVIITAELPGVRSEDLDILIHRDSVTLSGERQAEAEDARRGYHRRERRQGRFVRTVSLPFLVDPNNVGANLINGLLTLGLPRAEEDKPKRIHVNASKEARHG

SEQ ID NO: 1822 - protein, 783 aa, Cryptococcus neoformans
MTTNLYAIAGPSKPTTPTSTPSPRSEPPSPLKSLTSLPTNPLNSHGTSTPNTLTNQLSSTGIGISKPGLSVDENGEVMKVPAFLNKLYTMVSDPEVDDLIYWGESGDSFFVPNAELFGRELLPRWFKHSNFSSFVRQLNMYGFHKVPHLQSGALKNETPIELWEFANPYFKRGQPQLLTKVTRKNNRPSNSGVGPSSSVGGSGAGGGMSTRSASAAAASGSASGQIQQAISQGHEAGNHSTSGKYLITDGTTPGSVPPSHTSAGPLIAPQTLDLSAINSGIAAIRQTQASIATDLRKLQASNEALWRQAYETQEKQRKHEETIDLIVSFLERLFGTEGEGLKGLKEAMRRGVGVRRDRDGREGRDSRDSRFAEDDDGGQKKRRRVGIDRMIEGGTGDGTGEHGEIESPTSDDRLVEIGSNSEYSIPSVKRTSSSSHPISLGQLGSSRFTALPSEDPSPSASGPGSTSYEGLHTTQTNARGAGADVNVTDPTLGMNHLSPLSDTDPLLPSSSNALAPYSSHLPFPSSNSNQSNSFNPSNPSSAWASNPSQPLLSPTSAAAAAHAYNLDPSLLQTTIGSLLQSPAAAQMFLNSLSASAQGQALASHSHPHNPSPLNPNPNGNASTSASASAHGMNTGGMGTGSGTKDVDPTLALFSPLPSHSSLTSQSNDLLKSYSDALTVGEGVDNLQESIDSLVRSMGLDLPNGGSSVGVDVGDGAGVGTETGEGDGEFNVDEFLQGLAKEGEEEGEREVEGDGGVSSSGAGAGAENGRKEDVIAQSGLKSES

SEQ ID NO: 1823 - protein, 159 aa, Zea mays
RKMARKPLDYEELNENVKRVQYAVRGELYLRASELQKEGKKIIFTNVGNPHALGQKPLTFPRQVVALCQAPFLLDDPHVGLMFPADAIARAKHYLAMAPGGLGAYSDSRGIPGIRKEVADFIHLRTTILPAEEDFPAIMSSFKKFNDSFMEQYEGYSRL

SEQ ID NO: 1824 - protein, 519 aa, Zea mays
DWVPRGRPGLFVLIHPQATVHSQLPRNGGGGDGGVSRPRRKMARKPLDYEELNENVKRVQYAVRGELYLRASELQKEGKKIIFTNVGNPHALGQKPLTFPRQVVAPCQAPFLLDDPHVGLMFPADAIARAKHYLAMAPGGLGAYSDSRGIPGIRKEVADFIHKRDGYPSDPELIYLTDGASKGVMQILNTIIRNEMDGILVPVPQYPLYSATISLYGGSLVPYYLEEEANWSLDFANIRQAVAEARSKGISVRAMVMINPGNPTGQCLSEANIRELLRYCYHENLVLLADEVYQQNVYQDERPFISARKVMFDMGPPISREVQLVSFHTVSKGYWGECGQRGGYFEMTNLPPKTVDEIYKVASIVLSPNVPGQIFMGVMVNPPKPGDISYPKFTAESKSILESLRRRARMMTDGFNSCRNVVCNFTEGAMYSFPQIQLPARAIEAAKRAGKAADVFYCLKLLEATGISTVPGSGFGQKEGVFHLRTTILPAEEDFPTIMSSFKKFNDSFMEQYEGYSRM

SEQ ID NO: 1825 - protein, 771 aa, Candida glabrata
MSEKDGGNTVFINKLYDLLENKDLDDLIWWAANGESFLIRPSESFSQNLAHYFKHTNITSFVRQLNIYGFHKISNDHFHNLKREKKQKSSTDNNTGVSNNNSGDENIKVWEFKHSGGLFKKGDLENLKLIKRRSSSRTIPSLSLASSNTNTSTLETNDGAEIDNVKVIASAVHNATEHLKKKDKVKKEGKKSSKKSTKLKNEPTVDISNTETTSAAITNESEQSSNKRATRVYKSVGTISNQDSKNPEKLTKKPKKNSNLKNKGKKSKSNSVDGQSIDNIQPNENQPINIQVNTTEIPTDNTLHHYNETLYEQSIQLNHQIAQMRNTNMDMLAILELMSKLAEMNKEVLNINNSEKIPELMANHYRFFDAQLTSLKNNILDRINNTNIHKFGMDSNDLRSASQTNIHLSHPIAQNMVYSSADQAIPKSVPYYLKQGQRTSPDNGTTTPAGAQNYSKNQVVQHPQAANDYFSSVHVQTANPFEKFQTEKNGIINVTARRHMSVLVDPLTPASMMSVPTTTQSSLSGPSLYNQQHAIIFPHDLNQAFNSRSEPTITPITGHHSNFTRASDSNLMNTKQTIVNSMKNRASYPSRRTESPLKYSSGMPIEEEQRWEYKITKDNGRNTDIPQLPSNQCQIDSPVPVRSPYNKFVSPHSFYAGGRNISPPMNGNVDMLAQRPSTEVVSLTSSDNKIDNAVVIKRSSTANPILRGSSSEKENKESSNKLIGSTVTEKTSRTKRNSSGVYSLLNGTIKEEKANETFIDTDSHVDKKIKL

SEQ ID NO: 1826 - protein, 123 aa, Dianthus caryophyllus
MITIHHPWVFAFGLLGNFISFMVFLAPLPTFIRVYKKKSTEGFQSFPYVVAIFSAMLWIYYALLKGNSLLLITVNVTGVIIETIYVIIFITYAPRQARISTMKLLLFMNFGGFCMIVPRPRPR

SEQ ID NO: 1827 - protein, 481 aa, Photobacterium profundum
MTKSTLTQANGTPVVDNDNSLTAGPSGPILLQDTWLLEKLAHFDRERIPERVVHAKGSAAFGTFTVTHDISALTKANLFSEVGKETDVLLRFSTVAGEKGAADAERDVRGFALKFYTDEGNWDLVGNNTPVFFIRDPLKFPDFIHTQKRNPITNLRSATAAWDFWSRHPESLHQVTILFSDRGIPTDYRHVNGYGSHTYSFINSNNERSWVKFHFKTQQGHKHYTDEEAVNVVGKSRESSQVDLFMNIEEGNFPRWDVKVQIMTEQQAQEVSFHPFDLTKVWPHGEFPLIDVGVLELNRNPENYFAEVEQAAFSPANIVSGIGFSPDRMLQGRLFSYGDTQRYRLGVNHGQLPVNKPKSPVHTTHRDGSMRGDDNGGKEPNYAPNHYNAYVPTHEQEPALALEKAALHYDFREYDEDYYTQPGNLYRIMDAEQQQRFIQNLIASLSEVDCEQIKRNQIYHFYQADKSLGKALAEGLGVSIG

SEQ ID NO: 1828 - protein, 547 aa, Ralstonia eutropha
MAAKDVVFGDAARAKMVEGVNILANAVKVTLGPKGRNVVLERSFGGPTVTKDGVSVAKEIELKDKLQNMGAQMVKEVASKTSDNAGDGTTTATVLAQSIVREGMKFVAAGMNPMDLKRGIDKAVAAAVEELKKVSKPTTTSKEIAQVGAISANSDTSIGERIAEAMDKVGKEGVITVEDGKSLADELEVVEGMQFDRGYLSPYFINNPEKQVVQLDSPFVLLFDKKVSNIRDLLPVLEQVAKAGRPLLIIAEDVEGEALATLVVNNIRGILKTAAVKAPGFGDRRKAMLEDIAILTGGTVIAEEIGLTLEKATLNDLGQAKRIEIGKENTIIIDGAGDAAAIEGRVKQIRAQIEEATSDYDREKLQERVAKLAGGVAVIKVGAATEVEMKEKKARVEDALHATRAAVEEGIVPGGGVALLRARAAISALTGENPDQNAGIKIVLRAMEEPLRQIVLNAGEEASVVVAKVIEGKGNYGYNAASGEYGDLVEMGVLDPTKVTRTALQNAASVASLMLTTDCAVAETPKEESAPAMPGGMGGMGGMEGMM

SEQ ID NO: 1829 - protein, 255 aa, Xanthomonas campestris
MRLIALPAFDDNYIWALIAADGRAIIVDPGQAEPVLAAAQHQGLVPSAVLLTHHHGDHIGGVAELQQRWPDLELFGPADERIPADAHQVGHGERLRLLDVEFQVLQVPGHTRSHIAFVADGYLFSGDTLFSLGCGRMFEGTAPQMFDSLQRLASLPGETLVCCGHEYTLANAAFALHVDPTNAALQRRQQEAQAMRHAARPTLPISLKSELATNPFLRTGRPEIRAAVAPRAAGELSSEVDVFAELRRWKDEFRS

SEQ ID NO: 1830 - protein, 499 aa, Glycine max
MVLTSTATHPDEQDQSLNYTFASRYVREPIPKFKMPEKSIPKDAAYQIINDELMLDGAPRLNLASFVTTWMEPECDKLIMASLNKNYVDMDEYPVTTELQNRCVNIIANLFHAPISDDETAVGVGTVGSSEAIMLAGLAFKRKWQTKRKAEGKPYDKPNIVTGANVQVCWEKFARYFEVELKEVKLKEGYYVMDPAKAVEMVDENTICVAAILGSTMTGEFEDVKLLDELLTKKNNETGWDTPIHVDAASGGFIAPFLYPDLEWDFRLPLVKSINVSGHKYGLVYPGVGWVVWRSKDDLPDELVFHINYLGSDQPTFTLNFSKGSSQIIAQYYQLIRLGFEGYKNIMENCWENARVLKEGIERTGRFNIISKDIGVPLVAFSLKDSSQHTVFEIADHLRKFGWIVPAYTMPPDAQHIAVLRVVIREDFSRGLAERLAADIEKVVKLLDTLPSPLTTKAVHITAITSETGEKIKKAAIETQKEIAFYWKRLVDGKRLGAC

SEQ ID NO: 1831 - protein, 213 aa, Brassica napus
  misc_feature (22)..(22): Xaa can be any naturally occurring amino acid
RRVGSFKKVARSMGYGEKDISXVSFQSISKGYYGECGKRGGYMEVTGFTSDVREQIYKVASVNLCSNISGQILASLVMSPPKPGDESYESYIAEKEGILSSMARRAKTLEEALNKLEGITCNRAEGAMYLFPCINLPQKAIAAAEAAKTAPDTFYCKRLLNATGIVLVPGSGFRQVPGTWHFRCTILPQEDKIPAIVNRLTEFHKSFMDEFRD

SEQ ID NO: 1832 - protein, 201 aa, Triticum aestivum
  misc_feature (164)..(164): Xaa can be any naturally occurring amino acid
MDPVTASIHGHHLPPPFNTRDFHHHLQQQQLHLKSEDDHGGGSPFGGHGTKHGHEDDENSGNGNGSGGELALISPSGGGLQDGGENGSRRPRGRPAGSKNKPKPPIIITRDSANTLRTHVMEVAGGCDISESITAFARRRQRGVCVLTGAGTVTNVTLRQPASXGAVVALHGRFEILSLSGSFLPPPAPPEATGLTVYLAG

SEQ ID NO: 1833 - protein, 744 aa, Hevea brasiliensis
  misc_feature (642)..(642): Xaa can be any naturally occurring amino acid
  misc_feature (645)..(645): Xaa can be any naturally occurring amino acid
  misc_feature (659)..(659): Xaa can be any naturally occurring amino acid
MEACNCIEPQWPADELLMKYQYISDFFIALAYFSIPLELIYFVKKSAVFPYRWVLVQFGAFIVLCGATHLINLWTFTMHSRTVAIVMTTAKVLTAAVSCATALMLVHIIPDLLSVKTRELILKNKAAELDREMGLIRTQEETGRHVRMLTHEIRSTLDRHTILKTTLVELGRTLALEECALWMPTRSGLELQLSYTLRQQNPVGYTVPIQLPVINKVFSCNRAVKISPNCPVARIRPFAGKYMPGEVVAVRVPLLHLSNFQINDWPELSTKRYALMVLMLPSDSARQWHAYELELVEVVADQVAVALSHAAILEESMRARDLLMEQNVALDLARREAETAIRARNDFLAVMNHEMRTPMHAIIALSSLLQETGLTPEQRLMVETILKSSNLLATLINDVLDLSRLEDGSLQLDLGTFNLRAVFREVLNLIKPIASVKKLPVTLNLAPDLPEYAIGDEKRLMQTILNVVGNAVKFSKEGNISITAFVARPESLRDLRFPDFFPVPSDDHFYLRVQVKDEGLGINLQDIPKLFTKFAQNQSLATRNSGGSGLGLAICKRFVNLMEGHIWIESEGLGKGCTAIFVVKLAILECSNESKHPFMQNGPKPNQGAKQTSFMGPESSLLMDDTGGYQDGNKRTFWGTLXCDXTTVSSSDECLRVVXLDHKVVFMDVCMPDGLELLSAYMKDFTKRHERPLIVALYWNANKVTKENCMKVGMDGVILKPVSVDKMRGVLSDLLEHRVLFEAM

SEQ ID NO: 1834 - protein, 275 aa, Geobacillus kaustophilus
MNGLQDCATLHNGVKMPWVGLGVYKVKEGEEVRSAVRTALEIGYRHVDTAAFYENEEGVGRAIRESGIPREQVFVTTKVWNTDQGYETTLKAFDKSLKKLGFDYVDLYLVHWPVKGKYKETYKALEKLYKDGYVRAIGVSNFHIHHLQDVLADCEIKPMVNQVEYHPRLTQKELLTFCRENGIQLEAWSPLMRGEILSEPTIIDIGRKYGKTPAQVVLRWDLQHGVVTIPKSVTPARIKENADIFDFSLTDEEMKQIDALNLNKRVGPDPDNFNF

SEQ ID NO: 1835 - protein, 424 aa, Xylella fastidiosa
MSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAISVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKSRSAAA

SEQ ID NO: 1836 - protein, 459 aa, Bacillus cereus
MNEKYDKHRKELLEEDFNKHRELTEPAKFHSQTVGSRGPVLEQDSVLHESLQQFIHEKILERPVHVKGFGAFGYFQTIYSMSEHTKLSFLQNSNEKVPVMVRFSLAVSTKGTPDTARNVRGFSTKFYTKEGIFDLLCNHIPVFSVRDPMRFPETIQALLPSPKNNLIDPNRFWSFVAKAPESIHFVVRLYSNNGTAKSLRHIPGHSVNTYVWRNAEGNRKYVKYHWYPFEGVQYITSKEAIKLAAENPDYSGKDLYDAIENGKPVEYGLYVQLMDPKDETHLSYDPLDDTKVWDEQTYPLIPVGKMVLNKNPENFMEQVEKVAFSPSNLLEGAELSDDKMLQGRANIYSDSQRRRIGPEFRKLTINQQQDWTPANQITTGEGRYVEGKLERASITKQDDFTQAGEFYTKLQPIEKEHLAENLASDLKVISDDIREIVLGYFNQVSTDLKTSIETKMKEH

SEQ ID NO: 1837 - protein, 224 aa, Triticum aestivum
HASAGVEYCHRNMVVHRDLKPENLLLDSKYNVKLVDFGLSNVMHDGHFLKTSCGSLNYAAPELISGNLYAGPEVDVWSCGVILYALLCGKVPFEDDNIPKLFKKIKMRQNGGFYILPSYLSDLAMDLIPRILVVDPMKRITIREIRDHPWFQNRLPRYLAVPPPNTPQQAKMINEDTLQNVVNLGYDKDHVGGSLCNRLQNEATVAYYLLLDNRFRATSDYWGR

SEQ ID NO: 1838 - protein, 615 aa, Bacillus cereus
MCGITGWVDYKRSLEGERDVVTKMAETLAKRGPDDNKVWIKGNVAFGHKRLIVVDPEGGKQPMTCLKGETNYAICYNGELYNTEDIRKELLRRGYTFKGHSDTEVLLASYMEWKEECVDHLNGIYAFAVWDEQKEQVFIARDRLGVKPLFYKYDSGRLLFGSELKAILAHPDVKAEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSIDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQRRYEESIQEVPILEGESPIEAKRRQLFYLNMVWFMTTLLDRKDRMSMGASLEVRVPFADHRLVEYAWNIPWEMKMYKNREKGLLRKALEGLLPNDILYRKKSPYPKTHNPHYTKAVTVWLQDLLTDKGSILHELFDKEQLSGLIESGGSAFQTPWFGQLMTGPQLLAHLAQIHVWFKEYGVNIKE

SEQ ID NO: 1839 - protein, 314 aa, Ashbya gossypii
MSMETPPVDIDNIIDRLLEVRGSKPGQQVDLEEHEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIIDEKIFCMHGGLSPDLNTMEQIRRVMRPTDIPDVGLLCDLLWSDPDKDIVGWSENDRGVSFTFGPDVVSRFLQKLDMELICRAHQVVEDGYEFFSKRQLVTLFSAPNYCGEFDNAGAMMSVDESLLCSFQILKPAVKPSAGRGQPKKKK

SEQ ID NO: 1840 - protein, 449 aa, Bacillus cereus
MNPNNRLTTNQGAPVGDNQNSRTAGRRGPVLLEDYHLVEKLAHFDRERIPERVVHARGAGAHGVFVTKNSMKQYTKAAFLQNEGTETPVFVRFSTVIHGQGSPETARDPRGFAVKFYTEEGNYDIVGNHLPVFFIRDAIKFPDMVHSLKPAPDTNIQTPDRYWDFMTLSPESTHMMTWVFSDYGTPASYREMEGFGVHSFKWINAEGKIVYIKYHWKPQQGVRNLSAKEVQEVQGKDFNHATRDLFDAIEKGNYPKWDLHVQVMQLEETDSLDFDPLDPTKVWPEDRFPLMEVGTMTLNRNPKNFFAEVEQVAFSPSATVNGIEPSEDKLLQGRLFSYPDTQRYRLGANYLQIPVNCPYAAVHNQQRDGAMQTNQNPSTINYEPSRHAENPVEDPAYRDSTMKVEGYVSREKIDKPNDFKQAGERYRSFSKEEQDNLIANLTNDLKRRK

SEQ ID NO: 1841 - protein, 471 aa, Unknown
  Vibrio sp. Ex25
MILVWFRRDLRTLDHTALKAALDSGQPVVACFIATPEQWREHHMAPMQADLIARRLEYLNDELESLNVPFLYKEVPSFSDCTEVISEWAKTLEATSVMANIHYEVNERELDAQVSEALASHDIDFELFHDKCVHPPTTVLNKQGEYFKVFTPFKRAWLTQFQMPAVTKPQEQAPLSSKLLEQLEPIRFSSDFTFSYPRESSEDWFASTNDVLKQLREFARERSDAYKEERDFPAIDGTSQLSPYLAIGALSPRQCIARLYAENQQNDLTEGKATWLSEIIWREFYQHLLVFEPKLVKGKGFIDWEDKIQWSYDEQAFERWKAGATGYPIVDAAMRQLNQTGWMHNRLRMVVASFLTKDLHIDWRWGEAYFMSKLVDGDFAANNGGWQWSASTGCDGQPYFRIFNPISQGEKFDSDGQFVRHWVPEIKSVPNKYIHKPWTWEGFSLLEYHKPMVDHKTEREITLRLFKSAKE

SEQ ID NO: 1842 - protein, 138 aa, Zea mays
  misc_feature (45)..(45): Xaa can be any naturally occurring amino acid
EGVQQIIRTELMLDANPRLNLGSLVPRWMEPKCDKLIMDSTTKNXVDMAEYPVPPEPQNPWVNIKAPLFNAPIKEDETAIGVGTVGSSEAIMLAGLAFKRKWQNKRKEQGKPCPPPNMVPGANVQDPGPPNNGCKCWV

SEQ ID NO: 1843 - protein, 137 aa, Brassica napus
  misc_feature (101)..(101): Xaa can be any naturally occurring amino acid
HASADSERDPHSPKEGFWFSHLLWIYDSAYLVTKCGRRTNVDDLKRQWFYRFLQKTVLFHILGLGIILFYLGGMSFVTWGMGVGAALEVHVTCLINSLCHXWGTRTWKTNDTSRNVWWLSVFSFGESWHNNHHAFES

SEQ ID NO: 1844 - protein, 238 aa, Triticum monococcum
MGRGKVVLQRIENKISRQVTFAKRRNGLLKKAYELSLLCDAEVALVLFSHAGRLYQFSSSSNMLKTLEKYQRYIFASQDAAVPTTDEMQNNYLEYMELKARVEVLQRSQRNLLGEDLAPLSTIELEQLEGQVGKTLRQIRSRKTQVLLDEMCDLKRKEQILQDANMTLKRKLGEIELEATPDPPQQPQQQQMWQGDRGVPPHTPPQPEHFFQALERYPSLQPVFRGMDVNQPPPAWMA

SEQ ID NO: 1845 - protein, 259 aa, Poa annua
MGRGRVELKRIENKINRQVTFSKRRNGLLKKAYELSVLCDAEVALIIFSSRGKLYEFGSAGTTKTLERYQHCCYNAQDSNSALSETQSWYQEMSKLKAKFEALQRTQRHLLGEDLGPLSVKELQQLEKQLECSLSQARQRKTQLMVEQVEELRRKERQLGEINRQLKHKLDAEGSSSNNYRAMQQLTWAAGTVVDEGAAAYHMQHQQQQQPNHSAAMDCEPTLQIGYPHQFAAPEQAANNIPRSSGQGGENNFMLGWVL

SEQ ID NO: 1846 - protein, 502 aa, Arabidopsis thaliana
MAQVLSTPLAIPGPTPIQFMAGLLARIVTKNTNKETSTPESPRSPRTPQGSILMDKYEIGKLLGHGSFAKVYLARNIHSGEDVAIKVIDKEKIVKSGLAGHIKREISILRRVRHPYIVHLLEVMATKTKIYIVMEYVRGGELYNTVARGRLREGTARRYFQQLISSVAFCHSRGVYHRDLKLENLLLDDKGNVKVSDFGLSVVSEQLKQEGICQTFCGTPAYLAPEVLTRKGYEGAKADIWSCGVILFVLMAGYLPFDDKNILVMYTKIYKGQFKCPKWFSPELARLVTRMLDTNPDTRITIPEIMKHRWFKKGFKHVKFYIENDKLCREDDDNDDDDSSSLSSGRSSTASEGDAEFDIKRVDSMPRPASLNAFDILSFSDLSGLFEEGGQGARFVSAAPMTKIISKLEEIAKEVKFMVRKKDWSVRLEGCREGAKGPLTIRVEIFELTPSLVVVEVKKKGGNIEEYEEFCNKELRPQLEKLMHYQADEVEEVMCLPPEIEQ

SEQ ID NO: 1847 - protein, 251 aa, Betula pendula
MGRGRVELKRIENKINRQVTFAKRRNGLLKKAHELSVLCDAEVALIIFSNRGKLCEFCSSPSMLKTLERYQKCNFGAPEPNVSAREALELSSQQEYLKLKARYEALQRTQRNLMGEDLGPLSSKELELLERQLNMSLKQIRSIRTQCMLDQLTDLQRKEHMLNEANRTLKQRLVDGYHIDTVLQLDQSANDVGYGRQPAQTQDDCFFHPLCEPTLQIGYQHDHPMTVVTAGSGSVVTAGPSVNNYMSGWMP

SEQ ID NO: 1848 - protein, 348 aa, Pyrobaculum aerophilum
MAVRIDGSYGEGGGQILRTSIALSALLGRPVEIVNIRAKRANPGLQPQHLTGVKVAALLTDAEVKGAEKGSTRLYFEPKTLKCGNFSIDIGTAGSISLIVQTLAPILLYAPCPTQITVTGGTDVAWAPPIDYMRFVFTKVLERFGAKLSIELIRRGHYPRGGGRAVVRAEPVKRLKAVESEEFGNVVKISGISHAVNLPPHVAERQAKAAREELSKMGLDADIAIEVRNDGLGPGSGVVIWAVSDAGNVIGGDSLGERGKPAETVGKEAAQKLIAVLKTRASVDPHMADMAVLYMALAEGRSRISTSEETMHLKTNMYIIEQFLRVKFSTMEKAGRYTIEVEGVGYNR

SEQ ID NO: 1849 - protein, 242 aa, Betula pendula
MEFQNQSMSVSPQRKLGRGKIEIKRIENTTNRQVTFCKRRNGLLKKAYELSVLCDAEIALIVFSSRGRLYEYANNSSVKTTIERYKKACAESSNSGSVSEANTQFYQQEAAKLRGQIRSVQNSNRHLLGEALSELNFKELKNLEIKLEKGINKIRSKKNELLFAEIEYMQKREAELHNNNQILRAKIAENERNQQNLNVMPGGGNYELMQSQSYDSRTYFQVDALQPNHHYPRQDQIPLQLV

SEQ ID NO: 1850 - protein, 318 aa, Pachysolen tannophilus
MTLQYYTLNNGRKIPAIGMGCWKLENAADMVYAAIKEGYRLFDCACDYGNEKEVGEGINRAIKDGLVKRKDLFITSKLWNNFHAKENVKKALMKSLSDFNLDYFDLYLMHFPISFKFVPFEEKYPPGFYCGDGDKFIYEDVPIIETWRAMENLVDEGLVKSIGVSNVSGGLLEDLIKAARIKPASLQIEHHPYLQQNKLVEYAQLKGIVVTGYSNFGPLSFLELGNETAKKTQPLYENKTITTIAAKHGKTPFQVLLRWVNQRGIAIIPKSTFPNTLAVNLHVDEFDLTKEDFEEIAKLDRHLRFNDPWTWDKIPTFV

SEQ ID NO: 1851 - protein, 639 aa, Butyrivibrio fibrisolvens
MSQKVFISEDDEYLFGQGTHYDIYDKLGAHPSEEKGKKGFFFAVWAPNAADVHVVGDFNGWDENAHQMKRSKTGNIWTLFIPGVAIGALYKFLITAQDGRKLYKADPYANYAELRPGNASRTTDLSGFKWSDSKWYESLKGKDMNRQPIAIYECHIGSWMKHPDGTEDGFYTYRQFADRIVEYLKEMKYTHIELIGIAEHPFDGSWGYQVTGYYAPTARYGEPTDFMYLINQLHKHGIGVILDWVPAHFCPDEFGLACFDGTCIYEDPDPRKGEHPDWGTKIFNLAKPEVKNFLIANALYWIRKFHIDGLRVDAVASMLYLDYGKKDGQWVPNKYGDNKNLDAIEFFKHFNSVVRGTYPNILTIAEESTAWPKVTAPPEEDGLGFAFKWNMGWMHDFCEYMKLDPYFRQGAHYMMTFAMSYNDSENYILPLSHDEVVHLKCSMVEKMPGYKVDKYANLRVGYTYMFGHSGKKLLFMGQDFGQEREWSEKRELDWFLLENDLNRGMKDYVGKLLEIYRKYPALYEVDNDWGGFEWINADDKERSTYSFYRRASNGKDNILFVLNMTPMERKGFKVGVPFDGTYTKILDSAKECYGGSGSSVPDKIKAVKGLCDYKDYSIEFDLPPYGAEVFVFQTKKTKN

SEQ ID NO: 1852 - protein, 115 aa, Magnaporthe grisea
MSRVGKLAPEVNRALFVKNLSYNVTPEELFDLFGKFGPIRQVRQGIASNTKGTAFVVYEDVMDAKQACDKLNGFNFQNRYLVVLYHQPEKMARSKEDLEARKENLAQLKKQHGID

SEQ ID NO: 1853 - protein, 243 aa, Triticum aestivum
MVSADAARNVVGIIGNVISFGLFLSPTPVFWRIIKAKDVEEFKPDPYLATLLNCMLWVFYGLPIVHPNSILVVTINGIGLVIEGSYLIIFFLYSTNNKRLKMIGVLAAEAAFMVAVVLGVLLGAHTHEKRSMIVGILCVIFGTIMYASPLTIMGKVIKTKSVEYMPFTLSLVNFLNGCCWLAYALIKFDLYVTIPNGLGAFFGLMQLILYGCYYKRTPKEEKSVELPTSNPAGAGNVSVTVDR

SEQ ID NO: 1854 - protein, 711 aa, Pseudomonas putida
MPSKKTDAPKHSEAAGTQTPDRANTNAKLQSLEADRSDATGQALRTNQGVRIADNQNSLKAGDRGPSLLEDFIMREKITHFDHERIPERIVHARGTGAHGFFQSYGNHAELTKAGFLQDPEKITPVFVRFSTVQGPRGSGDTVRDVRGFAVKFYTDEGNFDLVGNNMPVFFIQDAIKFPDFVHAVKPEPHNEIPTGGSAHDTFWDFVSLVPESAHMVMWAMSDRAIPRSLRMMEGFGVHTFRLINAEGVASFVKFHWKPRQGVHSLLWDEAQKLAGKDTDFQRRDLWEAIETGDYPEWELGVQIVPEADEHKFDFDLLDPTKIIPEELVPVTPLGKMVLNRNPDNFFAEVEQVAFCPGHIVQGIDFTNDPLLQGRLFSYTDTQISRLGGPNFHQIPINRPVAPNHNNQRDALHQHVVHKGRASYEPNSIDGGWPKETPPAAQDGGFESYQERIDAHKIRQRSESFGDHFSQARLFFHSMSPTEQQHIIKAYSFELGKVEREHIRAREVNEILANIDLKLAAAVAANLGLPAPKAGTVKVKGSQLAQSPALSQMNHPGSVGIKGRKIAVLVADGVDAASVDKLVKALEAHSARPMLLGPTSAPVKAADGKQLPVAASMEGMPSIMFDGIVVPAGKASTDALAASGLAKHFVLEGYKHLKALVLTKELAKALGLKEDKGLLLGDEQKAVDAFVKAVEGHRVWEREAAAEAVPA

SEQ ID NO: 1855 - protein, 484 aa, Listeria monocytogenes
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFERFNGRVKYWVTLNEQNVFISHGYKLAYHPPGVSNDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 1856 - protein, 144 aa, Aquifex aeolicus
MDRRSMIVWRPFEEVERLRRDFERLLEEFVPRRAEQETLVPPVEVYETDKEVVIKMDLPGVKKEDIEITVKENAVHVRAERKEEKEEKTENIIRAERFYGVIERVIPLPVEVDPEKAEAKYENGVLEIRIPKVHVEKEKKIKLA

SEQ ID NO: 1857 - protein, 145 aa, Bacillus licheniformis
MPLVPYEPFKHLNTIRREFDRVFADFPANFGGEHGFGDIRVDVHEAGNEIVASCDIPGLESKEDVHIEVENNMLHISGTINRSSEVKEENMHRKERFTGRFHRAVALPAPVSREGIRASYRNGVLEVRMPKDKPDEKKRIDVEFH

SEQ ID NO: 1858 - protein, 437 aa, Corynebacterium glutamicum
MTTDKRKTSKTTDTANKAVGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 1859 - protein, 544 aa, Arabidopsis thaliana
MDSFSYSSMKSMLIQARGSLNSRLSEFEPLVLLLVPLVSLFLAQIIGSVFGVVHEKGLKACLIGFIMGLLKMIPGVQNYIDAEKQKVVDQLQSGSSSKKKNKTEVLPVKGLGVEVLEKMENEKRNDAIWQGKCSGTVYIGGAESEGHFSLINQACSMFAHTNPLHIDVFQSVVRFESEVVAMTAALLGSKETASGGQICGNMTSGGTESIVLAVKSSRDYMKYKKGITRPEMIIPESGHSAYDKAAQYFKIKLWRVPVDKDFRADVKATRRHINRNTIMIVGSAPGFPHGIIDPIEELGQLALSYGICFHVDLCLGGFVLPFARKLGYQIPPFDFSVQGVTSISVDVHKYGLAPKGTSTVLYRNHEIRKHQFVAVTEWSGGLYVSPTIAGSRPGSLVAGAWAAMMSLGEEGYLQNTSKIMEASKRLEEGVREIHELFVIGKPDMTIVAFGSKALDIFEVNDIMSSKGWHLNALQRPNSIHICITLQHVPVVDDFLRDLREAVETVKANPGPITGGLAPIYGAAGKMPDRGMVNELLVSFMDSQY

SEQ ID NO: 1860 - protein, 226 aa, Oryza sativa
MAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKVTHSCLVEFVICALLNLKGGHEPGWRDVPVHDPVVKDAADHAVKSIQQRSNSLFPYELLEIVRAKAEVVEDFAKFDILMKLKRGNKEEKFKAEVHKNLEGAFVLNQMQQEHDESSSQ

SEQ ID NO: 1861 - protein, 546 aa, Brucella melitensis
MAAKDVKFGRTAREKMLRGVDILADAVKVTLGPKGRNVVIEKSFGAPRITKDGVSVAKEVELEDKFENMGAQMLREVASKTNDTAGDGTTTATVLGQAIVQEGAKAVAAGMNPMDLKRGIDLAVNEVVAELLKKAKKINTSEEVAQVGTISANGEAEIGKMIAEAMQKVGNEGVITVEEAKTAETELEVVEGMQFDRGYLSPYFVTNPEKMVADLEDAYILLHEKKLSNLQALLPVLEAVVQTSKPLLIIAEDVEGEALATLVVNKLRGGLKIAAVKAPGFGDCRKAMLEDIAILTGGQVISEDLGIKLESVTLDMLGRAKKVSISKENTTIVDGAGQKAEIDARVGQIKQQIEETTSDYDREKLQERLAKLAGGVAVIRVGGATEVEVKEKKDRVDDALNATRAAVEEGIVAGGGTALLRASTKITAKGVNADQEAGINIVRRAIQAPARQITTNAGEEASVIVGKILENTSETFGYNTANGEYGDLISLGIVDPVKVVRTALQNAASVAGLLITTEAMIAELPKKDAAPAGMPGGMGGMGGMDF

SEQ ID NO: 1862 - protein, 497 aa, Zea mays
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSSQIIAQYYQLIRLGFEGYRNIMQNCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 1863 - protein, 240 aa, Medicago sativa
RGKIQIKRIENTTNRQVIFSKRRNGLLKKAKELAILCDAEVGVMIFSSTAKLYDFASTSLRSVIGRYNKSKEEHNQLGSTASEIKFGQREAAVLRQQLHNLQESHRQIMGEELSGLTVKELQGLENQLEISLRGVRMKKEQLFMDEIQELNRKGDIIHQENVELYRKVYGTKDKNGTNRVLSLTNGVGIGDDSNRTCESPAQPATETRTTTALMHSLEISVLTCKQGKWTQILISYMNGI

SEQ ID NO: 1864 - protein, 608 aa, Streptomyces hygroscopicus
MCGITGWVSFHQDPRTQAPVIEAMTATLAPRGPDAAGVWLGPRAAIGHRRLAVIDLAGGVQPMTDRPDAPTTVLTYSGEIYNHHELRSQLSGLGHEFRTRSDTEVVLRGYAEWGEKVADHLDGMFAFAVWDERAQRLLLVRDRLGVKPLFWAEVDGGLAFASEPKALFAHPEIRPRVDADGLREAYSLLFNTGPTVWSGVREVEPGGLLLLDRDGIRERRYWQLEADAHPDDRDATIARVHDLVSTAARAQLEADVPLCSLLSGGIDSTVLTALLADELRLREGPGARIRSYAVDYSDQAESFTGDVLRTGHDTPYATEAGAFLGTDHSTVVLDPRALLDPEHRRAVVVARDSPIGVGDMDTSLHLLFGEIRKHSTVALSGEAADEVFGGYPWFHNPKALATATFPWLLVTGDEAAMPLNPELDLRIGEFRDDTYRTALAAVPHLDGETPTEHRQREMQHLSLTRWLRQLLHRKDRLSMAQGLEVRVPYCDHRLVEYAFTTPWALKNFDGREKSLLRAAGTGLAPDSVLHRPKNHYPATHHPDYNRGLQNMARDALADDTVRSLADETRLKPCLDTPPGQLEWGHRLRLERVVDLALWLDHYQPELAL

SEQ ID NO: 1865 - protein, 658 aa, Triticum aestivum
ALCSKVARQVGVFYEEAYAALCAPPLSQHFDRTWVSHVQLKAAQFYADACYRFSLDLHQQEEIAQEIARLRIGMNALADAKKAAKGVAAPLLDSVNKLESNMKTNLERAMKENNSVYLMRVPEAGTLGALPAASLVKSTSLAEVLDASNERLFSSLVPDGSMKALSKYTEMVDDIIRTQAEKLQQSSEITRVRLKEMDLPDSILSLEGNVSIPADLKEDVEAVQISGGPAGLEAELQQLRDLNRVNQELLVQTEEMLQKEASEDAQFRTQFGSRWTRPQSSTLTKNIQDRLNLFAGNLKKAAASDALIERDVKESYPLMSILDRRPIESALPSISRPIMSLDGNEDAIVGALKQSLRQLESLGAQRAGLEDHLKEMKRKDDILPKLMAGVGAHDDLFRKEIAKYDPICAEIADNIVAQEQLLLQIQEQNAQFAAVFNLDDYKVARERCYKQIAAAVAKYQAIKKNMNDGLNFYVSLQDATGKIQQQCSDFIMTRNIQCREMIEDVQRKLAGFNLSSSSHNTNTPRSSSVPPDQHSPSPPPHAPHAQSSYGAPPGGDPRPVYSQPESRPPYSQPYPTYGAPPQQPPYGAAHPGQYQQHPQQHQPPPGHDYGQPAYPGWRGPYYNGQQPQPQQPGPYPQAPYSAPGAYPPHHQSNYYRPQ

SEQ ID NO: 1866 - protein, 359 aa, Hortaea werneckii
MAEFVRAQIFGTTFEITSRYTDLQPVGMGAFGLVCSAKDQLTSQAVAVKKIMKPFSTPVLSKRTYRELKLLKHLRHENIICLSDIFISPLEDMYVVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIATICSENTLRFVQSLPKRERQPLKNKFKNADPQAIELLERMLVFDPRKRVKAGEALADPYLAPYHDPTDEPEAQEKFDWSFNDADLPVDTWKIMMYSEILDFHNVDANAEQAAHNNDTVAG

SEQ ID NO: 1867 - protein, 541 aa, Psychrobacter arcticus
MSKTAAAIENNANNNDGNNHQPHYLMWFRRDLRVHDNTALAAICERANTDNAKLSAVFFLTPEQWQTHDMSLTQLDHIARTLPILAQKLQALNITLTVQICPSFTDCIAALSALCESNNISCVMANHEYEGNEIARDEQLTKQLAKTDIEFIRWHDQCILPPQTITTNDNSMYQVFTPFYKKWRHTLEVGDIQIHTAPAITNNEQINLISSEFSANTIQAIEALCKETVHDYQQYLQTHECYQYIDTDKQISQARTAYPAGEAEACHRLTQFISDDINHYDVSRDVPSLHATSHLSAYLTIGALSPRLCYLQATKALGELHRNDGDNFDSGDNNDINRWISELAWRDFYRHVLDYKPELIRHQAYKHETDKKINWSYDEDAFAAWREGKTGVPLVDAAMRCLNATGFMHNRLRMVTAMFLTKDLLIDWRWGERYFMQQLIDGDFASNNGGWQWSASTGTDSAPYFRIMNPFSQAKTHDSDGIFLKTWLPELEPIPASILHSEDKMRKALSKNGAFADIDYPIPMVEHKLARQLAIAEFKKE

SEQ ID NO: 1868 - protein, 546 aa, Xanthomonas campestris
MAAKDIRFGEDARTRMVRGVNVLANAVKATLGPKGRNVVLEKSFGAPTITKDGVSVAKEIELADKFENMGAQMVKEVASKTNDNAGDGTTTATVLAQALIREGAKAVAAGMNPMDLKRGIDQAVKAAVVELKNISKPTTDDKAIAQVGTISANSDESIGNIIAEAMQKVGKEGVITVEEGSGLENELDVVEGMQFDRGYLSPYFINNQQSQSADLDDPFILLHDKKISNVRDLLPVLEGVAKAGKPLLIVAEEVEGEALATLVVNTIRGIVKVVAVKAPGFGDRRKAMLEDMAVLTGGTVISEEVGLALEKATIKDLGRAKKVQVSKENTTIIDGAGDTAAIESRVGQIKTQIEDTSSDYDREKLQERVAKLAGGVAVIKVGASTEIEMKEKKARVEDALHATRAAVEEGVVPGGGVALVRALVAVGELKGANEDQTHGIQIALRAMEAPLREIVANAGEEPSVILNKVKEGSGNYGYNAANGEFGDMVQFGILDPTKVTRSALQNAASIAGLMITTEAMVADAPKKDEPVMPAGGGMGGMGGMDF

SEQ ID NO: 1869 - protein, 492 aa, Arabidopsis thaliana
MDPYKYRPASSYNSPFFTTNSGAPVWNNNSSMTVGPRGLILLEDYHLVEKLANFDRERIPERVVHARGASAKGFFEVTHDISNLTCADFLRAPGVQTPVIVRFSTVIHARGSPETLRDPRGFAVKFYTREGNFDLVGNNFPVFFIRDGMKFPDIVHALKPNPKSHIQENWRILDFFSHHPESLNMFTFLFDDIGIPQDYRHMDGSGVNTYMLINKAGKAHYVKFHWKPTCGVKSLLEEDAIRLGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 1870 - protein, 122 aa, Zea mays
  misc_feature (113)..(113): Xaa can be any naturally occurring amino acid
  misc_feature (116)..(121): Xaa can be any naturally occurring amino acid
MALKALDYDTLNENVKKCQYAVRGELYLRASELQKEGKKIIFTNVGNPHALGQKPLTFPRQVVALCQAPFLLDDPNVGMLFPADAIARAKHYLSLTSGRFCALCGACGRPGVXKEXXXXXXR

SEQ ID NO: 1871 - protein, 1081 aa, Candida albicans
MNPTKKPRLSPMQPSVFEILNDPELYSQHCHSLRETLLDHFNHQATLIDTYEHELEKSKNANKASQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRKINVHAQGEILQLQRTINTMVDQLRTFAFEVSKVARDVGVLGILGGQALIENVEGIWEELTDNVNAMALNLTTQVRNIANVTTAVAKGDLSKKVTADCKGEILDLKLTINQMVDRLQNFALAVTTLSREVGTLGILGGQANVQDVEGAWKQVTENVNLMATNLTNQVRSIATVTTAVAHGDLSQKIDGHPKGEILQLKNTINKMVDSLQLFASEVSKVAQDVGINGKLGIQAQVSDVDGLWKEITSNVNTMASNLTSQVRAFAQITAAATDGDFTRFITVEASGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLEVCVSDTGIGIEKDKLGLIFDTFCQADGSTTRKFGGTGLGLSISKQLIHLMGGEIWVTSEYGSGSNFYFTVCVSPSNIRYTRQTEQLLPFSSHYVLFVSTEHTQEELDVLRDGIIELGLIPIIVRNIEDATLTEPVKYDIIMIDSIEIAKKLRLLSEVKYIPLVLVHHSIPQLNMRVCIDLGISSYANTPCSITDLASAIIPALESRSISQNSDESVRYKILLAEDNLVNQKLAVRILEKQGHSVEVVENGLEAYEAIKRNKYDVVLMDVQMPVMGGFEATEKIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVKDMIGDTPRQGSVEGGGTSSRPVQRRSAREGSITTISEQIDR

SEQ ID NO: 1872 - protein, 246 aa, Triticum aestivum
MARGREGEVRNLVLGKYELGRMLGQGSFAKVYYGRDLRDGQSVAIKVIDKARLRQTDGMVEQLRREISIMRMVRHPNVVGIREVLASRQRVFVVMEYARGGELFAKVARGRLTEDAARKYFQQLVAAVAFCHSRGVAHRDLKPENLLLDEEGRLKVTDFGLAALPEQLRHDGLLHTQCGTPAYVAPEVLRKRGYDGARADMWSCGVVLYVLLCGFLPFQHDNYVKMYQKIFKGEYQMPPWVSGEAR

SEQ ID NO: 1873 - protein, 175 aa, Pseudomonas putida
MSLHDLQTLPGVTAQPDAATAQFVFNHTMLRVKDIEKSLDFYTRVLGFRLVDKRDFPEAAFSLYFLALVDPAQIPADDTARHQWMKSIPGVLELTHNHGTENDADFAYHNGNTDPRGFGHICISVPDVRAACARFEELEVPFQKRLQDGRMNHLAFVKDPDGYWVEVIQPTELEG

SEQ ID NO: 1874 - protein, 166 aa, Oryza sativa
  misc_feature (32)..(32): Xaa can be any naturally occurring amino acid
  misc_feature (100)..(100): Xaa can be any naturally occurring amino acid
  misc_feature (148)..(148): Xaa can be any naturally occurring amino acid
TKSSPTHPVELNEVKLIDGYYIMDPAKASGYXVDENTICIVAIPRSTLNGEYEDVKLLNDLLTKKNAETGWDTPIHVNAGSGWFIAPMLYPELKWDFRLXLANSMIISGHKYGLVYAGIGWCIWTSKEDLSEELMFHMNYLGADQPTXTLNLWKGCSHVIAHDYQL

SEQ ID NO: 1875 - protein, 710 aa, Methanosarcina mazei
MDKKMINEKSKEEQLEKFHEDPEREFLTTNQGVRVNNTDISLKAGERGPTLLEDFHFREKLTHFDHERIPERVVHARGSGAHGFFQVYEPMTEYTSAKFLQDPNKKTPVFVRFSTVVGFRGSADTVRDVRGFAVKFYTEDGNYDLVGNNMPVFFIQDAIKFPDLVHAIKPEQDNQIPQASAAHDTFWDFVSCHHENAHMIMWVLSDRALPRSYRMMEGFGVNTFRFVNAEGKGRFIKFHWKPMLGIHSLVWDETQKIAGKDPDFNRRDLWDAIEMGAYPEFELGVQILEEEDEFKFDFDILDPTKLWPEEDVPIKWIGKMTLDRNPDNFFAETEQVAFCPANVVPGIDFSNDPLLQGRLFSYLDTQLIRLGGPNFQEIPVNRALAPVANNQREGYNRMTINKGKTSYFPNTVGDGKPRPASAEEGGYVHYMEKVEGKIIRSRSEKFKDFFSQAKLFWNSMSQPEKEHIIEAFHFEIGKVKDKKIRQAVVDMFNNVDGDLAVEIAKGVGVSAPAQKGGSPVAKESPNLSQERSERNVKNTIKTRKIAIIVADGYDHKDLSQVMQALEAGGARADIISKFQGMLKSSDGQEIEVDKNYRTTESVLYDAVYIPGGKENVETLKKHGDAIHFVNEAFRHCKPLGATGEGVELFKAAHLPDIKLAGKSSADKVVSDKGVVTARNEGDRSSFNESFTIAIAQHRHWNREKKEQVPA

SEQ ID NO: 1876 - protein, 477 aa, Kluyveromyces lactis
MEQVDLVNANVLAAGANKKSVRVVNGLGSLMGSKQMADVDFENDSNMDYLLEQDKKEKEKYKNKRHISELPWTLNNWHLHLNWLNLILVVAIPLYGVYMALSGRVPLRHEILIFSMIYYCIGGISITGGYHRLWAHRAYSAHWPLRLFFAVFGAASVEGSIKWWSHSHRIHHRYTDTVRDPYDARRGLWYSHMGWMLLQPNPKHRARADIADLTDDWIVRWQHRNYIPLMLFSAFILPALFCHYMWNDFWGGLIYGGVLRVCAIQQATFCINSLAHYLGDQPFDDRRTPRDNWITALVTFGEGYHNFHHEFPTDYRNAIKWYQYDPTKVLIYLTSLFGLSYDLKKFSQNAIQQGLVQQQQKKLDRTRSKLNWGSPLSKLPVWDKDEFMEKLKSNNGLVVISGIVHDVSGYITEHPGGETLIQASLGKDATKAFNGGVYLHSNAAHNILATMRIAVVKDNVDQAAKFAARRGEVYEKK

SEQ ID NO: 1877 - protein, 580 aa, Pseudomonas putida
MHRHGAHLLDATSARFALWAPDARSVSVEVEQQPAIELLPDDEGWYSGVAPCQAGDRYHYRIDGELQVADPASRYQPDGVHGPSQVVDVAGYAWQHPWQGRPWHEAVIQEVHVGLLGGYAGVARQLPRLAELGISAIELMPLGQFPGERNWGYDGVLPYAPQNTYGSPEQLCALVDQAHGHGLMVLVDVVYNHFGPDGNYLHQYASPFFREDRQTPWGAAIDFRRPQVREYFIQNALMWLCDYRCDGLRLDAVHAIDQPDFLIELAQRVRAAVEPGRHVWLVLENEHNQAGLLEQGYDAQWNDDGHNALHVLLTGETEGYYADYQHRPIDQLARCLGEGFVFQGQANRHGKPRGEPSGHLPPSAFVLFLQNHDQIGNRALGERLTRLCPAPALRAATGLLLLAPMVPLLFMGDEAGSCQPFLFFTDFHDALADAVREGRRGEFAHFAAFADPKQREHIPDPNAEQTFASSRPQNKAVIAGWHGLYQQLLDLRRRHIIPHLPGSRALGAEVHADKALTARWQLGNGNTLRIDLNLADTPQAVELPAPSTRLFDSSDTRHPDTHLAAYSCVVSLLPPAQEHP

SEQ ID NO: 1878 - protein, 140 aa, Arabidopsis thaliana
MSLKALDYESLNENVKNCQYAVRGELYLRASELQKEGKKIIFTNVGNPHALGQKPLTFPRQVVSLCQAPFLLDDPNVGMIFPADAIARAKHYLSLTSGGLGAYSDSRGLSGVRKEVAEFIERRDGYPSDPELIFLTDGAS

SEQ ID NO: 1879 - protein, 238 aa, Stylosanthes hamata
MAPREKTPAVKVNGKSNAGVKEVHFRGVRKRPWGRYAAEIRDPGKKSRVWLGTFDTAEDAARAYDAAAREFRGPKAKTNFPFPDSDDINNNNIVVVKNNNRSPSQSSTVESSSRDRDSYSAAAATAVADSSPLDLNLAPQELDSPDPFGSHSTQPFAVFPGGMPAAKQALYLDAVLRASMASHGQFGFGYNRPAAAGAQSDSDSSSVIDLNQNEGDVAKNNGRGLVLDLNEPPPQEMA

SEQ ID NO: 1880 - protein, 736 aa, Pseudomonas putida
MNVTTRENGGLRQRDLDALARAEHADPFAVLGPHGDGAGGQVVRAFLPNALKVRIQARDDGRVLAEMEQGSLPGLFSAHLDKAQPYQLHIVWAGGEQVTEDPYSFGPQLGDMDLHLFAEGNHRDLSGRFGAQPTQVDGIDGVCFSVWAPNARRVSVVGDFNNWDGRRHPMRLRHGAGVWELFIPRLGVGETYKFEVLGKDGILPLKADPLARATELPPSTASKVAGELSHAWQDHDWMAQRAQRHAYNAPLSIYELHPGSWRCELDEAGEIGRFYNWRELAERLVPYVQELGFTHIELLPIMEHPFGGSWGYQPLSMFAPTSRYGSAEDFAAFIDACHQGGIGVLLDWVPAHFPTDEHGLARFDGTALYEYDNPLEGYHQDWNTLIYNLGRNEVRGFMMASALHWLKHFHIDGLRVDAVASMLYRDYSRKAGEWVPNRHGGRENLEAIDFIRHLNGVAAHEAPGALIIAEESTAWPGVSQPTQQGGLGFAYKWNMGWMHDTLHYIQNDPVHRTYHHNEMSFGLIYAYSEHFILPISHDEVVHGKHSLIDKMPGDRWQKFANLRAYLTFMWAHPGKKLLFMGCEFGQWREWNHDAELDWYLLQYPEHQGVQRLVGDLNRLYREEPALHEQDCQPQGFQWLIGDDAQNSVYAWLRWSSSGEPVLVVANFTPVPREGYRIGVPFGERWQELLNSDAELYAGSNVGNLGAVASDEVASHGQPLSLALNLPPLGVLIMKPA

SEQ ID NO: 1881 - protein, 649 aa, Lactobacillus acidophilus
MCGIVAFYDPKINDKQAVIGKMMATIKHRGPSSDGYYTNDEVALGFRRLSIIDLRGGSQPIYNEDKTRAIIFNGEIYNFKPLREELIKAGHTFTTKADTEVLLHGYEEWGMDGLLKRVRGMFAFLIWDDNNKTLYGARDFFGIKPMYYSNQDGHLLVGSELKSFLEYPKFKRELNVEAVKPYLMNQYNDLEETFFKGVYRFPAGHWFEYKDGEMKTHQYWDAEYKENSLSFEETLKRINDDLKETVDLYRNADVKVGAFLSEGIDSSYLTSLLNPDDVFSVSFDDSTYDEASKAKALADINHWKFFSEKVDADEAMRDFPEMQYHMDEPDANPSIIPLWYLCKLARKHVTVALSGEGADELFAGYVNYGMHTHNDVIKVFTSELKKLPKNKQVKLAHKIKKMPNFPGKVHMYTNLAEPSEFYVGQSVIYDMDYPTIFTSKDANSILQPTYRNKLTVNGIYQKDFKKVKGIDNVKQMQYIDLHHFMLNDIEQKADKISMAHSLEVRVPYLDKKIAELANSIPTKYLVNRHDTKYALRKASEKVLPDEWAKRPKLGFPTPIKQWLKEPRFYKQVRSLFEEEFVNDIFDQKKIIKLLDDNYEGDGSHRRQIWAIYTFLVWYKLFFVDYENTVKKYQHVQPEVANLISQGKLL

SEQ ID NO: 1882 - protein, 456 aa, Pediococcus pentosaceus
MILGVLITIVSGLVFFVGILGHTDGEKNDFNRVASVYNQINSDYYKKVDTSKLATGAIDGMLSTLNDPFSDYLTDSDATSLNDSVSGAFGGVGIQVVKKNHQIEVMTTIDGTPAKKAGLKAGDVILEVDGKKLTNQSLSKATTLMRGKVGTKVKVKLQRGNDTFDKVLTRSKIPVETVTAKMLKNKVGYITISTVAEKTSSELKRALKRLDKQGAKSYIIDVRNNPGGLMQEALKMSSMFLKNGKTIMQVKARTGKAEVYKASKKYDGGYKVTKPTTVVINGESASAAEIFAAALHQSANVPLVGSKSYGKGTVQNITQYTDSDELKLTIAKWLTPNGTWIHGKGLKPDYQADYPAMAYITEFDQKKTYSVGESNSDIKNIQIALKGLGYYDDKISKEYTEKVKQAVEAYQEKNQLAVTGKVDAKTMRSIEQNVIKTLAKNDPALEKAQKVMNDEK

SEQ ID NO: 1883 - protein, 681 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTG

SEQ ID NO: 1884 - protein, 107 aa, Oryza sativa
MAEEAQSHAREGGRHPRQPAGRENDLTTVELARFAVAEHNSKANAMLELERVVKVRQQVVGGFMHYLTVEVKEPGGANKLYEAKVWERAWENFKQLQDFKPLDDATA

SEQ ID NO: 1885 - protein, 480 aa, Pyrococcus horikoshii
MCLIAGGFKLYTDEIIRIIELGKHRGPDSFGVWSEREVIKSSDFSALEEVKGGDKVLIQCRLAMTGSKEYTQPFYNEIALVHNGEIYNHEKLRAYLVERGISFESDVDSEVILRLLEYLLFDRNLSPWNAIKKLMWMLRGDYAVAFHYNGKFYLFRDPLGIRPLYYSSQGHFGSEKKVLWGLGEEATPVMPGEAVEISKFGINRVRLYDVTAIKSFGSEYFDGLRNLLIDSVKIRSSKKIGILFSGGLDSTLIAFIASRYSNVTLYVSGTEDSKDVEWARKVSQELGLKLKEYIFSKEEVEKELKRIMFAIEEPNPMNLSIAIPLYFSTKLAREDGVKILLSGQGADELFGGYAKYLENPNLMISDVANLGERNLARDDKVSMINGVEVRYPYLDLPFAVLALNTPLQHKIKDGKRKIILREIAKSLGLPEWIAEREKKAAQYGSNAQKILEKIAKSRGIRLKELASLLFSEVFRGIHNR

SEQ ID NO: 1886 - protein, 640 aa, Francisella tularensis
MKNKNSEQNTHSTIGEQDIHYFHEGKHIYAYEFMGAHKACEEGIEGIRFTTWAPNAKSICVIGDFNYWQVEDKNYMEPITDAGLWSVFIPNAKNGDKYKFVVTNKDTNHYVYKSDPYAFFSELRPNTASIITTETQYTWSDDKWLEKRAKTNYYDNPMNVYELHLASWKTKNGKFLTYDELSETLPQYIKEMGYTHVEFMPLHEHPLDASWGYQPTGFYSVNSRHGDIIGLKRLVDKLHNNDIGVILDWVPGHFCKDQHGLIYFDGSPCYEYQEPTKAINKGWGTHNFDLGRNEVKCFLISNAMYWINEFHIDGLRVDAVSNILYLNYDREDGQWIPNIYGGHENLEGIAFLKELNGVLKHTCKGVITIAEESSSWPDISTPVEKGGLGFDFKWNMGWMNDTLRYISLDPVYRKYHHNLITFSMVYHYSEKFILSISHDEVVHGKKSLINKMWGDLWNKYAGLRLYMSYMIGHPGKKLIFMGSEFVQFVEWREYEQLQWQVVDQYESHKQTLHFFKKLNDFYHNETALWQCDYNHHGFRWIDADNSQQSILSFIRSSKDNKQKLIFICNFTPVTYYDYHLGVPDAGSYKEVFNSDNLEFGGSGQVMATEIFSSLQSSHGFEQRITIKIPPMATLVLKLIK

SEQ ID NO: 1887 - protein, 172 aa, Pyrococcus horikoshii
MRGGERMVRRRRWDIWDPFDLIREIQEEIDAMFDEFFSRPRLWTYRRWKEPELYEEGTGEVWREPFVDIFDRGDELVVIAELPGVRKEDIKVRVTEDSVYIEAIVRREKELEEEGAVRVERYYSGYRRVIRLPEEVIPEKAKAKYNNGVLEIRIPKKNPTKKEGEGFEVKIE

SEQ ID NO: 1888 - protein, 531 aa, Neurospora crassa
MGNSSSKDAGASSKNRGDDDLKSYPSFSKSDTKDSSRSFRGLRSKIPGGSKTDSPRNSTILSSEEVAEKMNALSGKNGRPSVHTRPSRRDMSPSPASPSTSSPSSPSLDTATLASPTGEPLPPPSPVHNATGGHHDVRAAQESGEVDHISDQPPSGGGGANSNQQPGQSILVKRENTINPVYDTPNQDPQNEQAVSGVAMSDIKDIDLDDFIKRLLDAAYAGKVTKSVCLKNAEIVAICHRARELFLSQPALLELDAPVKIVGDVHGQYTDLIRMFEMCGFPPNSNYLFLGDYVDRGKQSLETILLLMCYKLKYPENFFLLRGNHECANVTRVYGFYDECKRRCNVKIWKTFVDTFNCLPIAAIVAGKIFCVHGGLSPALGHMDDIRNIARPTDVPDYGLLNDLLWSDPADMDQDWEANERGVSYCFGKKVISDFLATHDFDLVCRAHMVVEDGYEFYTDRILVTIFSAPNYCGEFDNWGAVMAVSTELLCSFELLKPLDSAALKTHIKKGRHRRNNMLNSPPAHFNPQSV

SEQ ID NO: 1889 - protein, 240 aa, Unknown
  Petunia x hybrida
MGRGKVELKRIENKINRQVTFAKRRNGLLKKAYELSVLCDAEVALIIFSNRGKLYEFCSSSSMSTTLEKYHRYCYGALEGSQPSTDSQNIYQEYLKLKTRVEALQQSQRHMLGADLGQLGTKDLEQLERQLDSSLRQIRSTRTQNMLDQLSELQEKQEQSLIEMNKSLRMKLEELGVAFQTSMHSGEESVQYRQQPAEPEGLFHPVECNNSLPIRYNTLPREHVVPSAQDSTGVLPGWML

SEQ ID NO: 1890 - protein, 121 aa, Ustilago maydis
MASQSSIGAARQHSRILFVKNLNYNTTGADLYQVFGRYGAIRQIRLGDATGTKGTAYVVYEEMADVKRALDHLNGFHLNERYIVVLYHMPARLAAKADLARREAELADLKALHNITDEVLH

SEQ ID NO: 1891 - protein, 543 aa, Arabidopsis thaliana
MRRFVIGQAKNLIDQSRRRQLHHHKNLSFVSLIPPFSAPSDSSSRHLSSSSSSDMSASDSSSSLPVTLDTINPKVIKCEYAVRGEIVNIAQKLQEDLKTNKDAYPFDEIIYCNIGNPQSLGQQPITFFREVLALCSYTALLDESATHGLFSSDSIERAWKILDQIPGRATGAYSHSQGIKGLRDAIADGIEARDGFPADPNDIFMTDGASPGVHMMMQLLITSEKDGILCPIPQYPLYSASIALHGGTLVPYYLDEASGWGLEISELKKQLEDARSKGITVRALAVINPGNPTGQVLSEENQRDVVKFCKQEGLVLLADEVYQENVYVPDKKFHSFKKVARSMGYGEKDLALVSFQSVSKGYYGECGKRGGYMEVTGFTSDVREQIYKMASVNLCSNISGQILASLIMSPPKPGDDSYESYIAEKDGILSSLARRAKTLEEALNKLEGVTCNRAEGAMYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 1892 - protein, 404 aa, Vibrio parahaemolyticus
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGNPVHYLCDEQSDWYPDLDDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAFELINQIPGVSCVKPKGAMYLFPKIDTKMYNIKNDQQMVLDFLKQEKVLLVQGSGFNWPKPDHFRIVTLPHVEDLETAIGRFERFLSTYSQ

SEQ ID NO: 1893 - protein, 246 aa, Unknown
  Petunia x hybrida
MGRGRVELKKIENKINRQVTFAKRRNGLLKKAYELSVLCEAEVALIIFSNRGKLYEFSSTSNMVKTLDRYQKCSYGTLEVNHRSVKDNNEERIYREYLKLKAKYESLQRYQRQLLGDELGPLNIDELEHLELQLDSSLKLIKSTRTQLMLDQLSDLQTKEKLWVEANKVLERKLEQIYAENNIQQSWGGGEQSGAYGQQHAQTQGFFQPLECNSTLQIGYDPATSSQITAVTSGQNVNGIIPGWML

SEQ ID NO: 1894 - protein, 505 aa, Helicobacter pylori
MVNKDVKQTTAFGAPVWDDNNVITAGPRGPVLLQSTWFLEKLAAFDRERIPERVVHAKGSGAYGTFTVTKDITKYTKAKIFSKVGKKTECFFRFSTVAGERGSADAVRDPRGFAMKYYTEEGNWDLVGNNTPVFFIRDAIKFPDFIHTQKRDPQTNLPNHDMVWDFWSNVPESLYQVTWVMSDRGIPKSFRHMDGFGSHTFSLINAKGERFWVKFHFHTMQGVKHLTNEEAAEIRKHDPDSNQRDLFDAIARGDYPKWKLSIQVMPEEDAKKYRFHPFDVTKIWYTQDYPLMEVGIVELNKNPENYFAEVEQAAFTPANVVPGIGYSPDRMLQGRLFSYGDTHRYRLGVNYPQIPVNKPRCPFHSSSRDGYMQNGYYGSLQNYTPSSLPGYKEDKSARDPKFNLAHIEKEFEVWNWDYRADDSDYYTQPGDYYRSLPADEKERLHDTIGESLAHVTHKEIVDKQLEHFKKADPKYAEGVKKALEKHQKMMKDMHGKDMHHTKKKK

SEQ ID NO: 1895 - protein, 1453 aa, Ralstonia metallidurans
MNGVRLLTRRIRWIDLLGLLRCVGFLLLMSIWHDAVAQQPIATTAQTIRVGVVQNDWPPFAIVQDGQVSGIGVDFLRAALGDRPVRIVTTTFASMPALLAAACANQVDVVLNVGETAERARCLRFSEAYFDATAAIVGRAGAAGQDAVALEQARIAVEPGSFMDERLRARFPNARFVPVKDAEGGLRAVRDNQADYYPTRQPVADYYLGRPEYKGLAVQAGYREPGGGLHFAFSPAAAALQTTVNQGLATMPQDARRAIIGRWVTPPIVASSPAGEFFLTPEERAFLQSLPVLKVAFDAGSAPYSYVDDRGRPGGMAADYLSYLGRTLGVRFQRERAAPFAQTVEALRQGKLDLMAVAVAEDPALAGLPVTRPYASFPMVIVGRQLDVAVEGLNDLTGKRVVVCEASGVEGLLRAAVPHLQLSVVSSVHAGMEAVANGKADAYVDDLATVDVELQRYFAGTLRIIGSGRQTLDMGFGLSPELGARLLPLIDRAMEYMPQVERLAIQSRYIAASYALEPSWQQVLRRIAPYLVAVIVIIGILLRSQYRLRREASARRLAKQQLQAQLDFQRTLIDAVPIPITVKDAQGRYVEVNAAFQSRAGMTRQQMVGHLPTELNVPGNRAAEALEAGSRRALETQQLQQFAVDYVDADGKQRYYLCWAQPIKRVGPEFAGVISAAVDVTEIRNAEAKAQAAEAMLVDATRHLPATAFRMRERDGVFSYEWVSGNAQQLLGRSSESLIGPANPLLGMANVEDRIAALAAAEEAKTTGRPLSADMRLLIRGQTRWIRIHAVPKTEPDGGVLWHGYYVDLTEERERANALAQAKDAAEAASRAKDSFLAMMSHEIRTPMNGILGLIELLQRTPLTAEQQRMVALAGESGQALGRILDDILDYAKLEAGRLAILRAPVDLRELFDGVLGSLLPQAFQKGLRLKQRVSAEVAAIVQADGIRLRQILFNLLGNAIKFTDHGSVMLRATMEPGATGLPMLVVVVEDTGIGIARTDLARLFAPFMQSERSTARRFGGTGLGLTIVRTLAELMDGEITLKSEAGVGTTAVLRVPCEVVSQGYDLPNLRGRALSVLVSDDSRRAALIAYGEAAGMRCVSPEDETPDDGIAITDRMERAGRKGQFAIHLTDELLPLGYSQDESGVSLGSNPLRWTAFVGALEALLKGIAPASPQASRAGEGKADDLVPQGARILVVEDHPINREVIGQQLRLLGYRSTVCTNGQEAVTALRADTYDLVLTDCHMPVMDGFDLTRSIRASDRPSVRALPVVGLTATVAREEHVLCMEVGMNAFLVKPATLASLQQTIETALQGGPEAPSPKTEVRSREASPARRTPESGGFRPECIDTVGLRSQLEPMLAERDVRQIFLRSLEQDRDALRAQLAAPTPAGLGKWCHRAGGAISVMEQPYLHELLDRLDGLLETGSPAQIQSAGASLSAMYDYLIDWLEKLDVA

SEQ ID NO: 1896 - protein, 681 aa, Ralstonia metallidurans
MRIQHAFRLITLAMVATIVGFGSYLWTEEWRAYAVAQHSEAMLQAFRATLVAAEKVSAERGPSNAALGAAPGVAAGALLRAREQSDASLTAAIAMLHGANCPECGAAKGSLEHARAQLAAARSQIDRLIARPLSERHDVQRAVSGMFTIVDEILRVADGPLSRLQRSAPVAAQHAVSARFAAELREYAGRAGSEFTSALVSNRPMHSEERERLAGDLGRVQTLGDQIQQRVSFQLASKPGLRDADTALHKRFFGDGLAYLQKVEAIGPAEPRPTTAELASTYVPLMAPIVAMRDAVLDVAQAEVQADTTRAKRRLGGLLAILAIITSFVAATFWLFAKRVLRPLTLATEATVELAEGRYDGPTHVWPKTDEIGAIFVALEQLRAGLLRKVALEHERTTLIARLQAAVTHERAQMMALAQARDAAEASARTKSSFLAMMSHEIRTPLQGILGLLELVEYSPLSAEQRRQVRLASEAGQALRQILDDVLDYAKMDAGRLRLALAPLDLRGLFANVLSLLAPRAQAKGLQLQQWVQPDVPVQLVADGARLRQILLNLVGNAIKFTECGSVDLLASVEPTSAGEDVLVVSVADTGIGIAPEDIARLFTPFVQGESGPARRFDGTGLGLAISRQLAQLMGGELMLDSTLGVGTQVMLRVPMPGCPDAGSPLSNSERREHRAEFRLA

SEQ ID NO: 1897 - protein, 239 aa, Stylosanthes hamata
MAPREKTPAVKVNAGVKEVHFRGVRKRPWGRYAAEIRDPGKKSRVWLGTFDTAEDAARAYDAAAREFRGPKAKTNFPFPDSDDINSNNNNIVVVKNNNRSPSQSSTVESSSRDRDSYSAAAAATAVADSSPLDLNLAPAGAGFAGSIRFPFQQPFAVFPGGMPAAKQALYLDAVLRASMASHGQFGFGYNRPAAAAAGAQSDSDSSSVIDLNQNEGDVAKNNGRGLVLDLNEPPPQEMA

SEQ ID NO: 1898 - protein, 255 aa, Xanthomonas axonopodis
MRLIALPAFDDNYIWALVAADGRAIIVDPGQAEPVLAAAQRQGLVPSAVLLTHHHGDHIGGVAELQQRWPDLALFGPADERIPTNAHHVGRGERLRLLDVEFQVIKVPGHTRSHIAFLADGHLFSGDTLFSLGCGRMFEGTAPQMFDSLQRLASLPGETLVCCGHEYTLANAAFALHVDPTNAALQRRQQEAQAMRHAARPTLPISLKSELATNPFLRTSHPEIRAAVAPRAASALSSEVDIFAELRRWKDEFRA

SEQ ID NO: 1899 - protein, 294 aa, Brucella melitensis
MWWPAPRKTAQKISGKGYIMTVPTVKLNDGNHIPQLGYGVWQISNDEAVSAVSEALKAGYRHIDTATIYGNEEGVGKAINGSGIARADIFLTTKLWNSDQGYESTLKAFDTSLKKLGTDYVDLYLIHWPMPSKDLFMETWRAFIKLKEEGRVKSIGVSNFRTADLERLIKESGVTPVLNQIELHPQFQQDELRLFHGKHDIATEAWSPLGQGKLLEDPTLKSIAEKHAKSVAQIILRWHIETGNIVIPKSITPARIKENFDIFDFTLNGTDHDAITKLDMADGRIGPNPSVFSA

SEQ ID NO: 1900 - protein, 370 aa, Triticum aestivum
PTRPREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRQAEPASFPVPTRPVVGKREKTRIKKENDFVQPGERYRSWAPDRQDRFVRRFADALAHPKVSHELRVIWIDFLSKCDKSCGMKVANRLNVKPSM

SEQ ID NO: 1901 - protein, 507 aa, Zea mays
SQNGVQMLSPSEIPQRDWFPSDFTFGAATSAYQIEGAWNEDGKGESNWDHFCHNHPERILDGSNSDIGANSYHMYKTDVRLLKEMGMDAYRFSISWPRILPKGTKEGGINPDGIKYYRNLINLLLENGIEPYVTIFHWDVPQALEEKYGGFLDKSHKSIVEDYTYFAKVCFDNFGDKVKNWLTFNEPQTFTSFSYGTGVFAPGRCSPGLDCAYPTGNSLVEPYTAGHNILLAHAEAVDLYNKHYKRDDTRIGLAFDVMGRVPYGTSFLDKQAEERSWDINLGWFLEPVVRGDYPFSMRSLARERLPFFKDEQKEKLAGSYNMLGLNYYTSRFSKNIDISPNYSPVLNTDDAYASQEVNGPDGKPIGPPMGNPWIYMYPEGLKDLLMIMKNKYGNPPIYITENGIGDVDTKETPLPMEAALNDYKRLDYIQRHIATLKESIDLGSNVQGYFAWSLLDNFEWFAGFTERYGIVYVDRNNNCTRYMKESAKWLKEFNTAKKPSKKILTPA

SEQ ID NO: 1902 - protein, 436 aa, Nocardia farcinica
MTAIALFTRDLRVHDNPVLAAARDAGDAVVPLFVIDAHLVPDRCPPNRARFLAAAVRELDAELRTRGGRLIVRRGVVADEVARVVDETGARTVHLADDVSGYSAARADALRERLDRRGVRLEPHPASITTVDGDVLRPATGRDHFAVFTPYFRRWSEVPRRAPLPPPEDLEVPDLPSAALPTPESLNRGEPSPQLSVGGETTGRALLDSWLAGPVDDYVETGDDLAADATSHLSPYLHFGCLSPTELLHRVDVGSAGGQAFARQLAWRDFHHQLLAARPAVARHDYRPRPIRWRDDPQALAAWRSARTGYPIVDAALRQLHTEGWLPNRARLIAAAFLTKTLGLHWRAGAGHFLHWLVDADLANNQLNWQWVAGTGSDTRPNRGFNPLRQADRYDPDGVYVRRWIPELADLDGGRIHRPWRAEVDYPSPIAECPGM

SEQ ID NO: 1903 - protein, 686 aa, Pseudomonas syringae
MAFEAMFQPIQIGKLTIRNRVLSTAHAEVYATDGGMTTDRYVKYYEEKAKGGIGLAICGGSSSVAIDSPQGWWKSVNLATDRIIPHFQNLADAMHKHGAKIMIQITHMGRRSRWDGDHWPTLMSPSGIREPVHRATCKTIEPEEIWRVIGNYASAAARAKAGGLDGVELSAVHQHMIDQFWSPRVNKRTDEWGGSFENRMRFGLEVIKAVRKEVGPDFCVGLRICGDEFHPDGLSHEDMKQIAKYYDDTGLIDFLGVVGSGCDTHNTLANVIPNMSYPPEPFLHLAAGIKEVVKAPVLHAQNIKDPNQATRILEGGYVDMVGMTRAHIADPHLIAKIKMGQIDQIKQCVGANYCIDRQYQGLDVLCIQNAATSREYMGVPHIIEKSAGPKRKVVVVGAGPAGMEAARVSAERGHDVTLFEKKAFIGGQITTASKAPQRDQIAGITRWFQLELARLKVDLRLGTAADAATILDLRPDIVVLAVGGHPFLEQNEHWGAAEGLVVSSWDVLDGKVAPGKNVLVYDTICEFTGMSVADFLADKGCQVEIVTDDIKPGVAIGGTSFPTYYRSMYPKEVIMTGDMMLEKVYREGDKLVAVLENEYTGAKEERVVDQVVVENGVRPDEAIYYALKEGSRNKGQIDIDALFAIEPQPSLSQPGDGYLLFRIGDCVAQRNTHAAIYDGLRLCKDF

SEQ ID NO: 1904 - protein, 351 aa, Glycine max
MDKYEAVKDLGAGNFGVARLMRNKETKELVAMKYIERGQKIDENVAREIINHRSLRHPNIIRFKEVVLTPTHLAIVMEYAAGGELFERICNAGRFSEDEARYFFQQLISGVHYCHAMQICHRDLKLENTLLDGSPAPRLKICDFGYSKSSLLHSRPKSTVGTPAYIAPEVLSRREYDGKLADVWSCGVTLYVMLVGAYPFEDQDDPRNFRKTIQRIMAVQYKIPDYVHISQDCRHLLSRIFVANPLRRISLKEIKSHPWFLKNLPRELTESAQAVYYQRGNPSFSIQSVEEIMKIVGEARDPPPVSRPVKGFGWDGEEDEGEEDVEEEEDEEDEYDKRVKEVHASGEFQIS

SEQ ID NO: 1905 - protein, 245 aa, Unknown
  Petunia x hybrida
MGRGRVELKRIENKINRQVTFAKRRNGLLKKAYELSVLCDAEVALIIFSSRGKLYEFCSTSSMMKTLEKYQQCSYASLDPMQSANDTQNNYHEYLRLKARVELLQRSQRNLLGEDLGSLNSKELEQLEHQLDSSLKQIRSKKTQHMLDQLADLQQKEQMLAEANKQLRRKLEESAARIPLRLSWDNGGQPMQHNRLPPQTEGFFQPLGLNSSSPQFGYSPMGANEVNNAVSTAQNMNGFIPGWML

SEQ ID NO: 1906 - protein, 366 aa, Rhodopseudomonas palustris
MSNSKLFEPTKLGPITLANRVVMAPLTRNRAVPEGLVPSPLAAEYYGQRASAGLLITEASQVSQQGQGYQDTPGIYSQAQVEGWRKVTGEVHKRGGKIFIQLWHVGRISHVDLQPNHGAPVAPSAIRANTKTFVGGQFADVSEPRALELSEIPGIIEDFRKAAANAIAAGFDGVEIHGANGYLLDQFARDSSNKRTDEYGGSIQNRARLMLEVAAAVAKEIGPERTGIRISPVTPANDVSDSNPQALFDYIVDELNKLKLVYIHVIEGATGGPRDIAPFDYASLRKRFSGSYIGNNAYDLALANKQLDAGAADLIAFGKPFISNPDLVERLKRNAPLNEPDKSTFYGGGAKGYTDYPTLESAQAAQ

SEQ ID NO: 1907 - protein, 488 aa, Listeria monocytogenes
MTDRKNLTTNQGVPVGDNQNSMTAGRKGPTLIEDYVLIEKLAHFDRERVPERVVHARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREIRGSSVHAFKWINEEGKTVYVKLRWVPKAGIVNLSTEQASQIQAKEFNHASRDLYEAIENGDYPEWDLYVQVLDPKDLDSFDFNPLDATKDWFEDVFPYEHVGTMTLDRNPDNIFAETESVGFNPGVLVRGMLPSEDRLLQGRLFSYSDTQRHRVGPNYLQLPINSPKAPVANNQRDGHMPFKQQTSSINYEPNSYDTEPKENPAFIEPEQEIRGDVAGRLIAEKPNNFGHAKEVWDRYSDAERAALVKNIVDDWSAVREDIKIRNLRNFYQVDPEFASRVAARTGINLEEHVTDLK

SEQ ID NO: 1908 - protein, 482 aa, Lactobacillus acidophilus
MYSAKMPNNFLWGGAVAAHQLEGAWKEGGKGTSVADVMTVGSATKPREITDGVLPGKNYPNHSAIDFYHHYKEDIKLMAEMGFKAFRTSIAWTRIFPNGDETEPNEEGLKFYDDLFDTCHEYGIEPVITLSHFEIPFNLAKNYSGFTNRKVIDFFVRFAEVCFKRYKNKVKYWMTFNEIDNQSAFNDDFLMATNSGILFKDGMTDKDKEAAMYQAGHYELVASALAVKIGHKINPDFQIGCMINYSPVRPLTPSSDDVLLADKWEQRRDWFSDVHVFGEYPNAVEAYIERNGYRPDITDEDRIVLKEGTVDYVGFSYYQSTTVSSKKVMPDDLTDLAKAIAKNPTLKRSDWGWEIDPEGLRIALNQLQDRYHKPLFIVENGLGAYDKVEADGSIHDDYRIDYLRSHISEMEKAVELDGVDLMGYLPWGCIDLVSAGTGQMDKRYGFIYVDKNDAGEGTLDRSRKDSFFWYKNVIESNGKNLG

SEQ ID NO: 1909 - protein, 134 aa, Zea mays
MRKHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEEGASA

SEQ ID NO: 1910 - protein, 363 aa, Pseudomonas putida
MSALFEPYTLKDVTLRNRIAIPPMCQYMAEDGMINDWHHVHLAGLARGGAGLLVVEATAVAPEGRITPGCAGIWSDAHAQAFVPVVQAIKAAGSVPGIQIAHAGRKASANRPWEGDDHIAADDARGWETIAPSAIAFGAHLPKVPREMTLDDIARVKQDFVDAARRARDAGFEWIELHFAHGYLGQSFFSEHSNKRTDAYGGSFENRSRFLLETLAAVREVWPENLPLTARFGVLEYDGRDEQTLEESIELARRFKAGGLDLLSVSVGFTIPDTHIPWGPAFMGPIAERVRREAKLPVTSAWGFGTPQLAEAALQANQLDLVSVGRAHLADPHWAYFAAKELGVEKASWTLPAPYAHWLERYR

SEQ ID NO: 1911 - protein, 188 aa, Arabidopsis thaliana
MTNYGAIPTSSHASPLVDVESLSRAKHRIKAGLATRRAWRVMFDFHSMGLPHGVSDAFTRIKTNLAYFRMNYAIVVLIVIFFSLIWHPTSLIVFTVLVVVWIFLYFLRDEPIKLFRFQIDDRTVLIVLSVLTVVLLLLTNATFNIVGALVTGAVLVLIHSVVRKTEDLFLDEEAATTETSGLTSYPST

SEQ ID NO: 1912 - protein, 380 aa, Zea mays
MRDDVAFQIINDELYLDGNARQNLATFCQTWDDENVHKLMDLSINKNWIDKEEYPQFAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGARY

SEQ ID NO: 1913 - protein, 337 aa, Desulfovibrio vulgaris
MPEVTVTEHLLLHQKKSPAATGQFTTLLNDLVLSAKIISRSVTKAGLLDVLGGTGEVNVQGELVQKLDEFANRVLIYRMERSGAVCAMASEENADIIKVPEKLHRGDYVLIFDPLDGSSNIDVNINVGTIFSILRRKSPASDDVCIDDVLQPGYEQVAAGYILYGPSTMLVFSTGQGVHGFTLDPSVGEFLLSHPDMSIPERGRIYSINESYWNYWDEPTREIVSYFKGDHNERGKPYSLRYVGSLVADFHRTLLYGGIFMYPMDYRHPDKPQGKLRLMCEASPLAFLAEQAGGRAIDGSRRILDVCPGTLHERIPLFIGSARDVDKVEEIYARHRA

SEQ ID NO: 1914 - protein, 398 aa, Methanosarcina mazei
MNEQGLSEREIFSYLENAKSEDTDYYRVFSSMCTRPHKIAIEANRLFIEANLGDLGLFAGAHKLEQEVVRMLGNLLHASSIDVPSGGLCQSSVCGYLTTGGTESNIQAVRGMKNLVTAGKKEFKGTPNIVIPASAHFSFDKVADMMGIEVRRASLDSEFRVDMASVEKLINENTIGLVGIAGNTEFGQIDPIDKLSEVALENELFLHVDAAFGGFVIPFLEKPQPFDFKVPGVTSIAIDPHKMGLSTIPSGALLFRSPSFLDSLKVSTPYLTTKSQFTLTGTRSGASAAATCAVMKYLGYEGYRKNVQYCMELTSKIVEEARKLGFEPLIEPVMNVVALKVPNPDLVRERLLKKFGWNVSITRTPRALRLVLMPHNSPEDIELFLEDLKKVTAEIKSP

SEQ ID NO: 1915 - protein, 227 aa, Eucalyptus grandis
MAREKIQIKKITNATARQVTFSKRRRGLFKKAEELSVLCDADVALIVFSSSGKLFEYCSSSMKEILERHHSHSENLGKLDQPSLKLQLVENGDYSRLSKEVAEKGHQLRQMRGEELQGLNIDELQQLEKSLEAGLNRVIEKKGEKIMKEITDLQQKGAKLMEETKRLKQQVTEISGRKTTATDSETIINEEGLSSESITNVCSSSSGPPQEDDSSDISLKLGLPYNG

SEQ ID NO: 1916 - protein, 109 aa, Glycine max
  misc_feature (17)..(17): Xaa can be any naturally occurring amino acid
  misc_feature (31)..(31): Xaa can be any naturally occurring amino acid
  misc_feature (38)..(38): Xaa can be any naturally occurring amino acid
  misc_feature (42)..(42): Xaa can be any naturally occurring amino acid
KEDVEAVHISGGPCWLXAQLHPLNDLTMVNXELLTLTXELLXQKEAREDSYFRIHFGTKWTMPQSSTLTMNLHDMLNRLAGNSEQAAESDGMIERSVREHSDVMSILDA

SEQ ID NO: 1917 - protein, 207 aa, Hypocrea lixii
VAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKS

SEQ ID NO: 1918 - protein, 171 aa, Candida albicans
MCLCLSDLFLIILSVLFPPLPVWIRRGCCSCDSLINIALCMLGYFPGLIHSWYIIAKYSSYYYQQQQQQRKDTIYYVYRSDLENQTPRRDGRDGRDECHHDHHHHHHHHHNQAESQSAGLIVSNNHNNNNNNYGSVVEGSSSSNLTPVAPIPVENGAPPPAYTEIDNKTQH

SEQ ID NO: 1919 - protein, 200 aa, Fusarium proliferatum
VAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASEN

SEQ ID NO: 1920 - protein, 265 aa, Triticum aestivum
  misc_feature (232)..(232): Xaa can be any naturally occurring amino acid
  misc_feature (253)..(253): Xaa can be any naturally occurring amino acid
  misc_feature (259)..(259): Xaa can be any naturally occurring amino acid
HYRTSLYKKAGWYRSGIPGISSTHASETNMQENWRIVDFFSHHPESLHMVTFLFDDVGIPLNYRHMDGFGVNTYTLISRDGKAHLVKFHWKPTCGVKCLLDDEAVTVGGTCHTHATKDLTDAIAAGNYPEWKLFIQTIDADHEDKFDFDPLDVTKTWPEDIIPLQPVGRMVLNKNIDNFFAENEQLAFCPAVTVPGIHYSDDKLLQTRIFSYADTQRHRLGPNYLMLPVNSXECAHHNNHHDGLMNFMHRDEXVNYFPXRFDPTR

SEQ ID NO: 1921 - protein, 434 aa, Geobacter sulfurreducens
MRNELVTPGAGELTYEIRNIVNVAEKLQKHGVKINWENIGDPIVKKEEIPRWMKEIVAAAVMENDTWGYCHTRGVLETREFLCGLTNNRGGAQITPDDIIFFNGLGDAISTVYGNLRHESRILMPSPTYTTHSIGEAAHAQAAPVCYRLKPEDNWFPDVEDLENHVKYNPQISGILLINPDNPTGMVYPREILEQIVAIARRYDLFIIADEVYNNITYNGQTTVPISDVIGEVPAIAMKGISKEIPWPGSRCGWIEVYNGNRDEQFHKFLNSILTAKMNEVCSTTLPQKCIPAIMKHPEYQTYLRERIACYERMSTITYDCLKQVPGLMVNRTNGAFYMSVAFRDGLLTDRQSLPIESVEVRELVEKLVNAPGVSPDKRFVYYILASTGICIVPLSSFNTPLQGFRVTLLEKDENECMRIYRTLAERIKEYLNS

SEQ ID NO: 1922 - protein, 595 aa, Corynebacterium glutamicum
MCHSISHLSSPTGSIFTSLVAMLTSQSFSVWAPLPHDVHLILNGETLPMHKTEGSWWRAEIAPKAGDRYGFSLFDGSSWSKTLPDPRSTSQPDGVHGLSEVSDDSYLWGDQQWTGRILPGSVLYELHVGTFSEDGTFEGVVDKLPYLRDLGVTAIELLPVQPFGGNRNWGYDGVLWHAVHAGYGGPAGLKKLIDASHQAGIAVYLDVVYNHFGPDGNYNGQFGPYTSGGSTGWGDVVNINGHDSDEVRNYILDAARQWFEDFHVDGLRLDAVHSLDDRGAYSLLAQLTMVAEDVSAQTGIPRSLIAESELNDPKFVTSREAGGFGLDAQWVDDIHHALHALVSGERNGYYSDFGSVDTLAKTLREVFEHTGNYSTYRGRNHGRPVHPDITPASRFVTYTTTHDQTGNRAIGDRPSTTLTPEQQVLKAAIIYSSPYTPMLFMGEEFGATTPFAFFCSHTDPELNRLTSEGRKREFARLGWNADDIPSPELESTFTSSKLDWEFTAEQRRINDAYKQLLHLRHTLGFSQPNLLTLEVEHGENWLSMANGRGRILANFSDDTITVPLGGELIYSFTSPTVTDTSTTLQPWGFAILTRN

SEQ ID NO: 1923 - protein, 153 aa, Rubrobacter xylanophilus
MLSPFRGFWDVRSELDRMFDDVVRDAFRLWRGEGRAARTAEWAPAIDVYSKDGDLVIKAELPGMKPEDVDITLQEGVLTISGERKAEEEREGAGYFVRERRYGSFRRSMRLPEGVDESKIHARFEDGVLEVVVEGAGAVTEPRRIQIEAPKGS

SEQ ID NO: 1924 - protein, 403 aa, Glycine max
MASDGFTDKNTVFRKLKAKSENKMCFDCNAKNPTWASVTYGIFLCIDCSAVHRSLGVHISFVRSTNLDSWSPEQLKTMSFGGNNRAQVFFKQHGWNDGGKIEAKYTSRAADLYRQILSKEVAKSMAEDGGLPSSPVASQSSQGVNGLPEVKTNEVPKENILEKPEKPESTSSPRASHTVISSTVKKPIGAKKAVKSGGLGARKLTKKPSESLYEQKPEEPPAPVSSSTNNMPAGPSPTSRFEYAENVQSSELNTGGSHLLSHVSPPKSSSFFADFGMDSGFPKKSGPSSSKVQIQETDEARRKFSNAKSISSSQYFGDQNKAADVDSQATLSKFSGSSAISSADLFGDSRDNNIDLTAGDLINRLSFQAQQDLSSLKNIAGETGKKLSSLASTLMTDLQDRIL

SEQ ID NO: 1925 - protein, 313 aa, Unknown
  Rhizobium sp. TAL1145
MTDIREWTSTVGLENELGEVLSGLANACATIARTLRTAPLAQLSGSAGSLNVQGEAQKPLDIISNEVFVNACRELAQISLAVSEEEEDPIPISATGSYAVVFDPLDGSSNLDVNVTVGSIFSVVSATTPKHILPGGRPQHIAGFASYGPSTDLTVLAKGRVARFTLDASDTWRLVELDMRLPDRFPEIAINAARADSWDDVIRGFVNDAFHGNEIRYNARWVASLVAETQRILSRGGLFLYPADSSGRGRLRLLYEARPIAAIVEAAGGRCSTGFMPILEVNAETLHDRVPLIFGGASQVEALEAAYRADKEN

SEQ ID NO: 1926 - protein, 366 aa, Dioscorea elephantipes
SGKPFYAIVHRVTGCLIFDFEPVKLSDIPTSTTASGALQSYKLAAKAIARPQSLPGGSMDTLCETLVEEVFQFTGYDRVMVYKFHEDDHGEVYQEITKPGMVPYLGLHYPATDIPQAARFLFIKNKVRMICDCRAKHVNIHQDETLLFDITFCGSTLRAAHNCHLQYMSNMNSIASLTMAVVVNEGEEEDDHLEPGQSSQQQQQQQQQQQQQQQKRKHLWGLVVCHNESPRFLPFPMRYACQFLMQVFSVHVTKELELENQIREKNILRTQTLLCDMLLRDTAPVGIITQSPNIMDLVKCDGAALLYDDRIWRLGLTPTKEQIRSIAHWLAEHHMAPTALSTDSLQDAGYPDAQALGDLVCGMAAA

SEQ ID NO: 1927 - protein, 546 aa, Helicobacter pylori
MAKEIKFSDSARNLLFEGVRQLHDAVKVTMGPRGRNVLIQKSYGAPSITKDGVSVAKEIELSCPVANMGAQLVKEVASKTADAAGDGTTTATVLAYSIFKEGLRNITAGANPIEVKRGMDKAAEAIINELKKASKKVGGKEEITQVATISANSDHNIGKLIADAMEKVGKDGVITVEEAKGIEDELDVVEGMQFDRGYLSPYFVTNAEKMTAQLDNAYILLTDKKISSMKDILPLLEKTMKEGKPLLIIAEDIEGEALTTLVVNKLRGVLNIAAVKAPGFGDRRKEMLKDIAILTGGQVISEELGLSLENAEVEFLGKAGRIVIDKDNTTIVDGKGHSDDVKDRVAQIKTQIASTTSDYDKEKLQERLAKLSGGVAVIKVGAASEVEMKEKKDRVDDALSATKAAVEEGIVIGGGAALIRAAQKVHLNLHDDEKVGYEIIMRAIKAPLAQIAINAGYDGGVVVNEVQKHEGHFGFNASNGKYVDMFKEGIIDPLKVERIALQNAVSVSSLLLTTEATVHEIKEEKAAPAMPDMGGMGGMGGMGGMM

SEQ ID NO: 1928 - protein, 463 aa, Dioscorea elephantipes
SGKPFYAIMHRIDVGLVIDLEPVNPADVPVTAAAALKSYKLAAKAISRLQSLPSGNIPLLCDVLVKEVSELIGYDRVMAYKFHEDEHGEVIAECRRSDLEPYLGLHYPATDIPQASRFLFMKNKVRMICDCSAPPVKVIQDKRLPQPLSLGGSTLRAPHGCHAQYMANMGSIASLVMSVTINEDDDETGSGDQQQNGMKLWGLVGCHHTSPRFVPFPLRYACEFLLQVFGIQLNKEVELATQQREHILRTQLSCDMLLRDAPIGYLLNSPNVMDLVKCDGAALYYKNQFWLLEITPTEAQIRDIFAWLLEYHNSTTGLSTNSLTEAGYPGAVELGDAVCSMAATKITSKDFIFWFRSHTSKEIKWGGAKHDPGDRTDEGRKMHPRSSFKAFLEVVKRRSLPWEDVDMDAIHSLQLILRGSLQDEPVTDNSKTIVNATPDDAKQIQHMDELRIVTTEMVRLMET

SEQ ID NO: 1929 - protein, 547 aa, Pseudomonas syringae
MAAKEVKFGDAGRKKMLAGVNVLADAVKATLGPKGRNVIIEKSFGAPLITKDGVSVAKEIELKDRFENMGAQLVKDVASRANDDAGDGTTTATVLAQAIVNEGLKAVAAGMNPMDLKRGIDKATIAIVAELKKLSKPCTDTKAIAQVGTISANSDHSIGDIIAEAMEKVTKDGVITVEEGSGLENELSVVEGMQFDRGYLSPYFINKPDTMVAELDSPLLLLVDKKISNIREMLPVLEAVAKAGRPLLIVAEDVEGEALATLVVNNMRGIVKVAAVKAPGFGDRRKAMLQDIAVLTGGTVISEEIGLSLETTTLEHLGNAKRVILNKENTTIIDGAGVKTDIDSRISQIRQQIGDTSSDYDKEKLQERLAKLSGGVAVIKVGAGSEVEMKEKKARVEDALHATRAAVEEGVVPGGGVALVRSLQAIEGLKGDNADQDVGIALLRRAVEAPLRQIVANSGDEPSVVVDKVKQGSGNFGYNAASGEYGDMIEMGILDPAKVTRSALQAASSIASLMITTEAMIADVADEKAAGGGMPDMGGMGGMGGMM

SEQ ID NO: 1930 - protein, 235 aa, Musa acuminata
RIENKINRQVTFAKRRNGLLKKAYELSVLCDAEVALIVFSNRGKLYEFCSSSSMLRTLERYQKCNYGAPETNIISRETQSSQQEYLKLKARVDGLQRSQRNLLGEDLGPLNIKELEQLERQLDASLRQIRSTRTQYMLDQLGDLQRLGTNAMWSLIKPWKIRLEESSEADQQQLWDPNTHAVAYGRQQPQPQGDGFFQFIDCEPTLQIGYHPDQMAIAAAAAAAPGPSYMPGWLA

SEQ ID NO: 1931 - protein, 187 aa, Ginkgo biloba
DEHGEVVAEIRRSDLEPYLGLHYPATDISQASRFLFMQNRVRMICDCCATPVKVIQDEELRQPLCLVGSTLRAPHGCHAQYMANMGSIASLVMAVIINGTDEEGLSGRNSMKLWGLVVCHHTSPRAVPFPLRYACEFLMQAFGLRLNMELQLGAQLHEKHILRTQTLLCDMLLRDAPIGIVTQSPSI

SEQ ID NO: 1932 - protein, 466 aa, Unknown
  Hedyosmum sp. SM-2000
SGKPFYAIIHRVTASFIIDFEPVKPYEVPMTAAGALQSCKLAAKAISRLQSLPGGSMERLCETVVQEVFELTGYDRVMAYKFHEDDHGEVFSEITKPGLEPYLGLHYPATDIPQAARFLFMKNKVRMICDCHAKPVKVFQDEKLTFDLTLCGSTLRAPHSCHLQYMANMSSIASLVMAVVVNEGEDEGENVDSGQQQQQKRKRLWGLVVCHNTTPRFVPFPLRYACEFLIQVFAIHVNKEIELESQIREKNIFRTQTLLCDTLMRDAPLGIISQNPNILDLVKCDGAALLYKSKVWRLGLTPNEPQIHDISLWLSEYHMDSTGFSTDSLHEAGYQGAVALGNIVCGMAAVWITSKDMLFWFRSHTAAEVRWGGAKHDPDDTDDNRRMHPRSSFKAFLEVVKKRSIPWKDYEMDAIHSLQIILRGNFSDSEKTHANTTFDSRLNDLKLEGMEELQAVTNEMVRLIET

SEQ ID NO: 1933 - protein, 493 aa, Arabidopsis thaliana
MVLSKTVSESDVSIHSTFASRYVRNSLPRFEMPENSIPKEAAYQIINDELMLDGNPRLNLASFVTTWMEPECDKLMMESINKNYVDMDEYPVTTELQNRCVNMIARLFNAPLGDGEAAVGVGTVGSSEAIMLAGLAFKRQWQNKRKAQGLPYDKPNIVTGANVQVCWEKFARYFEVELKEVNLREDYYVMDPVKAVEMVDENTICVAAILGSTLTGEFEDVKLLNDLLVEKNKQTGWDTPIHVDAASGGFIAPFLYPELEWDFRLPLVKSINVSGHKYGLVYAGIGWVVWRTKTDLPDELIFHINYLGADQPTFTLNFSKGSSQVIAQYYQLIRLGFEGYRNVMDNCRENMMVLRQGLEKTGRFKIVSKENGVPLVAFSLKDSSRHNEFEVAHTLRRFGWIVPAYTMPADAQHVTVLRVVIREDFSRTLAERLVADFEKVLHELDTLPARVHAKMANGKVNGVKKTPEETQREVTAYWKKLLETKKTNKNTIC

SEQ ID NO: 1934 - protein, 245 aa, Unknown
  Petunia x hybrida
MGRGRVELKRIENKINRQVTFAKRRNGLLKKAYELSVLCDAEVALIIFSNRGKLYEFCSTSSMTKTIEKYQRCSYATLEANQSATDNQNNYHEYLRLKARVELLQRSQRNLLGEDLGTLSTKDLEQLENQLESSLKQIRSRKTQFMLDQLADLQQREQMLAESNKQLRQKLEESVAGIPHRLCWEDGLQAMQHNSRLPQTEGFFQPLGLNSSNSPQFGYNPAGTDVENAAATTHNMNGFIHGWML

SEQ ID NO: 1935 - protein, 188 aa, Arabidopsis thaliana
MTNYGAIPTSSHASPLVDVESLSRAKHRIKAGLATRRAWRVMFDFHSMGLPHGVSDAFTRIKTNLAYFRMNYAIVVLIVIFFSLIWHPTSLIVFTVLVVVWIFLYFLRDEPIKLFRFQIDDRTVLIVLSVLTVVLLLLTNATFNIVGALVTGAVLVLIHSVVRKTEDLFSFEEAATTETSGLTSYPST

SEQ ID NO: 1936 - protein, 394 aa, Arabidopsis thaliana
MKRYIGVGEEEEVQLFYYFIKSERNPQEDPLLLWLSGGPGCSSISGLLYENGPVNVKIEVYNGTLPSLVSTTYSWTKVSSIIYLDQPVGTGFSYSRTKLVNKPSDSGEAKRIHEFLHKWLGKHQEFSSNPFYVGGDSYCGMVIPALVQEISKGNYVCCKPPINLQGYILGNPSTENEVDINYRIPYAHGMALISDELYESMKRICKGKYENVDPRNTKCLKLVGEYQKCTKRINKALIITPECVDTSPDCYMYRYLLTTYWANDENVQRALHVNKGSIGEWVRCYFEIPYNHDIKSSVPYHMNNSIDGYASLIFSGDHDMEVPYLGTQAWIRSLNYSLIDDWRPWMIGDQIAGYTRTYANKMAFATIKGGGHTPEYKPEESYIMFQRWISGQPL

SEQ ID NO: 1937 - protein, 468 aa, Geobacillus kaustophilus
MNVIQRWAAALLLFAAPFLAWSPPAEAAPASTKVLEEVRELVRQYYVEPVSDRVLKASTPQDIVKQLDPYSAYMTKQEYEEFLKWIDMESVGIGVMVEEDEDGVHILSVLDNGPAARAGLQPGDVIRAVDGQPVTNETMEKVLSLIAGEEGTTVAVTVWRPSTEETVSVTIKREKIDWPNVEFKRLAGNIGYIQLYSFDETAPGEIERAIRSLSGVKGWIFDLRDNQGGYVETAQKIAGFFPNVKQAFQLRDRSNHPEVYAAVKQPVQMTGPIRLLVNASSASASEMLAAAVKEQKAAVLYGQRTFGKGSMQEMFELSDGSMLKLTVAHFFSPKGTPIHNVGVKPDVPTVVGKELYAAHRDLLIGQLKGYQSLGKLRNAPVDKTFVVRFSRPLANTAVSGVKLYQLGGQEVAVTAQIRRGTELLIKPAAKLAKGQSYLLVIPPVLKSKDGVAMKKGAYMEIQTAASTK

SEQ ID NO: 1938 - protein, 397 aa, Unknown
  Hedyosmum sp. SM-2000
DLEPVNPAEVPVIAAGALKSYKLAAKAISKLRSLPSGNISLLCDVLVREVSELTGYDRVMAYKFHEDEHGEVIAECRRSDLEPYLGLHYPATDIPQASRFLFMKNKVRMICDCSAPPVKVIQDKRLGQPLSLCGSTLRAPHGCHAQYMTNMGSIASLVMSITINEDDEETDNEQQLQQEKPKKLWGLVVCHHTSPRFIPFPLRYACEFLIQVFGIQLNKEVELAAQVREKHTLKTQTVLCDMLLRDAPMGILTQSPNVMDLVKCDGAALNYKNQFWLLGTTPTEAQIKDLAEWLLECHDGTTGLSTDSLTEAGYPGSYVLGDAVRGMAAVKITSKDFLFWFRSHSAKEIKWGGAKHDPIDKDDDGRKMHPRSSFKAFLEVVRQRSVPWEDIEMDAIQ

SEQ ID NO: 1939 - protein, 442 aa, Arabidopsis thaliana
MVDSDPVEFPPENRRGQLFGKYEVGKLVGCGAFAKVYHGRSTATGQSVAIKVVSKQRLQKGGLNGNIQREIAIMHRLRHPSIVRLFEVLATKSKIFFVMEFAKGGELFAKVSKGRFCEDLSRRYFQQLISAVGYCHSRGIFHRDLKPENLLLDEKLDLKISDFGLSALTDQIRPDGLLHTLCGTPAYVAPEVLAKKGYDGAKIDIWSCGIILFVLNAGYLPFNDHNLMVMYRKIYKGEFRIPKWTSPDLRRLLTRLLDTNPQTRITIEEIIHDPWFKQGYDDRMSKFHLEDSDMKLPADETDSEMGARRMNAFDIISGSPGFNLSGLFGDARKYDRVERFVSAWTAERVVERLEEIVSAENLTVAKKETWGMKIEGQKGNFAMVVEINQLTDELVMIEVRKRQRAAASGRDLWTDTLRPFFVELVHESDQTDPEPTQVHTTS

SEQ ID NO: 1940 - protein, 465 aa, Heuchera canadensis
SGKPFYAIVHRVTGSLIIDFEPVKPYEVPMTAAGALQSYKLAAKAITRLQALPSGSVERLCDTMVQEVFELTGYDRVMAYKFHDDDHGEVVSEITKPGLEPYLGLHYPATDIPQAARFLFMKNKIRMICDCRAKHVKVLQDEKLPFDLTLCGSTLRAPHSCHLQYMENMNSIASLVMAVVVNDGDDESESSNPAQPSKRKRLWGLVVCHNTTPRFVPFPLRYACEFLAQVFAIHVSKELELENQILEKNILRTQTLLCDMLMRDAPLGIVSQSPNIMDLVKCDGAALLYKDKIWRLGVVPTDSQLQDIASWLSKYHMDSTGLSTDSLYDAGFSRALSLGDVVCGMAAVKINSNDILFWFRSHTAAEIRWGGAKHETGEKDDNRKMHPRSSFKAFLEVVKTRSLPWKDYEMDAIHSLQLILRNTFKDIETVDANTNKIHTKLSDLKIEGMQELEAVTSEMVRLIET

SEQ ID NO: 1941 - protein, 408 aa, Rickettsia rickettsii
MATKLIKHGSKAREQMLEGIDILADAVKVTLGPKGRNVLIEQSFGSPKITKDGVTVAKSIELKDKIRNAGAQLLKSAATKAAEVAGDGTTTATVLARALAREGNKLVAAGYNPMDLKRGMDLAVNAVVEEIKKSSKKINSQEEIAQVGTISSNGDKEIGEKIAKAMEEVGKEGVITVEEAKNFSFDVEVVKGMMFDRGYLSPYFVTNSEKMVAELENPFILLFEKKLSNLQPMLPILEAVVQSQRPLLIIAEDVEGEALATLVVNRLRGGLKVAAVKAPGFGDRRKAMMEDIAILTKGELITEDLGMKLENVSIKSLGTAKRVTISKENTVIVDGNGDKKNIEDRVLQIKSQIAETTSDYDKEKLQERLAKLSGGVAVLKVGGATEVEVKERKDRVEDALAATRAAVE

SEQ ID NO: 1942 - protein, 193 aa, Zea mays
MSKYGTIPTSSSAGGGPVPLGGASPLDFISRAKARGASALATRRPWRELVDVHAVGLPPSLGDAYLRVRANLAHFAMNYAIVVLVVVFLSLLWHPVSLIVFLVCMLAWLVLYFLRDEPLVLFGRVVADGYVLAVLAVVTLVLLLLTDATANILSSLLIGLVLVLVHAALHKAEDNAADEADRWYAPVSQQPSH

SEQ ID NO: 1943 - protein, 252 aa, Gnetum parvifolium
MGRGRVQLRRIENKINRQVTFSKRRNGLLKKAYELSVLCDAEVALIIFSTRGKLYEFASSSMSKTLERYEKCSYSMQENASTDRDAQNWHHEVTKLKAKLESLHKAQRNLMGEDLGPLNIKELQSLEQQLEVALGHVRNRKTQLLIQTIDELRDKERTLQEVNKSLQKKLSETEGRNVIPALPHATTGSGEWESSTLTTTYALQTQQPSGIHHVDCEPTLHIGPYHQAVHHEAIPGPPATHSEPHNQYIWWV

SEQ ID NO: 1944 - protein, 247 aa, Oryza sativa
MAVEAVLEASRSSSEEEAEVIVTHGGGGGGGGGGGQVEGWGKRKRSRRRRPQLPPSEEEYLALCLLMLARGRRDGDDVAASASAAAAAVEHRCSVCGKAFASYQALGGHKASHRKPPPPAMVDDDEVVVETKPAAIATPSSSASGVSGGGGGRAHECNVCGKAFPTGQALGGHKRCHYDGTIGSAAGAGASKPAAKTTVAVAASRGFDLNLPALPDVAAAADQRCAAEDDEVLSPLAFKKPRLMIPA

SEQ ID NO: 1945 - protein, 404 aa, Salmonella enterica
MSPIEKSSKLENVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVNIAREHNLIIFADEIYDKILYDDAEHHSIAALAPDLLTITFNGLSKTYRVAGFRQGWMVLNGPKKHAKGYIEGLEMLASMRLCANVPAQHAIQTALGGYQSISEFILPGGRLYEQRNRAWELINDIPGVSCVKPRGALYMFPRIDAKRFNIHDDQKMVLDFLLQEKVLLVQGTAFNWPWPDHFRIVTLPREDDLEMAINRFGRFLSGYHQ

SEQ ID NO: 1946 - protein, 371 aa, Candida albicans
MSSVASKKIITFEGHRNFRLRLVLATLSGKPIKITKIRSQDLNPGLKDHEVSFLRLLEAVTNGSHIEISYTGTTIIYRPGIIIGGDLTHNCPDTKSIGYFIEPMLMLAPFSKKKFSIIFKGLTNIAGNDTGVDAIKWGLLPVMEKFGVREVSLHILKRGSAPLGGGEVHLLCSSLIPQPLTIHALDIPKFSAIRGVAYCTRVSPSIVNRMIDSARAVLKPPGCEVNITADVWRGENSGKSPGFGITLVAESKRGWRIVTENVGSAGSLPEDSGELTAYQLLEEISNSGVVGRYQLPLALVYMTIGKEDIGRLKLQKSEIDENLVSVLRDIQEVFGTEAFFKDDAEELDSDDKFMTVSIKGVGFTNVSKKIA

SEQ ID NO: 1947 - protein, 668 aa, Vibrio parahaemolyticus
MNCRSKVTLIAASLWLAASAQALEAKLHKDDLPVLAPEVQHETASKRVTSRFTRSHYKHFNLNDDFSKAIFERYVEMLDYNRNIFTQADIDSFKDWSIELDDQLKAGNNKIAFDVYNLSMQKRFERFAYAMTLLDKEIKFDNADEIELDRSEAAWPKDEAELNELWRKRVKYDALNLKLTGKEWPEIKEVLEKRYNNAMKRITQTNNEDAFQLYMNAFARQVDPHTSYLSPRNAEQFQSEMNLSLEGIGAVLQLTDDYTVIRSLVAGGPASKSKQLGEGDRIIGVGQDGEEIVDIIGWRLDDVVQLIKGPKGTKVNLQILPEGAGAKSYVVTIVRDKVRLEDRAVKSEIIEKDGKKIGVLEVPSFYVGLSQDTDKLLNDLKAKNVDGIIVDLRNNGGGALTEATALTGLFIKEGPVVQVRDSYGRIKVNADTDGLVSYDGPLTVLINRYSASASEIFAAAMQDYNRAVILGENSFGKGTVQQHRSLNHIYDLFDKELGYVQYTIQKFYRIDGGSTQNRGVAPDIAYPTPIDPSETGESVEDNALPWDSIDKATYQTFPDNDKLIANLTELHNKRIADEMEFRFINEDIEKYRKEKDDNMLSLNEKVRKDESDKAEALRLKRINERQTALGKKTFKSLDDVPKDYEAPDVYLDESVAIMVDMLKAPKQS

SEQ ID NO: 1948 - protein, 672 aa, Bordetella bronchiseptica
MHPYRNLLEPYDFGFLALRNRMVMGAMHTRIETLDQPVARLAQFFRERARGEVGLILTGGFAPDQAGRMEDDAPVLEHAGQLAPHQAITQAVHEEGGRIVLQILHAGRYAKHPLCVGPTAQRAPINPHVPRAMTPEDIARTVRAIAHTASLARQAGYDGVEIMGSEGYLLNEFASARTNTRDDAYGGSFDNRIRLPIETVRAVRAAAGPDFLLIYRISAIDLVEDGMTGAESAQLARRLQEAGVDMLNTGIGWHESAIPTIAASVPRAGWEFAVRNIKDAVSIPVIASNRINTPEVGERLLADGAADFVSMARPLLADPEFAAKTRLGQPERINSCIACNQACLDRIFTERTASCLVNPRAGRELDYPRGRAATPRRIAVAGGGAAGMAFAVYAAERGHAVTLYEAADTLGGLLNLARRIPGKREFDETLRYFHGRLAELDIAVRLGTRVTADQLRQAQYEAVVVATGVTPRLPAIDGLDHPKVAFYDEVLSGRREIGQRVAIIGTGGIAFDTAEFLLGDAAESQSPERFQRHWGIDASLRQPGGLADPALPPPRRLIHMLQRGHDKPGARLGKSTGWILKSRLRRAGVRMITGVTYHGVSDAGLAYACDGVAHVLPVDDVIVCAGQLALDELSQALAGSGMRVAAIGGARHAAELDAARAIEEALQLAHAF

SEQ ID NO: 1949 - protein, 245 aa, Houttuynia cordata
MGRGRVQMKRIENKINRQVTFSKRRMGLLKKAHEISVLCDADVALIVFSTKGKLYEYATDSSMTKILERYERYSFAEREFALADNESEGAWSLEFGKLKARVEALQKTHRHYLGEDLDSLKVKELQHLEQQLDSALKHVRLRKNQVIQETISELQKKEKALQEQNNMLEKKVQEKQKAKAQQTRWENQSQNQNSAPFLFSLPLPNLNMGTYHQENGTEIREQEAARPLAHSNSQMPAWMLRHASE

SEQ ID NO: 1950 - protein, 148 aa, Triticum aestivum
IRVKDKDASLSFYQDVMGMKLKRTSESPNAGFNLYFLGYGVDAPETTANGVNPVSDSEGLLELTWNYGTEKDAEFKYHNGNDEPQGFGHICIAVDDLDAACARFEEKKVNWKKRLTDGRMKNIAFVLDPDNYWIEVVQNEKLKTRSNW

SEQ ID NO: 1951 - protein, 446 aa, Thermotoga maritima
MNVKKFPEGFLWGVATASYQIEGSPLADGAGMSIWHTFSHTPGNVKNGDTGDVACDHYNRWKEDIEIIEKLGVKAYRFSISWPRILPEGTGRVNQKGLDFYNRIIDTLLEKGITPFVTIYHWDLPFALQLKGGWANREIADWFAEYSRVLFENFGDRVKNWITLNEPWVVAIVGHLYGVHAPGMRDIYVAFRAVHNLLRAHARAVKVFRETVKDGKIGIVFNNGYFEPASEKEEDIRAVRFMHQFNNYPLFLNPIYRGDYPELVLEFAREYLPENYKDDMSEIQEKIDFVGLNYYSGHLVKFDPDAPAKVSFVERDLPKTAMGWEIVPEGIYWILKKVKEEYNPPEVYITENGAAFDDVVSEDGRVHDQNRIDYLKAHIGQAWKAIQEGVPLKGYFVWSLLDNFEWAEGYSKRFGIVYVDYSTQKRIVKDSGYWYSNVVKNNGLED

SEQ ID NO: 1952 - protein, 279 aa, Bacillus cereus
MKNLQSTTTLHNGVEMPWFGLGVFKVEDGPELVEAVKSAIKAGYRSIDTAAIYGNEKAVGEGIRAGIKEAGISREDLFITSKVWNSDQGYETTLAAYEESLKKLELDYLDLYLVHWPVEGKYKDTWRALETLYKEERVRAIGVSNFQIHHLQDVMKDAEIKPMINQVEYHPRLTQKELQAFCKEQGIQMEAWSPLMQGQLLDNETLQAIAEKHGKTTAQVILRWDLQNGVITIPKSTKEYRIIANADVFNFELTKEDMEKIDALNQNHRVGPDPDNFDF

SEQ ID NO: 1953 - protein, 427 aa, Oryza sativa
MSLCCKATRRSSGGLTTGHPISALPRAIKRILSSYPSLLTSLGGNLARGYKAAKPFLSIGFGRVVLGMVLVMSVSAATYTAPSSLALTEENLLFLEAWRAVDRAYYDKSFNGQSWFRYRENALRNEPMNTREETFSLLEHNCISDAAIKKMLSTLDDPFTRFLEPEKFKSLRCYLSKLFPYIFARGPEGSSVDLDIRSGSNTRHVVLKRQTVTLNPVRSRMCEIPGAKDNSKVGYIKLTTFNQNAAGSVKEALQKLRENNVKSFVLDLRNNSGGLFPEGIEIAKIWMDKGVIVYICDSQGVRDIYEADGISTVAASEPLVVLVNKGTASASEILAGALKDNKRAVIYGEPTYGKGKIQSVFALSDGSGLAVTVARYETPAHTDIDKVGVIPDRPLPASFPTDEDGFCSCLRDSNSACNLNAAQLFTR

SEQ ID NO: 1954 - protein, 170 aa, Triticum aestivum
  misc_feature (140)..(140): Xaa can be any naturally occurring amino acid
AARDPIGITSFYQGRSSTLPGAIFFASELKCLSSVCDEIIAFPPGHVYDSKTNETTRYFKPSWWDPHRQPAAPVDYRLLRTTLEKSVKKRLMAEVPFGVLLSGGLDSSLIASIAQRETLRLKAASLEQSSKLFDSKGTVXKQCRGKGKQLVGIDEDNNLSTLANYSAKPF

SEQ ID NO: 1955 - protein, 239 aa, Zea mays
MVVSVAATGPGTDAEPVSSTFFASRYVRDPLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCERPNIVTGANVQVCWEKFARYFEVELKEVKLSEGYYVMDPVRAVEMVDENTICVAAILGSTLTGEFGDVKQLNDLSTDKNKET

SEQ ID NO: 1956 - protein, 243 aa, Houttuynia cordata
MGRGRVELKRIENKINRQVTFAKRRNGLMKKAFELSVLCDAEVALIVFSSRGKLYEFCSSSGMMKTIERYQKCNYGAPEATVSTKEIQSSYQEYMKLKARVESLQRSQRNLLGEDLGPLTGKELEQLERQLDMSLKQIRSTRTQCMLDQLSDLQRREQMLSEANKALRRRLLQLDDGSQTNPHHSWDPNAHGVGYSRHPGQPQGEVIFDPLDCEPTLHIGYQPDQITIAAPGPNGNYMQGWLP

SEQ ID NO: 1957 - protein, 148 aa, Listeria monocytogenes
IMYLFSDEGTPASYREVRGSSVHAFKWINEEGKTVYVKLRWVPKAGIVNLSTEQASQIQAKEFNHASRDLYEAIENGDYPEWDLYVQVLDPKDLDSFDFNPLDATKDWFEDVFPYEHVGTMTLDRNPDNIFAETESVGFNPGVLVRGM

SEQ ID NO: 1958 - protein, 1123 aa, Solanum tuberosum
MSSSRPSQSSATSSRSKHSARIIAQTSIDAKLHADFEESGDSFDYSSSVRVTSVAGDEERPKSDKVTTAYLHQIQKGKFIQPFGSLLALDEKTLKVIAFSENAPEMLTMVSHAVPSVGEHPVLGIGTDIRTIFTGPSGAALQKALGFGEVSLLNPVLVHCKNSGKPFYAIVHRVTGSLIIDFEPVKPYEVPMTAAGALQSYKLAAKAITRLQSLPSGSMERLCDTMVQEVFELTGYDRVMGYKFHDDDHGEVVSEITKPGLEPYLGLHYPATDIPQAARFLFMKNKVRMICDCRAKHVKVVQDEKLPFDLTLCGSTLRAPHYCHLQYMENMNSVASLVMAVVVNDGDEEGESSDSSQSQKRKRLWGLVVCHNTTPRFVPFPLRYACEFLAQVFAIHVNKELELENQFLEKNILRTQTLLCDMLMRDAPLGIVSQSPNIMDLVKCDGAALLYKNKIHRLGMNPSDFQLHDIVSWLCEYHTDSTGLSTDSLYDAGFPGALALGDAVCGMAAVRISDKDWLFWYRSHTAAEVRWGGAKHEPGEKDDGRKMHPRSSFKAFLEVVKTRSIPWKDYEMDAIHSLQLILRNAFKDADAVNSNTNSIHTKLNDLRIDGMQELEAVTAEMIRLIETASVPIFAVDVDGQVNGWNTKVAELTGLPVDEAIGKHLLTLVEDSSVDTVNKMLELALQGKEERNVEFEIKAHGPSRDSSPISLIVNACASKDVRDSVVGVCFIAQDITGQKSIMDKFTRIEGDYRAIIQNPHPLIPPIFGTDQFGWCSEWNSAMTKLTGWRRDDVMDKMLLGEVFGTQAACCRLKNQEAFVNFGVILNNAITGQESEKIPFGFFGRYGKYVECLLCVSKRLDKEGAVTGLFCFLQLASHELQQALHVQRLSEQTALKRLKVLAYIRRQIKNPLSGIIFSWKMLEGTSLGEEQKNILHTSAQCQRQLNKILDDTDLDSIIEGYLDLEMLEFKLHEVLVASISQVMMKSNGKNIMISNDMVEDLLNETLYGDSPRLQQVLANFLLVSVNSTPSGGQLSISGRLTKDRIGESVQLALLEFRIRHTGGGVPEELLSQMLGSEVDASEEGIFLLVSRKLVKLMNGEVQYLREAGRSTFIISVELAVATKSC

SEQ ID NO: 1959 - protein, 148 aa, Listeria monocytogenes
IMYLFSDEGTPASYREIRGSSVHAFKWINEEGKTVYVKLRWVPKAGIVNLSTEQASQIQAKEFNHASRDLYEAIENGDYPEWDLYVQVLDPKDLDSFDFNPLDATKDWFEDVFPYEHVGTMTLDRNPDNIFAETESVGFNPGVLVRGM

SEQ ID NO: 1960 - protein, 229 aa, Arabidopsis thaliana
MGQQSLIYSFVARGTVILAEYTEFKGNFTSVAAQCLQKLPSSNNKFTYNCDGHTFNYLADNGFTYCVVVIESAGRQIPMAFLERVKEDFNKRYGGGKASTAKANSLNKEFGSKLKEHMQYCADHPEEISKLSKVKAQVTEVKGVMMENIEKVLDRGEKIELLVDKTENLRSQVNNNHISNTAQDFRTQGTKMKRKLWFENMKIKLIVFGIIVALILIIILSVCHGFKCT

SEQ ID NO: 1961 - protein, 513 aa, Hordeum vulgare
MDGNNRGGGHSEVLKNYNLGKTLGLGTFGDVKVAEHKLTGQRVAIKILNRRKMETMEMEEKANREIKIMRLFIDFIHPHIIRVYQVIETPKDIFIVMEYCNNGELLDYIIENGRLQEDEARRIFQQILAGVEYCHRIMVVHRDLKPENLLLDSKYNVKLADFGLSNVMRDGHFLKTSCGSLNYAAPEIISSKLYAGPEVDVWSCGVILYALLCGSVPFDDDNIPSLFRKIKGGTYILPSYLSDSARDLIPKLLNIDPMKRITIHEIRVHPWFKNHLPCYLAVPPPYKAPKAKMIDEDILRDVVNLGYDKDHVCESLWNRLQNEETVAYYLLLDNRFRSTSGYLGADHQHLMDRSFNEFTLSESASPSTRNYLPGINDSQGGGLRPYYPVQRKWAIGLQSGAHPRDIMIEVLKALKELNVCWKKNGLYNMKCRWCPGFPQVSAMLLDSNHNFVDDSTIMDNGNADGRLPAVVKFEIQLYKTKDNKYLLDIQRVTGPQLLFLEFCGAFFTNLRVL

SEQ ID NO: 1962 - protein, 468 aa, Streptococcus mutans
MSKTLPKDFIFGGATAAYQAEGATHADGKGPVAWDKYLEDNYWYTAEPASDFYHQYPVDLKLAEEFGVNGIRISIAWSRIFPKGYGAVNPKGLAFYHNLFAECHKRHVEPFVTLHHFDTPEALHSNGDFLNRENIEHFVNYAEFCFKEFPEVNYWTTFNEIGPIGDGQYLVGKFPPGIQYDLAKVFQSHHNMMVAHSKAVKLFKDGGYSGEIGVVHALPTKYPYDPNNPADIRAAELEDIIHNKFILDATYLGKYSEKTMEGVNHILAVNGGQLDLREEDFAALEAAKDLNDFLGINYYMSDWMRAFDGETEITHNAKGEKGSSKYQIKGVGRREAPVNVPKTDWDWIIYPQGLYDQIMRVKQDYPNYKKIYITENGLGYKDEFVNHTVYDDARIDYVKKHLEVLSDAIADGANVKGYFIWSLMDVFSWSNGYEKRYGLFYVDFDTQERYPKKSAYWYKKLAETQIID

SEQ ID NO: 1963 - protein, 435 aa, Heuchera canadensis
SGKPFYAIIHRIDVGLVIDLEPVNPADVPITAAGALKSYKLAAKAISRLQSLPNGNITLLCDVLVKEVSDLTGYDRVMVYKFHEDEHGEVIAESCRPDLEPYLGLHYPATDIPQASRFLFMKNKVRMICDCLASSVKVIQDKRLPQPLSLCGSTLRSPHGCHTQYMANMGTIASLVMSVTINEEDDEMVTDQPKGRKLWGLVVCHHTSPRFVPFPLRYACEFLIQVFGVCINKEVELASQTREKHILQTQTVLCDMLLRNAPVGIVTQSPNVMDLVKCDGAALYYKKKAWLLGSTPTDAQIRDITDWLLEYHGGSTGLSTDSLVEAGYPDALNLGDAVCGMAAIKITSNDFLFWFRSHTAREIKWGGAKHDPDEKDDGRKMHPRSSFKAFLEVVKRRSLPWEDVEMDVIHSLQLILRGSLQDETVDDSKTIVNES

SEQ ID NO: 1964 - protein, 513 aa, Hordeum vulgare
MDGNNRGGGHSEVLKNYNLGKTLGLGTFGDVKVAERNVTGQRVAIKILNRRKMETMEMEEKANREIKIMRLFIDFIHPHIIRVYEVIETPKDIFVVMEYCNNGELLDYIIENGRLQEDEARRIFQQILAGVEYCHRIMVVHRDLKPENLLLDSRYNVKLADFGLSNVMRDGHFLKTSCGSLNYAAPEIISSKLYAGPEVDVWSCGVVLYALLCGSVPFDDDNIPSLFRKIKGGTYILPSYLSDSARDLIPKLLNIDPMKRITFHEIRVHPWFKNHLPCYLAVPPPYKEQQAKMIDEDILREVVNLGYDKDHVCESLWNRLQNEETVAYYLLLDDRFRSTSGYLGADHQHLMDRSFNEFTLSESASPSTRNYLPGINDSQGGGLRPYYPVQRKWAIGLQSGAHPRDIMIEVLKALKELNVCWKKNGLYNMKCRWCPGFPQVSDMLLDSNHNFVDDSTIMDNGNADGRLPAVVKFEIQLYKTKDNKYLLDIQRVTGPQLLFLEFCGAFLTNLRVL

SEQ ID NO: 1965 - protein, 366 aa, Unknown
  Chlamydomonas sp. W80
MMATAGSSAAGARVSMRAASGIRASSSSRRAAVVVKAANVNIGDSLAEFLAVATPDTKLRQLMTSMSEATRTIAHKVRTASCGGTACVNSFGDEQLAVDMVADGILFEALKYSHVCSYACSEEVPEPVAMGGSGYSVAFDPLDGSSIVDTNFSVGTIFGVWPGDKLTGITGRDQAAAGMGVYGPRTVFVIAINGFPGTHEFLLQDDGKWLLVKSTEEIGEGKLFAPGNLRAIFDNPEYSKLVSYYLEEQYTLRYTGGMVPDVFQILVKEKGVFTNVTSPSTKAKLRLLFEVAPLALLIENAGGASSCDGLVCRALDVEVTAHEQRTQICYGSKGEVARFEKYMLGESSASLTLSRPSKRPCAERAR

SEQ ID NO: 1966 - protein, 578 aa, Houttuynia cordata
  misc_feature (481)..(481): Xaa can be any naturally occurring amino acid
  misc_feature (504)..(504): Xaa can be any naturally occurring amino acid
  misc_feature (574)..(574): Xaa can be any naturally occurring amino acid
SGKPFYAIVHRVTGSLIIDFEPVKPFEVPMTAAGALQSYKLAAKAISRLQSLPSGSMERLIDTMVQEVFELTGYDRVMAYKFHEDDHGEVISEVTIPHLDPYLGLHYPATDIPQAARFLFMKNKVRMICDCRAKPVKVYQDDKLSFDLTLCGSTLRAPHSCHLQYMENMGSIASLVMAVVVNEGGEEDRGGPADSSQQQLGRYRRKKLWGLVVCHNTRPRFVPFPLRYACEFLTQVFAIHVSKELELEETNSRKEILRTQTLLCDMLLRDAPMGIVNQTPNIMDLIKCDGAALFYKDKVFRLGIAPSETDIREIAQWLSAYHMDSTGLSTDSLHDAGYPKAAFLGDLVCGMAAVKITCSDMLFWFRTHTAAEIRWGGAKHDHSDRDDGKRMHPRSSFRAFLDVVKTRSLPWKDYEMDGIHSLQLILRTSVKEPEQVDSNKVIHAQLGDLKLDEMNELHAVTTEVVRLIETATVPILAVDVXGLINGWNAKISELTGMSLEQVMXKHLLTLVEDCSINVVRRMLCLALKGEEEQNIEFQVKTHGTRSDHGPVVLVVNACASRDVHGNVVGVCFVXQDVT

SEQ ID NO: 1967 - protein, 418 aa, Glycine max
QIEYDEEKQTSKDRWGGLAYDTSDDQQDITRGKGMVDTLFQAPMESGTHYAVMSSYDYISAGLRQYNLDNTMDGFYIAPAFMDKIVVHITKNFLNLPNIKVPLILGIWGGKGQGKSFQCELVFAKMGINPIVMSAGELESGNAGEPAKLIRQRYREAADIIRKGKMCCLFINDLDAGAGRLGGTTQYTVNNQMVNATLMNIADNPTNVQLPGMYNKEENPRVPIIVTGNDFSTLYAPLIRDGRMEKFYWAPTRDDRIGVCQGIFRTDGVLKEDIIKLVDTFLGQSIDFFGALRARVYDDEVRKWISGVGVENIGKKLVNSKEGPPTFEQPKMTLSKLLEYGNMLVQEQENVKRVQLADKYLNEAALGDANDDAIKTGNFYGQGAQQVHVPVPEGCTDPTAENYDPTARSDDGSCTYKF

SEQ ID NO: 1968 - protein, 140 aa, Glycine max
  misc_feature (54)..(54): Xaa can be any naturally occurring amino acid
  misc_feature (69)..(69): Xaa can be any naturally occurring amino acid
  misc_feature (86)..(86): Xaa can be any naturally occurring amino acid
LPLPANLFPPLRLLNTIRLHPSALEISPLDYSPADHPVPKLTVVLDLDENTGMXAYETSGLPTALRTHXIERGLNWCELECVSMDXGRRTLINHLCDSMLNPALNELLEQLSEFADMVLITAGLVRYARHHVDRVDVKNR

SEQ ID NO: 1969 - protein, 415 aa, Hypecoum imberbe
SGKPFYAIVHRVTGSLIVDFEPVKPYEVPMTAAGALQSYKLAAKAIAKLQSLPSGSMERLCNTVVQEVFELTGYDRVMAYYFHEDDHGEVIAEVTKPGLEPYLGLHYPATYIPQAARFLFMKNRIRMICDCRAKHVKVLQDEKLPADLTLCGSTLRAPHTCHLQYMENMGSIASLVMAVVVNESNDEEESSEPPSQAPKKKKLWGLVVCHNTSPRFVPFPLRYACEFLIQVFAVHVNKEFELDNQIHEKRILRTQTLLCDMLMRDAPFGIISQSPNVMDLVKCDGAALLYKNKIYRLGLTPSEFQINDIASWLTEYHMDSTGLSTDSLYDAGFPGALSLGDAVCGMAAVRITCKDMLFWFRSHTAAEVRWGGAKHDPDERDDGRKMHPRSSFKAFLEVVKTRSLPWKDYEMDAIH

SEQ ID NO: 1970 - protein, 492 aa, Manihot esculenta
MDPCKFRPSSSNNTPFWTTDAGAPVWNNNSSMTVGTRGPILLEDYHMIEKLANFTRERIPERVVHARGMSAKGFFEVTHDVSHLTCADFLRAPGVQTPVIVRFSTVIHERGSPETLRDPRGFATKFYTREGNFDIVGNNFPVFFIRDGIKFPDVIHAFKPNPKSHIQEYWRIFDFLSHHPESLSTFAWFFDDVGIPQDYRHMEGFGVHTFTFINKAGKVTYVKFHWKPTCGVKCLMDDEALKIGGANHSHATQDLYDSIAAGNYPEWRLFIQTMDPADEDKFDFDPLDMTKIWPEDIFPLQQIGRLVLNRNIDNWFAENEMLAFDPGHIVPGIHYSNDKLFQLRTFAYADTQRHRLGPNYKMLPVNAPKCAYHNNHYDGFMNFMHRDEEVDYFPSRYDPVRHAERSPIPNAICSGRREKCVIEKENNFKQPGERYRSWAPDRQERFLCRLVNALSEPRITFEIRSIWVSYWSKCDASLGQKLASRLNVRPNI

SEQ ID NO: 1971 - protein, 392 aa, Hypecoum imberbe
DLEPVNPSDVPITAAGALKSYKLAAKAISRLQSLPSGNIPLLCDVLAREVRELTGYDRVMVYKFHEDEHGEVIAECRELDLEPYLGLHYPATDIPQASRFLFLKNKVRMICDCSAQPVKVIQDEKLAQPLSLCGSTLRAPHGCHSQYMTNMGSVASLVMSLTINEDDDEMETSTQKGRKLWGLVVCHHTSPRFVPYPLRYACEFLIQVFGIQLNKEVELASQLMEKHILKMQTVLCDMLLRDAPVGIVAQSHNVMDLVKCDGAALYYRNKLWLLGVTPTEAQVRDIARWLLECHYGTTGLSTDSLMEAGYPGASGLGDAVCGTAAISITSKDFLFWFRSQTAKEIKWGGAKHDPMDKDGLRKMHPRSSFKAFLEVVKCRSVPWEDIEMDAIQ

SEQ ID NO: 1972 - protein, 672 aa, Salmonella enterica
MSYPSLFAPLDLGFTTLRNRVLMGSMHTGLEEHPDGAERLAAFYAERARHGVALIVTGGIAPVPSGVVMTGGAMLNDASQLKPHRVVTDAVHAQGGKIALQILHTGRYSYQPHLVAPSAIQAPINRFMPHELTHDEILQLIDDFAHCAQLAREAGYDGVEVMGSEGYLINEFLTRRTNHRDDEWGGDYTSRMRFAVEVVRAVRQRVGNDFIIIYRLSMLDLVENGGTFDETVQLAQAIEAAGASLINTGIGWHEARIPTIATPVPRGAFSWVTRKLKGHVSVPLIATNRINDPQVAETILTRGDADMVSMARPFLADAEFLTKAQSGRADEINTCIGCNQACLDRIFIGKVTSCLVNPRACHETHMPITPAIRKKNLAVVGAGPAGLAFAINAASRGHHVTLFDAQSEIGGQFTIARQIPGKEEFYETLRYYRRMIDITGVTLKLNQRVNAEDLQPFDEAILACGIVPRRPPIDGIDHPKTLTYLEVLRDKAPVGKRVAIIGCGGIGFDTAMYLSQHGESTSQNIAEFCTEWGIDTSLQQAGGLRPEGPRLARSPRQIVMLQRKASKPGEGLGKTTGWIHRATLLARGVKMIPAVSYQKIDDDGLHLLIGGEPQLLEVDHVVICAGQEPRRELADPLRAAGKTVHLIGGCDVAMELDARQAIAQGTRLALEI

SEQ ID NO: 1973 - protein, 459 aa, Illicium oligandrum
SGKPFYAIMHRIDVGLVIDLEPVNPADVPITAAGALKSYKLAAKAISRLQSLPSGNIGILCDVLVREVSELTGYDRVMAYKFHEDEHGEVIAEYRRTDLEPYLGLHYPATDIPQASRFLFMKNKVRMICDCYAPPVKVIQDKKLAQPLSLGGSTLRAPHGCHAQYMANMGSIASLVMSVTINEDYDETSSNQQKGRKLWGLVVCHHTSPRFVPFPLRYACEFLLQVCGIQLNKEVELVAQMKEKHILKTQTLLCDMLLRDAPIGIMTKSPNVMDLVKCDGAALYYGKQLWLLGITPTEAQIRDITEWLLECHDSTTGLSTDSLMEAGYPGATTLGDTVCGMAAIKVASKDFLFWFRSHTAKEIKWGGSKHDPADKDGKKMHPRSSFKAFLEVVKRRSLPWEDVEMDAIHSLQLILRGSLQQVLESETKAIVDARLDDEQIQGPDELRIVTNEMVRLIET

SEQ ID NO: 1974 - protein, 684 aa, Desulfitobacterium hafniense
MENQQTNQKSLDLDAARVSHNKGYLTTNQGVGVSNTDDSLKAGKRGPTLMEDFIFREKVTHFDHERIPERVVHARGSGAHGYFQVYENLSHLTKAHFLSDPNLITPVFVRFSTVAGFRGSSDTVRDVRGFAVKFYTQEGNYDIVGNNMPVFFIQDAIKFPDLIHSLKPEPNNEMPQAASAHDTFWDFVVNTPETMHNVMWLMSPRAVPKSFRMMEGFGINTFRLVNAKGEFKFVKFHWKPVLGVHSLVWDEAQKVAGKDPDFNRRDLWETIEHGQAVEFELGIQVLKPEDEFRFDFDILDPTKLWPEELIPVQKIGKMTLNQNPDNFFAETEQVAFCPANVVPGIDFSNDPLLQGRLFSYLDTQLSRLGGPNFHQLPINRPLPKVNNNQRDGMHRMTIDEGQTSYYPNSLNKGEPHAARAGESHFEHYQEKVDGHVIRERSESFRDHYTQPAMFWNSMSDWERQHIIDAFRFELGKCKHKHTHQKLVDMLGNVDPELAQKVAEGLGATPPANGANPTTASSPALSMANTAKSPKTRKVAVLLESGFDKAQFDALTATLIAAGACFDVVSCKLGPVTAGDNGRVEGNQTYATTASVFYDAVYIPGGSHTEALKGSADVKGFLLDTFNHYKTIGLSGEASALLGLLPSGQKPAPGIVCESAGNMEIYANNFLAALTTGRHFERNVH

SEQ ID NO: 1975 - protein, 505 aa, Methanosarcina barkeri
MGEKNSSKVLTTGFGIPVGDDQNSLTAGNRGPVLMQDVHLLDKLSHFDHERIPERVVHAKGAGAGGYFEVTADVTKYTKAKFLSEIGKRTEVFVRFSTVGGEKGSADSARDPRGFAVKFYTEDGNYDLVGNNTPVFFIRDPLKFPDFIHTQKRNPATNCKDPDMFWDFLSLTPESIHQVTILFSDRGTPATYRNMNGYSSHTYKWYNEKGEYFWVQYHFKTDQGIKNLTLEEAEKIGGSDPDHATRDLYEAIKKGDYPSWTLEMQIMTPEQAEDYRFDIRDITKVWPHGDFPTMKIGKLVLNRNPTNYFAEVEQAAFSPANLVPGIGISPDKMLQGRVFSYHDTHIHRLGPNYNLIPVNAPKYSPENSYQRDGFMRVDANGGSGPNYWPNSFGGPSPDSVYLEPPFGVSGLAARTLYTHPNDDFVQAGNLYRDVMTDYDRENLVGNIVSHLSAAQKRIQLRQTALFFKADRDYGSRVAKGLELDIKEVERLANMTNEERARATER

SEQ ID NO: 1976 - protein, 710 aa, Oryza sativa
MSASPSSMSGAGAGEAGVRTVVWFRRDLRVEDNPALAAAARAAGEVVPVYVWAPEEDGPYYPGRVSRWWLSQSLKHLDASLRRLGASRLVTRRSADAVVALIELVRSIGATHLFFNHLYDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSL

SEQ ID NO: 1977 - protein, 123 aa, Glycine max
  misc_feature (23)..(23): Xaa can be any naturally occurring amino acid
  misc_feature (45)..(45): Xaa can be any naturally occurring amino acid
  misc_feature (48)..(48): Xaa can be any naturally occurring amino acid
  misc_feature (67)..(67): Xaa can be any naturally occurring amino acid
  misc_feature (81)..(81): Xaa can be any naturally occurring amino acid
  misc_feature (87)..(87): Xaa can be any naturally occurring amino acid
  misc_feature (100)..(100): Xaa can be any naturally occurring amino acid
EARVSLLGTEFIKVATNIDPDCXMIINEKGRNAKCAMRKAFVDEXKSXLPKHILYKEHQQITDRDGXVETDSLKAHAEKPXPDRMIXNAANIFPFNTPTXRETYHYTMIIDRFFPQKSPRLTV

SEQ ID NO: 1978 - protein, 217 aa, Glycine max
MGSEGPRAITIHVTGFKKFQGVPENPTEAIVNNLKEYVERRGLPAGVTLGSCTVLDVAGDGALPQLYQTMESAISKTDSVSNANVVWLHLGVNSGAVRFAIEHQAANEATFRCPDELGWQPQQLPIVLEDGGISQTRKTSMHVDAILKSLKKGAYDVMISGNAGRFVCNYVYYHSLRFAEQKGNKSLFVHVPLFARIDQETQMRFTASLLDAIASAC

SEQ ID NO: 1979 - protein, 246 aa, Houttuynia cordata
MGRGRVELKRIENKINRQVTFAKRRNGLLKKAYELSVLCDAEVTLIIFSNSGKLYEFCSSSSMMKTLERYQKCSYSMPEATGPSRETEKSYQEYLKLKGKVEHLQRIQRNLLGEDLGPLSSKELEQLENQLEQSLRQIRSTKTQSLLDQLSDLRRKEQQLLESKKILNKKLAEHGPENPLQLSWQSCGQSNPYSSQPAHSEAFFQPLDCNPTLQIGYPSVGQEQIMAAPATAAPQNANGFIPGWLV

SEQ ID NO: 1980 - protein, 547 aa, Ralstonia metallidurans
MAAKDVVFGDAARAKMVEGVNILANAVKVTLGPKGRNVVLERSFGGPTVTKDGVSVAKEIELKDKLQNMGAQMVKEVASKTSDNAGDGTTTATVLAQSIVREGMKFVAAGMNPMDLKRGIDKAVGAAVEELKKLSKPTTTSKEIAQVGAISANSDASIGERIAEAMDKVGKEGVITVEDGKSLADELEVVEGMQFDRGYLSPYFINNPEKQVVQLDSPFVLLFDKKVSNIRDLLPVLEQVAKAGRPLLIIAEDVEGEALATLVVNNIRGILKTAAVKAPGFGDRRKAMLEDIAILTGGTVIAEEIGLTLEKATLQDLGQAKRIEIGKENTIIIDGAGDASAIEGRVKQIRAQIEEATSDYDREKLQERVAKLAGGVAVIKVGAATEVEMKEKKARVEDALHATRAAVEEGIVPGGGVALLRARAAIAGLHGENPDQNAGIKIVLRAMEEPLRQIVLNAGEEASVVVAKVIEGKGNYGYNAASGEYGDLVEMGVLDPTKVTRTALQNAASVASLMLTTDCAVAESPKEESAPAMPGGMGGMGGMEGMM

SEQ ID NO: 1981 - protein, 344 aa, Synechococcus elongatus
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREAYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 1982 - protein, 247 aa, Houttuynia cordata
MGRGRVELKRIENKINRQVTFSKRRNGLLKKAYELSVLCDAEVALIIFSNRGKLYEFCSSSSMMTTLERYQECSYSMPEATGPTRETEKSYQEYLKLKGKVELLQRTQRNLLGEDLGPLSSKELEQLENQLEHSLRQIRSTKTQALLDQLSDLRRKEQQMLESNKILKKKLAEHGPENLLQLAWQSCGQSNPYSRQPAHSEAFFQPLDCNPTLQIGYHPVGQEEITMAAPAIAPPQNVNGFIPGWMV

SEQ ID NO: 1983 - protein, 148 aa, Listeria monocytogenes
IMYLFSDEGTPASYREIRGSSVHAFKWINEEGKTVYVKLRWIPKAGIVNLSTEQASQIQAKEFNHASRDLYEAIENGDYPEWDLYVQVLDPKDLDNFDFNPLDATKDWFEDVFPYEHVGTMTLDRNPDNIFAETESVGFNPGVLVRGM

SEQ ID NO: 1984 - protein, 494 aa, Zea mays
  misc_feature (324)..(324): Xaa can be any naturally occurring amino acid
TDTFAIHKYGHGRGGKPLNSDCRHPPASHPAQPRSSAREVVRENYPVAPDHYNGAGRANAAATMPPATGAVASAAGTVLLGRYELGGLLGHGASAKVYLARDLRTGRSVAIKSFPNPRAASDRPVAIEREAGILRRLRHRHVVRLHEILATRTKVHFVLDLAAGGELLSLVDASGRMTEDLARHYFRQLVCAVRYCHARGVCHRDIKPENLLLDGAGALKVADFGLGAVAGAGGDLLRHTTCGTPAYVAPEILSRKGYEYDPAKVDIWSCGVVLFVLAAGYLPFNDASLVNMYRKIYAGRFRCPACFSPALRGLLRRVLHPDPXARADADSIVAHPWFRHGASDEEMGRQLMHGGGGDEDEEAWVGAAADEDDAGREPTAFDILSFSPGCDLSALFLGGGCKERVFVGEAAAGVLGRVEAAGRKGGYRVRKEGKRGVRVEGEEGGVVAKVSVVRLADAVSVVEVVKDDGADAALFWTELLEPAVCVPATALCHV

SEQ ID NO: 1985 - protein, 148 aa, Listeria monocytogenes
ITYLFSDEGTPASYREIRGSSVHAFKWINEEGKTVYVKLRWVPKAGIVNLSTEQASQIQAKEFNHASRDLYEAIENGDYPEWDLYVQVLDPKDLDNFDFNPLDATKDWFEDVFPYEHVGTMTLDRNPDNIFAETESVGFNPGVLVRGM

SEQ ID NO: 1986 - protein, 464 aa, Lardizabala biternata
SGKPFYAIIHRVTGSLIIDFEPVKPYEVPMNAAGALQSYKLAAKAIARLQSLPNASMDRLCDTVVQEVFELTGYDRVMAYKFHDDDHGEVVSEITKPGLELYLGLHYPATDIPQAARFLFMKNKIRMICGCNATHVKVFQDEKLPLDLTLCGSTLRAPHSCHLQYMDNMGSIASLVMAVVVNEGDEENDGSGPAQPQKRKRLWGLVVCHNTTPRFVPFPLRYACEFLIQVFAIHINKELELENQVLEKTFYVPQTLLCDMLMRNAPLGIVSQSPNIMDLVKCDGAALLYKNKIWRLGLSPSEFHIRDIASWLYEYHMDSTGLSTDSLHDAGFPGALSLGDGVCGMAAVRITSKDMIFWFRSHIATEVRWGGAKHDPSEKDDGRKMHPRSSFKAFLEVAKTRSLAWKDYEMDAIHSLQLILRNAFKDGDTADLNSSVIHSRLDNLKIDGMEELEAVTNEMVRLME

SEQ ID NO: 1987 - protein, 394 aa, Lardizabala biternata
DLEPVNRADVPVTAAGALKSYKLAAKAISKLQSLPSGNISLLCDVLVHEVSDMTGYDRVMVYKFHEDEHGEVVSECLRSDLEPYLGLHYPATDIPQASRFLFLKNKVRMICDCSARSVEIIQDKRLTQPLSLGGSTLRAHHGCHTQYMSNMGSVASLVMSITINDDDDDDETETTKRKGRKLWGLVVCHHTSPRFVPFPLRYACEFLIQVFGIQLTKEVELATQLREKHILQIQTVLCDLLLRNAPVGIFTQSPNVMDLVKCDGAALYYKNKFWLLGVTPTEAQIREIAAWILEYHDGSTGLSTDSLMEAGYPGASVLGNAVCGMAAINITSKDFIFWFRSHTAKEIKWGGAKHDPVDKDDGRKMHPRSSFRAFLEVVQWRSLLWEDIEMDAIQ

SEQ ID NO: 1988 - protein, 141 aa, Lactobacillus acidophilus
MANDMMNRRNDMMDAMNDWFGFPRNFFDDSEIENIMQSDVAETDKDYVVKIDMPGMNKDDIKLNYKDGVLSVAGTRKAFKDTNDKERNIIHKERSEGSISRSYRLPNVVANEIHAKYDNGVLTITLPKQTAGDDDNSIQID

SEQ ID NO: 1989 - protein, 466 aa, Lilium superbum
SGKPFYAIVHRVTNCLIIDFEPVNHTESPTTAAGALQSYKLAAKAIAKLQSLPGGSVRRLCETVVQEVFELTGYDRVMAYRFHEDDHGEVFTEVTKPGLEPYVGLHYPATDIPQAARFLFMKNKVRMICDCRARPVKIHQDDKLPAEITFCGSTLRAPHSCHLQYMENMNSIASLVMAVVVNDDDEVLDEQGAPSRQQSGRKKLWGLVVCHHLSPRFVPFPLRYACEFLMQVFAIHVNKEFELENQIREKNILKTQTLLCDMLLRDGDPIGIVSQSPNIMDLVKCDGAALLYNNRIWQLGMAPTGSQIHDIAFWLAESHMDSTGLSTDSLLDAGYPGALALGDTVCGMAAARITTKDIVFWFRSHTASEIKWGGEKHDPEEEDDGRRMHPRSSFNAFLQVVKNRSLPWNDYEMDAIHSSQLILRGTLDDNGKSKKGSLDSGMGDMRLDGMVELQAVTNEMVRLIIT

SEQ ID NO: 1990 - protein, 453 aa, Bacillus halodurans
MPCMTKDTVTYRFPEGFWWGSATSATQTEGATHRDGKGKNIWDHWYEVEPSRFFQGVGPQDTSQFYERYKEDIQLMKEVGHNSFRFSISWSRLIPDGRGEVNPKGVEFYNNVIDELLGQGIEPFVNLFHFDMPMELQKIGGWANREVVDAYEAYAKTCFERFGDRVKKWFTHNEPIVPVEGGYLYDFHYPNEVDFEKAIQVGYHTVLSSAKAIRAYKQLNQGGKIGIILNLTPSYPRSNHPADLKAAKIADAFFNRSFLDPSVKGEFPEELVQILKEEGFMPIIEEEDLEIIRQHTVDLLGVNYYQPRRVKAKETLPNPDAPFMPERYFDHYAMPGRKMNVHRGWEIYEKGIYDILINLKEHYGNIECFISENGMGVEGEEKFRDENGVIHDDYRIEFIQDHLKWVHRAIQEGSNVKGYHLWTFMDNWSWANAYKNRLWVGVCQFRQEWGTDN

SEQ ID NO: 1991 - protein, 394 aa, Lilium superbum
DLEPVNPDDIPVATAGALKSYKLAAKAISRLQSLPSGNISLLCDAMVREVSELTGYARVMAYKFHEDEHGEVIAECKRPDLEPYIGLHYPATDIPQASRFLFMKDKVRMICDCTAPSVRVIRDRQLLQPPSLCGSTLRAPHGCHAQYMANMGSIASLVMAVTVNEDDDETDSNNQPKARKLWGLVVCHHTSPRFVPYPLRYACEFLLQVFGIQINKEVELAAQAKEKHIFRIQTVLCDMLLRDAPIGIFKKSPNVMDLVKCDGAALYYKNQFWRLGTTPTEAQIKDIVNWLLECHDGTTGLSTDSLTEAGYPDASSLGDEVCGMATISITLKDFIFWFRSHTAKEIKWGGAKHEPTDKDDDGRKMHPRSSFKAFLEIVKLRSLPWEDMEMDAIQ

SEQ ID NO: 1992 - protein, 465 aa, Pachysandra americana
  misc_feature (232)..(232): Xaa can be any naturally occurring amino acid
SGKPFYAIVHRVTGSLIIDFEPVKPYEVPMTAAGALQSYKLAAKAIARLQSLPSGSMERLCDTMVQEVFELTGYDRVMAYKFHEDDHGEVVSEITKPGLEPYLGLHYPATDIPQAARFLFMKNKVRMICDCNAKHVKVLQDEKLPFDLTLCGSTLRAPHSCHLQYMDNMGSIASLVMAVVINEGDEDGEGSDPAQPQKRKRLWGLVVCHNTSPRFVPFPLRYACEFLAQVFXIHVNKEIGLENQILEKNILRTQTLLCDMLMRDAPLGTVSQSPNIMDLVKCDGAALLYKNKIWRLGMAPGDFQINDISSWLSEYHMDSTGLSTDSLYDAGYPGALALGDVVCGMAAVRITTKDMLFWFRSHTAGEVRWGGAKHERGEKDDGRRMHPRSSFKAFLEVVKTRSLPWKDYEMDAIHSLQLILRNAFRDVETMDLDTNTIRMQLNDLKIKGMEELEAVTNEMVRLMET

SEQ ID NO: 1993 - protein, 146 aa, Catharanthus roseus
RTLRELKLLRHMDHENVVAIRDIIPPPQRESFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 1994 - protein, 246 aa, Zea mays
  misc_feature (235)..(235): Xaa can be any naturally occurring amino acid
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYIGWGIDGSVWISSEMKGLNDDCEHFEIFPPGHLYSSKQGGFKRWYNPPWFSEVIPSVPYDPLALRKAFEKAVIKRLMTDVPFGGLLSGXLDSSLGAAVTV

SEQ ID NO: 1995 - protein, 265 aa, Triticum aestivum
  misc_feature (106)..(106): Xaa can be any naturally occurring amino acid
  misc_feature (234)..(234): Xaa can be any naturally occurring amino acid
HYRTSLYKKAGWYRSGIPGISSTHASAENSIPKETAYQMITDELMLDGNPRLDLASFVTTWMEPECNKLIMDSINKNYVDMDEYPVTTELQNRCVNMIAHLFNAPXNEDEKAIGVSTVGSSEAIMLAGLAFKRKWANKRKEEGKPYDKPNIVTGANVQVCWEKFARYFEVELKEVKLTEGYYVMDPLKAVEMVDENTICVAAILGSTLTGEYEDVKLLNDPSVGKNRETGWNVXIHVDAASGGLSLLSTSELEWDSGYIGEDIKG

SEQ ID NO: 1996 - protein, 199 aa, Arabidopsis thaliana
MVQTKKFRGVRQRHWGSWVAEIRHPLLKRRIWLGTFETAEEAARAYHEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 1997 - protein, 800 aa, Arabidopsis thaliana
RSSLTPRFTLPSRPLNTGFNAGNSTLSFFFKKHPLSRKIFAGKQSAEFDSSSQAISASEKVLVPDNLDDDPRGFSQIFDLESQTMEYTEAVRTEDQTMNVVKERGVKPRIVPPPGDGKKIYEIDPMLRTYNNHLDYRYGQYKRLREEIDKYEGGLEAFSRGYEKLGFSRSDAGITYREWAPGAKAASLIGDFNNWNSNADIMTRNEFGVWEIFLPNNTDGSPAIPHGSRVKIRMDTPSGIKDSIPAWIKFSVQAPGEIPFNGIYYDPPEEEKYVFKHPQPKRPKSLRIYEAHVGMSSTEPMVNTYANFRDDVLPRIKKLGYNAVQIMAIQEHSYYASFGYHVTNFFAPSSRCGTPEELKSLIDRAHELGLVVLMDIVHSHASKNTLDGLNMFDGTDAHYFHSGPRGYHWMWDSRLFNYGSWEVLRYLLSNARWWLEEYKFDGFRFDGVTSMMYTHHGLSVGFTGNYTEYFGLETDVDAVNYLMLVNDMIHGLYPEAITVGEDVSGMPTFCIPVQDGGVGFDYRLHMAIADKWIEMLKKRDEDWQMGDIIYTLTNRRWSEKCISYAESHDQALVGDKTIAFWLMDKDMYDFMAVDRPSTPLIDRGIALHKMIRLITMGLGGEGYLNFMGNEFGHPEWIDFPRGEQRLSDGSVIPGNNFSYDKCRRRFDLGDADYLRYRGLQEFDQAMQHLEENYGFMTSEHQFISRKDEADRVIVFERGDLVFVFNFHWTSSYFDYRIGCSKPGKYKIVLDSDDPLFGGFNRLDRKAEYFTYDGLYDERPCSFMVYAPCRTAVVYALANHD

SEQ ID NO: 1998 - protein, 730 aa, Haemophilus influenzae
MTTAVTQAIIDGFFDASNGDPFATLGMHETERGIEIRTLLPEANRVVVIERESGKEITELDCVDERGFFVGVIPNCRQFFAYQLQVFWGNEAQIIEDPYRFHPMIDDLEQWLLSEGSMLRPYEVLGAHFMECDGVSGVNFRLWAPNARRVSIVGDFNYWDGRRHPMRFHLKSGVWELFLPKASLGQLYKFELIDCHGNLRLKADPFAFSSQLRPDTASQVSALPNVVEMTEARKKANQGNQPISIYEVHLGSWRRNLENNFWLDYDQIADELIPYVKEMGFTHIEFLPLSEFPFDGSWGYQPLGLYSPTSRFGSPEAFRRLVKRAHEAGINVILDWVPGHFPSDTHGLSAFDGTALYEHADPCEGYHQDWNTLIYNYGRNEVKNFLSSNALYWLERFGVDGIRVDAVASMIYRDYSRAEGEWIPNQYGGRENLEAIEFLKHTNWKIHSEMAGAISIAEESTSFAGVTHPSENGGLGFNFKWNMGWMNDTLAYMQLDPIYRQYHHNKMTFGMVYQYSENFVLPLSHDEVVHGKYSLLGKMPGDTWQKFANLRAYYGYMWGYPGKKLLFMGNEFAQGREWNYEESLDWFLLDENIGGGWHKGVLKLVKDLNQIYQKNRPLFELDNSPEGFDWLVVDDAANSVFAFERRSSNGERIIVVSNFTPVPRHNYRIGVNVAGTYEEILNTDSMYYQGSNVGNFGCVASEKIESHGRENSISVSIPPLATVYLRLKTK

SEQ ID NO: 1999 - protein, 548 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGQVFKNEREVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMDLEKSTLEDLGQAKRVVINKDTTTIIGGSGEKQAIQSRIGQIRQEIQEATSDYDKEKLNERLAKLSGGVAVLKVGAATEVEMKEKKARVEDALHATRAAVEEGVVAGGGVALVRVAGKISNLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPREDKSSDVASSPAGGMGGMGGMM

SEQ ID NO: 2000 - protein, 492 aa, Triticum aestivum
MDPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDKFDFDPLDVTKTWPEDIIPLQPVGRMVLNKNIDNFFAENEQLAFCPAITVPGIHYSDDKLLQTRIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDTSLGQKLASRLKIKPSM

SEQ ID NO: 2001 - protein, 186 aa, Arabidopsis thaliana
  misc_feature (117)..(117): Xaa can be any naturally occurring amino acid
MASEARESPANNPGLSTNRDEATKGYIMQQTMFRIKDPKASLDFYSRVLGMSLLKRLDFSEMKFSLYFLGYEDTTTAPTDPTERTVWTFGQPATIELTHNWGTESDPEFKGYHNGNXSEPRGFGHIGVTVDDVHKACERFEELGVEFAKKPNDGKMKNIAFIKDPDGYWIEIFDLKTIGTTTVNAA

SEQ ID NO: 2002 - protein, 323 aa, Gibberella zeae
MASTTETNNYKFNHSMIRVKDPKASTKFYEFLGMSLVKKLEFPDNKFDLYFFGYDSPNALSHNKSTFDRQGLIELTHNYGTENDPEYKVNNGNQDPHRGFGHTCIAVDNIQAACQRIEDAGYKFQKKLTDGRMRNIAFVLDPDGYWVEVVARNDYKETENVKETDVSTYTMNHTMLRVKDAEKSLKYYQEVLGMSRLRTLENPEAGFNLYFLGYPGDQPFPEGQDDKAITHREGLLELTWNYGTEKEENFKYHDGNSEPQGFGHICVSVDNLEAACKRFEDMDVSWKKRLTDGRMKNVAFLLDPDGYWIEIVQNEKFSGKENF

SEQ ID NO: 2003 - protein, 279 aa, Streptococcus pyogenes
MVTTVKMTSGYEIPVLGFGTYQAADGEEAYQSTLAAIKADYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTPEDKKTIRYLSGMSAISNPDTTSF

SEQ ID NO: 2004 - protein, 380 aa, Mannheimia succiniciproducens
MNAKFSPLFQSYTLNNGVEIKNRLVVAPMTHFGSNPDGTLGENEREFISNRANDMGMFILAATLVQDGGKAFHGQPEAIHASQLASLKETADIIKAQGAKAILQLHHGGKQAVTELLNGKDKITASDDEATGTRAATVEEIHSLINAFANAADLAIQAGFDGVEIHGANNYLIQQFYSGHSNRRTDEWGGSRENRMRFPLAIVDEVLAVKAKHQANDFIVGYRFSPEEPEELGLTMEDTLALIDTLKGKALQYLHISLHEFFKKARRGADTNAFRMQLVHDRIGGKLPLIGVGSLFTAEQILEAYNTGWAEFIALGKTVMINPTIATLIKEGKENEIVTTLDPEKADQYGIKGILWDLCKNGGAWLPPLKGKDDWHPVDV

SEQ ID NO: 2005 - protein, 325 aa, Vitis vinifera
GGGNFGVARLVSDKRTRELFAVKFIERGQKIDEHVQREIMNHRSLMHPNIVRFKEVLLTPTHLAIVMEYAAGGELFGRICNAGRFSEDEARFFFQQLISGVSYCHSMRICHRDLKLENTLLDGSTAPRVKICDFGYSKSSVLHSQPKSTVGTPAYIAPEVLSRKEYDGKLSDVWSCGVTLYVMLVGAYPFEDPDDPRNFRKTIGRILSVHYSIPDYVRVSIECRHLLSRVFVANPDKRITIPEIKTHPWFLKNLPIEMMDGGSWQKNDVNNPSQSVEEILSIIQEARKTTGVRKAGGPFMEGSMDLDDIDADEDIETSGDFVCPL

SEQ ID NO: 2006 - protein, 412 aa, Pachysandra americana
SGKPFYAIMHRIDVGLVIDLEPVNPADVPVTAAGALKSYKLAAKAISKLQSLPSGNISLLCDVLVKEVNELTGYDRVMVYKFHEDEHGEVVAECRRTDLEPYLGLHYPATDIPQASRFLFLKNKVRMICDCLAPPIRVIQDKRLEQPLSLCGSTLRAPHGCHAQYMENMGSIASLVMSVTINEDDDDDDVESDQQKGRKLWGLVVCHHTSPRFVPFPLRYACEFLIQVFGIQINKEVELAAQTKEKHILRNQTMLCDMLLRESPVGIVTKSPNVIDLVKCDGAALYYKNKFWLLGVTPTEAQIRDISEWLIEYHNGSTGLSTDSLMEAGYPGASVLGDAVCGMAAIKITSKEFLFWFRSQTAKEIKWGGAKHEPFNKDDARKMHPRSSFKAFLEAVKQRCLPWEDVEMDAIQ

SEQ ID NO: 2007 - protein, 554 aa, Pleea tenuifolia
  misc_feature (346)..(346): Xaa can be any naturally occurring amino acid
DLEPVNPADVPVTAAGALKSYKLAAKAISKLQSLPTGNISLLCDVLVREVSDLTGYDRVVAYKFHEDEHGEVIAECRRSELEPYLGLHYPATDIPRASRFLFMKNKVRMICDCSAAPVKVIQDKRLAQPLSLCGSILRAPHGCHAQYMASMGSVASLVMSVTIIEDDNETGSDQQEKGRKLWGVVVCHHTSPRFIPFPLRYACEFLIQVFCMQLTKEVELADQMREKHILQTQTVLCDMLLRDAPVGIFTQSPNVMDLVKCDGAALYYRNQFWLLGISPREAQIRDIAGWLLEYHDGTTGLSTDSLLDAGYPGASALGDEVCGMAAIRITDKDFLFWFRSHTAKEXTWGGAKHDLVEKDSDGRKMHPRSSFKAFLEVVEGRSLPWEDVEMDAIHSLQLILRDSLQGERASIDSKAIVNAPLDDAKKIQGMDELSLVTNEMIRLIETAAVPILAVDVLGNVNGWNIKAAELTGLVVQQAIGMPLIDLVEGDSIDVAKNMLFLALQGKEERDVEIKLKTFGHQEKNGPKILVVNACCSRDMKEDIVGVCFVAQDVT

SEQ ID NO: 2008 - protein, 467 aa, Pseudowintera axillaris
SGKPFYAIIHRVTGSLIVDFEPVKPYESPMAAAGALQSYKLTAKAISRLQSLPGGSLKRLIDTVVQGVFELTGYDRVMAYKFHEDDHGEVISEVTKPDLEPYLGLHYPATDIPQAARFLFMKNKVRMICDCNAKPMKVYQDEKLTFDLTLCGSTLRAPHSCHLQYMENMGSIASLVMAVVINEREEKDENSGSEQQQEQPKRKRLWGLVVCHNTTPRFVPFPLRYACEFLAQVFAIHVNKELELENQIQEKNILRTQTLLCDMLMRAAPLGIVTQSPSILDLVKCDGAVLLYQNKIWRLGIAPTESQILDIALWLSEYHMDSTGLSTDSLHDAGYPGALSLGDVVCGMAAVRINSKDTLFWFRSHTAAEIRWGGAKHDPNQKDDGRKMHPRSSFKAFLDVVKTRSSPWADYEMDATHSLQLILRGSLKEAEKVDTGTMIHSRLNDLKLEGVVELQAVTNQMVRLMET

SEQ ID NO: 2009 - protein, 499 aa, Cryptococcus neoformans
MSIVVSLPVLCTPPHTHDGPGPVLEETGPHLLQAAPPAGPRRLLRPHLHRRQRPQPPPARRRQAQEQRTRPPPPRPRLAPQPCARPQQRPARQNTPPSPAAVPTTQNIIAAPSQPSKSFLASSPPPPSAMPVSPAGTTRARSSSPPPSSSPAAASHLSRDSASSLSPGFALTQTVSRGSLGAGGAGFQILDVDNMIQRLLEAGYSGKVTKSPPLKNAEITSVCAAAREVFLSQPTLIELSPPVKIVGDVHGQYADLLRMFEMCGFPPAANYLFLGDYVDRGKQSLETILLLLCYKIKYPENFFLLRGNHECANVTRVYGFYDECKRRTNIKIWKTFIDVFNTLPIASIVASKIFCVHGGLSPSLKSMDDIRRIQRPTDVPDYGLLNDLVWSDPSDTALDWEDNERGVSFCYGKSVINAFLATHDMDLICRAHMVVEDGYEFYNDRTLVTVFSAPNYCGEFDNFGAVMSVSEDLLCSFELLKPLDGAALKKEMTKSKRKS

SEQ ID NO: 2010 - protein, 253 aa, Nicotiana benthamiana
MALEALNSPTTTTPPTFQFENNGPLRYLENWTKGKRSKRPRSMERQPTEEEYLALCLIMLARSDGSANREQSLPPPPVPVMKIHAPPEEKMVYKCSVCGKGFGSYQALGGHKASHRKLVAGGGGGDDQSTTSTTTNATGTTSSANGNGNGSGKTHECSICHKRFPTGQALGGHKRCHYDGGNSNGGVSVSASVGLTSSEGVGSTVSHRDFDLNIPALPEFWPGFGSGEDEVESPHPTKKSRLSLPPKFELFRE

SEQ ID NO: 2011 - protein, 395 aa, Pseudowintera axillaris
  misc_feature (154)..(154): Xaa can be any naturally occurring amino acid
DLEPVNPADVPVTAAGALKSYKLAAKAISKLQSLPSGNISLLCDVLVREVSELTGYDRVMTYKFHEDEHGEVIAECRRNDMEPYLGLHYPATDIPQASRFLFMKNKVRMICDCTARPVEVIQDKKLAQPLSLCGSTLTAPHGCHAQYMANMGSXASLVMSVTISEDDDEASSEEHRQKGRKLWGLVVCHHMTPRFVPFPLRYACEFLIQVFGIQLNKEVELAAQLREKNMLRTQTMLCDMLLRDAPVGIVTQSPNVMDLVKCDGAALYYRNQFWLLGTTPTEVQIRDIAEWLLEYHNNTTGLSTDSLMEAAYPGASILGDAVCGMAAVKITNKDFLFWFRSHTAKEIKWGGAKHDPSDKDGDGRKMHPRSSFMAFLDVVKRRSLPWEDVEMDAIQ

SEQ ID NO: 2012 - protein, 496 aa, Nicotiana tabacum
MVLSKTASESDVSIHSTFASRYVRTSLPRFKMPENSIPKEAAYQIINDELMLDGNPRLNLASFVTTWMEPECNTLMMDSINKNYVDMDEYPVTTELQNRCVNMIAHLFNAPLGDGETAVGVGTVGSSEAIMLAGLAFKRKWQNKMKAQGKPFDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGIEKSGRFNIISKEIGVPLVAFSLKDNSQHNEFEISETLRRFGWIVPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 2013 - protein, 441 aa, Pteridophyllum racemosum
  misc_feature (157)..(157): Xaa can be any naturally occurring amino acid
PYEVPMTAAGALQSYKLAAKAIAKLQPLHSGNMERLCDTVVQEVFDLTGYDRTMAYKFHDDDHGEVISEVTKPGLEPYLGLHYPATDIPQAARFLFMKNKIRMICDCNAKQVKVLQDEKIPFDLTLCGSTLRAPHTCHLLYMKNMGSAASLVMAIVXNEGDEEEEASGPSQPQKKKRLWGLVVCHNTTPRFVPFPLRYACEFLLQVFAIHVNKEFELENQILEKNILRTQTLLCDMLMRDAPLGILSQSPNIMDLVRCNGAALLYKNKIHRLGLTPSDFQIHDIASWLSEHHMDSTGLSTDSLYDAGFPGALSLGDQVCGMAAVRITSKDMLFWFRSHTAAEVRWGGAKHNPSEEDDGRKMHPRSSFKAFLEVVKTRSSPWRDYEMDAIHSLQLILRNAFKDAETADLNATVIHSGLNNLKIEGMEELEAVTNEMVRLIET

SEQ ID NO: 2014 - protein, 361 aa, Oryza sativa
MERAAAGPLGMEMPIMHDGDRYELVKEIGSGNFGVARLMRNRASGDLVAVKYIDRGEKIDENVQREIINHRSLRHPNIIRFKEVILTPTHLAIVMEYASGGELFERICSAGRFSEDEARFFFQQLISGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPEDPKNFRKTIQKILGVQYSIPDYVHISPECRDLITRIFVGNPASRITMPEIKNHPWFMKNIPADLMDDGMVSNQYEEPDQPMQNMNEIMQILAEATIPAAGTSGINQFLTDSLDLDDDMEDMDSDLDLDIESSGEIVYAM

SEQ ID NO: 2015 - protein, 2351 aa, Arabidopsis thaliana
MLGRDEDLVRTMSGRGSLGSTSHRSLAGAASKSFRDVFAPPTDDVFGRSDRREEDDVELRWAALERLPTYDRLRKGMLPQTMVNGKIGLEDVDVTNLAPKEKKHLMEMILKFVEEDNEKFLRRLRERTDRVGIEVPKIEVRYENLSVEGDVRSASRALPTLFNVTLNTIESILGLFHLLPSKKRKIEILKDISGIIKPSRMTLLLGPPSSGKTTLLQALAGKLDDTLQMSGRITYCGHEFREFVPQKTCAYISQHDLHFGEMTVRESLDFSGRCLGVGTRYQLLTELSRREREAGIKPDPEIDAFMKSIAISGQETSLVTDYVLKLLGLDICADTLVGDVMRRGISGGQRKRLTTGEMLVGPATALFMDEISTGLDSSTTFQICKFMRQLVHIADVTMVISLLQPAPETFELFDDIILLSEGQIVYQGSRDNVLEFFEYMGFKCPERKGIADFLQEVTSKKDQEQYWNRREHPYSYVSVHDFSSGFNSFHAGQQLASEFRVPYDKAKTHPAALVTQKYGISNKDLFKACFDREWLLMKRNSFVYVFKTVQITIMSLIAMTVYFRTEMHVGTVQDGQKFYGALFFSLINLMFNGMAELAFTVMRLPVFFKQRDFLFYPPWAFALPGFLLKIPLSLIESVIWIALTYYTIGFAPSAARFFRQLLAYFCVNQMALSLFRFLGALGRTEVIANSGGTLALLVVFVLGGFIISKDDIPSWLTWCYYTSPMMYGQTALVINEFLDERWGSPNNDTRINAKTVGEVLLKSRGFFTEPYWFWICIGALLGFTVLFNFCYIIALMYLNPLGNSKATTVVEEGKDKHKGSHSGTGGSVVELTSTSSHGPKKGMVLPFQPLSLAFNNVNYYVDMPAEMKAQGVEGDRLQLLRDVGGAFRPGVLTALVGVSGAGKTTLMDVLAGRKTGGYVEGSINISGYPKNQATFARVSGYCEQNDIHSPHVTVYESLIYSAWLRLSADIDTKTREMFVEEVMELVELKPLRNSIVGLPGVDGLSTEQRKRLTIAVELVANPSIIFMDEPTSGLDARAAAIVMRTVRNTVDTGRTVVCTIHQPSIDIFESFDELLLMKRGGQVIYAGTLGHHSQKLVEYFEAIEGVPKIKDGYNPATWMLDVTTPSMESQMSVDFAQIFVNSSVNRRNQELIKELSTPPPGSNDLYFRTKYAQPFSTQTKACFWKMYWSNWRYPQYNAIRFLMTVVIGVLFGLLFWQTGTKIEKEQDLNNFFGAMYAAVLFLGATNAATVQPAVAIERTVFYREKAAGMYSAIPYAISQVAVEIMYNTIQTGVYTLILYSMIGYDWTVVKFFWFYYYMLTCFVYFTLYGMMLVALTPNYQIAGICLSFFLSFWNLFSGFLIPRPQIPIWWRWYYWASPVAWTLYGIITSQVGDRDSIVHITGVGDMSLKTLLKNGFGFDYDFLPVVAVVHIAWILIFLFAFAYGIKFLNFQRRFYSFKLFRSSLSLPKVLCKTLSPSSMVYTISGVRFPHLPSIKKKNSSLHSFNEDLRRSNAVSFSLRKDSRSSGKVFARKPSYDSDSSSLATTASEKLRGHQSDSSSSASDQVQSRDTVSDDTQVLGNVDVQKTEEAQETETLDQTSALSTSGSISYKEDFAKMSHSVDQEVGQRKIPPPGDGKRIYDIDPMLNSHRNHLDYRYGQYRKLREEIDKNEGGLEAFSRGYEIFGFTRSATGITYREWAPGAKAASLIGDFNNWNAKSDVMARNDFGVWEIFLPNNADGSPAIPHGSRVKIRMDTPSGIKDSIPAWIKYSVQPPGEIPYNGVYYDPPEEDKYAFKHPRPKKPTSLRIYESHVGMSSTEPKINTYANFRDDVLPRIKKLGYNAVQIMAIQEHAYYASFGYHVTNFFAPSSRFGTPDDLKSLIDKAHELGLVVLMDIVHSHASKNTLDGLDMFDGTDGQYFHSGSRGYHWMWDSRLFNYGSWEVLRYLLSNARWWLEEYKFDGFRFDGVTSMMYTHHGLQVVEFTGNYNEYFGYSTDVDAVVYLMLVNDLIHGLYPEAIVVGEDVSGMPAFCVPVEDGGVGFDYRLHMAVADKWIELLKYVLRTSWLFSEIIKKRDEDWQVGDITFTLTNRRWGEKCVVYAESHDQALVGDKTIAFWLMDKDMYDFMAVDRQATPRVDRGIALHKMIRLITMGLGGEGYLNFMGNEFGHPEWIDFPRTDQHLPDGRVIAGNNGSYDKCRRRFDLGDAEYLRYHGLQEFDRAMQNLEETYGFMTSEHQYISRKDEGDRVIVFERGNLLFVFNFHWTNSYSDYRIGCSVPGKYKIVLDSDNSLFGGFNRLDDSAEFFTSDGRHDDRPCSFMVYAPCRTAVVYAAVDDDDDDERSSLVPIGLLPEDV

SEQ ID NO: 2016 - protein, 376 aa, Ralstonia eutropha
MALAVVPKHCCALLPPIRKYARPDLMPTLFDPIRIGDLDLPNRVIMAPLTRSRAVGGKRVPNALMAEYYVQRASAGLIISEATAVTPQGVGYADTPGIWTDEQVAGWKHVTDAVHAAGGRIFMQLWHVGRISDPIFLDGELPVAPSAIAAQGHVSLVRPKRAYVTPRALETEEIAGVIAAYRHGAENAKKAGFDGVEIHGANGYLLDQFLQDSTNQRTDAYGGPIENRARLLLEITDACIDVWGADRVGVHLSPRGDVHSMGDSDLAATFGYVARELGKRRIAFICAREALGDNRLGPALKAAFGGVYIANEKMTKQTAEHVLAAGEADAVAFGQLFIANPDLPRRLALDASLNEPRPETFYHPGAEGYTDYPALV

SEQ ID NO: 2017 - protein, 710 aa, Saccharomyces cerevisiae
MGNSGSKQHTKHNSKKDDHDGDRKKTLDLPPLTKSDTTHSLKSSRSLRSLRSKRSEASLASNVQAQTQPLSRRSSTLGNGNRNHRRSNNAPITPPNNHYLTSHPSSSRRLSSSSRRSSMGNNNNSELPPSMIQMEPKSPILKNSTSMHSTSSFNSYENALTDDDDDRGDDGGESPSMAKVTRINTSSSADRGSKRTPLRRHNSLQPEKGVTGFSSTSSKLRRRSDNTLPASYPLNAEAGGNGSDYFSNRSNSHASSRKSSFGSTGNTAYSTPLHSPALRKMSSRDNDDSGDNVNGRGTSPIPNLNIDKPSPSASSASKREYLSAYPTLAHRDSSSSLSPRGKGQRSSSSSSSSQRIYVSPPSPTGDFVHGSCADGDNGSRTNTMVEMKRKKPVRPVDIDEIIQRLLDAGYAAKRTKNVCLKNSEIIQICHKARELFLAQPALLELSPSVKIVGDVHGQYADLLRLFTKCGFPPMANYLFLGDYVDRGKQSLETILLLLCYKIKYPENFFLLRGNHECANVTRVYGFYDECKRRCNIKIWKTFVDTFNTLPLAAIVTGKIFCVHGGLSPVLNSMDEIRHVSRPTDVPDFGLINDLLWSDPTDSSNEWEDNERGVSFCYNKVAINKFLNKFGFDLVCRAHMVVEDGYEFFNDRSLVTVFSAPNYCGEFDNWGAVMTVSEGLLCSFELLDPLDSTALKQVMKKGRQERKLANR

SEQ ID NO: 2018 - protein, 242 aa, Antirrhinum majus
MGRGRVELKRIENKINRQVTFAKRRNGLLKKAYELSVLCDAEVALIIFSNRGKLYEFCSSTSMLNTLERYQKCNYGPPETNVSTREALELSSQQEYLKLKARYEALQRSQRNLLGEDLGPLNSKELESLERQLDMSLKQIRSTRTQAMLDTLTDLQRKEHALNEANRSLKHRLMDGSQISLQWNPNAEDHVGYGRQPSQPSADGFYHPLECEPTLHIGFQSDQITVAGAGPSVNNYISGWLP

SEQ ID NO: 2019 - protein, 547 aa, Haemophilus ducreyi
MAIKDVKFGNDARVKMLKGVNILADAVKVTLGPKGRNVVLDKAYGAPTITKDGVSVAREIELEDKFENMGAQMVKEVASKANDVAGDGTTTATVLAQSIVSEGLRAVAAGMNPMDLKRGIDKAVAAVVEELKAISKPCETSKEIEQVGTISANSDETVGKLIAQAMEKVGKEGVITVEDGTGLDDALDVVEGMQFDRGYLSPYFINKPEAGTVELDNPYIILVDKKISNIREILPVLEAVAKAGKPLLIIAEDVEGEALATLVVNTMRGIVKVAAVKAPGFGDRRKAMLQDIAILTAGTVISEEIGMELEKATLEELGQAKRVVITKDNTTIIDGIGDEAQIKARVVQIRQQIEDSTSDYDKEKLQERVAKLAGGVAVIKVGAATEVAMKEKKDRVDDALHATRAAVEEGIVPGGGVALVRAANKVSATLTGDNEEQNVGIKLALRAMEAPLRQIVENSGEDASVVARDVKDGSGNFGYNATTEEYGDMLEMGILDPTKVTRSALQFAASIAGLMITTECMITDLPKEDKLDAQAAMGGMGGMGGMM

SEQ ID NO: 2020 - protein, 823 aa, Zea mays
MLCLVSPSSSPTPLPPPRRSRSHADRAAPPGIAGGGNVRLSVLSVQCKARRSGVRKVKSKFATAATVQEDKTMATAKGDVDHLPIYDLDPKLEIFKDHFRYRMKRFLEQKGSIEENEGSLESFSKGYLKFGINTNEDGTVYREWAPAAQEAELIGDFNDWNGANHKMEKDKFGVWSIKIDHVKGKPAIPHNSKVKFRFLHGGVWVDRIPALIRYATVDASKFGAPYDGVHWDPPASERYTFKHPRPSKPAAPRIYEAHVGMSGEKPAVSTYREFADNVLPRIRANNYNTVQLMAVMEHSYYASFGYHVTNFFAVSSRSGTPEDLKYLVDKAHSLGLRVLMDVVHSHASNNVTDGLNGYDVGQSTQESYFHAGDRGYHKLWDSRLFNYANWEVLRFLLSNLRYWLDEFMFDGFRFDGVTSMLYHHHGINVGFTGNYQEYFSLDTAVDAVVYMMLANHLMHKLLPEATVVAEDVSGMPVLCRPVDEGGVGFDYRLAMAIPDRWIDYLKNKDDSEWSMGEIAHTLTNRRYTEKCIAYAESHDQSIVGDKTIAFLLMDKEMYTGMSDLQPASPTIDRGIALQKMIHFITMALGGDGYLNFMGNEFGHPEWIDFPREGNNWSYDKCRRQWSLVDTDHLRYKYMNAFDQAMNALDERFSFLSSSKQIVSDMNDEEKVIVFERGDLVFVFNFHPKKTYEGYKVGCDLPGKYRVALDSDALVFGGHGRVGHDVDHFTSPEGVPGVPETNFNNRPNSFKVLSPPRTCVAYYRVDEAGAGRRLHAKAETGKTSPAESIDVKASRASSKEDKEATAGGKKGWKFARQPSDQDTK

SEQ ID NO: 2021 - protein, 542 aa, Lactococcus lactis
MSKDIKFSSDARTAMMRGIDILADTVKTTLGPKGRNVVLEKSYGSPLITNDGVTIAKEIELEVHFENMGAKLVSEVASKTNDIAGDGTNTATVLTQAIVREGLKNVTAGANPVGIRRGIELAAETAVASIKEMAIPVHDKSAIAQVATVSSRSEKVGEYISDAMERVGSDGVITIEESKGMQTELDVVEGMQFDRGYLSQYMVSNTEKMVAELDNPYILITDKKISNIQEILPLLEQILKTNRPLLIVADDVDGEALPTLVLNKIKGVFNVVAVKAPGFGDRRKAQLEHLAILTGGTVITEELGLDLKDATLEALGQAAKATVDKDHTTIVEGAGSADAISDRVAIIKAQIEKTTSDFDREKLQERVAKLAGGVAVVKVGAATETELKAMKLLIEDALNATRAAVEEGIVSGGGTALVNAIAALDKLSEEGDIQTGINIVRRALEEPVRQIAANAGYEGSVIIDKLRSEEVGTGFNAATGQWVNMIEEGIVDPAKVTRSALQNAASVAGLILTTEAVVANKPEPAAPAMPPMDPSMGMGGMI

SEQ ID NO: 2022 - protein, 868 aa, Gibberella zeae
MASNILYLPFRKSTQLSLASTIRQYINTKYDQHPDMFKHDLEVIDALRRDAVNVREPHPSGIKKLQAYAGQLVWVGGKFPIDIGAEFSWYPALGYNTERPMVRNNLKYELMNVLYNLASLYSQLAINTPRGNTEGLKSAANYFSLAAGVLTHMQKEILPELRMSDPPEDMDHDTLESLTQLLLAQSQECFWQKAVMDGYKDASIAKLAARVSDLYNFAGEAAMKSEAISSAWIHHMSAKHHHFAAAAQYRAACDCLEKRKYGEEVARLRDAVSCAAEGLKEARNGYLGKVVVDDLNGLKRKVEEDLKRAEKDNDVIYLIAVPPKSELKILDRANMAVARVPPQIGNPYDYFGDRAEFGPALFSRLVPFSVHVATSIYEERRDRMVNQNIIQELESLTQKIHELLASLGLPGSLQALEKPLGLPPSLVQHAEEIRQADAINRVQKSFADIDKLRLGDMDIFEEGKRALASEEEEDQRLRMRYGTDRWIRPESREDPQGQKLWQHASEIETYFQSSVSSDGVVREKFIAIQDLLAILSGPDRDLMDSVPSSRRVDIPETLKPAIGRLRSAYNDVLRLESRRRKKVEALRDNARRDDIKPDILKEAARLERTYPNTALVPAHFEEFFDQRLDKLYEPEVEAIEKEAQDQDRLLQDVQRVNREFEAQKRQMGERGNREREVALQRLDNAYFKYKEIINNLEVGRKFYNDLNKIVGQGFRDVIRNWVAQRRMEARALEEYVFTSSKNDAMLMKCREINMPTLSNLNISNQQVQAQAQAQAHAHAQAQSPMPSYQEPAHSYAPPQQPPQPVQSPAQASIQSWGETVQQPKPVQPQQAAPMWNPGMGIKFGQPSGGSGQPPAPGTWNPNAGIKFG

SEQ ID NO: 2023 - protein, 1017 aa, Leptospira interrogans
MTSLRSDSNFLILNSSGEVITWNFYKPLQEFGSNLEKEIHPSQWNWAISDSWASVWKKVKSPRKKTSFLKVGYITQKKEPLDLEVKIVSLENDHILLLFFTNFESYFSETPSIFLQDSELRSTIFQKSANAILLLDPDKDLILEINQTASRYFEIQNQSEILNLPFSNLLAQDFTHFEYTSRKKKILSGETPSWDLEFKTFRGKKFWGNTSCRMISTHLNKIILVQIKDITEKVNTRKSLLEQAGTIAEHEANLNAIIENSEAMIWSIDKNYKLLIFNSQFQNVMQNFYHSEISTGFNLFQKELPPEIAKYWKEFYDRALSGEKVSVARKRPNQDGTFIFSELSFQPIRNTEYEITGVSAISVDITDKKLAEEKFRLLFERSSEPHVLYDDFGILECNPATLKMLRCSDKKLVLGKHPIHFSVETEKEKTNELESIALEKGSYTFEWVYKRFNDEEFSVEVTLIPIIIHQKRVFLSVWHEITERKVYEDSLKRAKEIAEAASKAKTDFLAMMSHEIRTPLNGVIGTVSLLEGTFLNTEQKEYLDIIKSSGQNLLILLNDILDLSRIESGQLKLEIQPVSPEKLTNEVVNLFRPMAEEKGLVVESEVSFNVPNWIISDPYRLRQVLTNLIGNSIKFTEKGKIHLSVEAEKFPNDKLRLIFHVKDTGIGIAEEKLELLFRAFSQVDSSTTRKYGGSGLGLTISKKLAELMKGEITVKSQVNSGSEFSLSILTEKLEYEIPAGVQELHSKNLATSAVISIQEFQFKEQIKKFCERNGFLVKMARTAKETIRIIGEEERIGVFLTDLNFPDMNLSEMLNELKKQNPSLKLTVILFMEKELKDSYYLVTNSLFNRPGFQIFMMFKPILLEELSKNFEKAFPIKVLKKEKQNENKKLLSEKIPLQILLVEDNVINQKIALRLLTKLGYNADSALNGLEGIEKLKTKNYDLIFMDIQMPEIDGYETTFQIRKDFGKSKPVIVAMTANAMEGDREKCLEAGMNAYISKPIQIQDIESTIVLLFQS

SEQ ID NO: 2024 - protein, 80 aa, Oryza sativa
ARDHKGVLSSKGSGKPPLLLGLSVHCPIREAIRAARKEFPGAGGFPLTFQMDVPATMPIVKELCGLDVVEKYFESFAAKA

SEQ ID NO: 2025 - protein, 205 aa, Nicotiana tabacum
MPSPANVLKVIILGDSGVGKTSLMNQYVNKKFSNQYKATIGADFLTKEVQFEDRLFTLQIWDTAGQERFQSLGVAFYRGADCCVLVYDVNSMKSFENLNNWREEFLIQASPSDPENFPFVVLGNKVDIDGGNSRVVSEKKARAWCASKGNIPYFETSAKEGTFVEEAFQCIAKNALKSGEEEEIYLPDTLDVGTSSQPRTGGCEC

SEQ ID NO: 2026 - protein, 290 aa, Oryza sativa
MAAGRAAAVAACASPAVPRRWAKSDNRRLLHVVYRVGDIDRTIKFYTECLGMKLLRKRDIPEEKYTNAFLGYGAEDNHFVVELTYNYGVDKYDIGAGFGHFGIAVDDVAKTVELIRAKGGKVTREPGPVKGGKTVIAFVEDPDGYKFEILERPGTPEPLCQVMLRVGNLDRAISFYEKACGMELLRKRDNPEYKYTVAMMGYGPEDKNAVLELTYNYGVTEYDKGNAYAQIAIGTDDVYKTAEVVKLFGGQVVREPGPLPGINTKITSILDPDGWKSVFVDNIDFAKELE

SEQ ID NO: 2027 - protein, 225 aa, Glycine max
MGQDQNQRSLIYAFVSRGTVILAEYTEFSGNFNTIAFQCLQKLPASNNKFTYNCDGHTFNYLVDNEFTYCVVADESIGRQVPVAFLERAKDDFVAKYGGGKATTAAANSLNKEFGSKLKEHMQYCVEHPEEISKLAKVKAQVSEVKDVMMENIEKVLDRGEKIELLVDKTENLHHQAQDFRNSGTKIRRKMWLQNMKIKLIVLAILIALILIIVLSVCRGFNCGK

SEQ ID NO: 2028 - protein, 168 aa, Oryza sativa
SSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQ

SEQ ID NO: 2029 - protein, 461 aa, Pteridophyllum racemosum
SGKPFYAILHRIDVGFVIDLEPVNPLDVPVTAAGALKPYKLAAKAISRLQSLPSGNISLLCDVLAREVSELTGYDRVMVYKFHEDEHGEVVSECRKIDLESYRGLHYPATDIPQASRFLFMKNRARIICDCSATPVKVIQDEKLAQPLSLCGSTLRAPHGCHAQYMANMGSIASLVMFVTINDDDDDIKIETHKGRKLWGLVVCHHTSSRFVPYPLRYACEFLIQVFGIQLNKEVELAVQSREKRILRTQTLLCDMLLRDSPVGIVTQSPNVMDLVRCDGAALYFRNKFWLLGVPPTEKQIRDIVGWLMEHYVGTTGLSTDSLMEAGYPDSSVLGDAVCGMAAINFTSKDFLFWFRSQTAKELKWGGAKHDPVDMDDVRKMNPRSSFNAFLEVVKWRSLPWEDVEMDAIHSLQLILRESMKNEIVNDVKTIVNTTPVIDARLRGMDQLCVVTGEMVSLMET

SEQ ID NO: 2030 - protein, 451 aa, Arabidopsis thaliana
MSGSRRKATPASRTRVGNYEMGRTLGEGSFAKVKYAKNTVTGDQAAIKILDREKVFRHKMVEQLKREISTMKLIKHPNVVEIIEVMASKTKIYIVLELVNGGELFDKIAQQGRLKEDEARRYFQQLINAVDYCHSRGVYHRDLKPENLILDANGVLKVSDFGLSAFSRQVREDGLLHTACGTPNYVAPEVLSDKGYDGAAADVWSCGVILFVLMAGYLPFDEPNLMTLYKRICKAEFSCPPWFSQGAKRVIKRILEPNPITRISIAELLEDEWFKKGYKPPSFDQDDEDITIDDVDAAFSNSKECLVTEKKEKPVSMNAFELISSSSEFSLENLFEKQAQLVKKETRFTSQRSASEIMSKMEETAKPLGFNVRKDNYKIKMKGDKSGRKGQLSVATEVFEVAPSLHVVELRKTGGDTLEFHKVCDSFYKNFSSGLKDVVWNTDAAAEEQKQ

SEQ ID NO: 2031 - protein, 431 aa, Thermus caldophilus
MTENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARTLADRVPFFATLNEPWCSAFLGHWTGEHAPGLRNLEAALRAAHHLLLGHGLAVEALRAAGAKRVGIVLNFAPAYGEDPEAVDVADRYHNRYFLDPILGRGYPESPFQDPPPTPILSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQL

SEQ ID NO: 2032 - protein, 618 aa, Moorella thermoacetica
MTYSVSLGANYLGDGRCRFHLWAPLAESVAVQIVAPEERLEPLTRKERGYFQGEVAGVVPGSLYYYLLDGQQLPDPASRYQPRGVHGPSQVVDAKAFSWSDRCWPGPKGEDLIFYELHVGTFTPEGTFEAIIAHLDDLRTLGVTAIELMPVAQFPGCRNWGYDGVFPFAVQNSYGGPEGLRRLVDTCHRYGLAVFLDVVYNHLGPEGNYLAKFGPYFTDRYRTPWGQALNFDGPGSDEVRRFFIENALYWLTEFHLDGLRLDAIHAIMDKSALPFLEELAAAVKLQAERLDRRVYIVAESDLNDPRVIRPQELGGYGLDAQWCDDFHHALHALLTGERNGYYRDFGTLGNLARAFREGYVYTGQYSAYRQRRHGRRPHPCKGNQFVVFTQNHDQVGNRARGERLSTLVPFVKLKLAAAVVLLSPFVPLLFMGEEYGETAPFQYFTSHSDPRLIAAVRRGRREEFAGHNWTGEVPDPQDEATFRRSRLNHGLSLQGQHRVLWEFYRQLIQLRRELPSLTELNLENMEVITCEEDLVLFVRRWSRDSEVGIIFSFSNTATAPTLPLPAGRWRKRLDAAEERWLGDGSTIPALLVSQGKMQVPLTPGACLLFERIKEAQAD

SEQ ID NO: 2033 - protein, 464 aa, Sarcandra glabra
SGKPFYAIIHRVTASLIIDFEPVKPYEVPMTAAGALQSYKLAAKAIARLQSLPGGSMEKLCDTVVQEVFDLTGYDRVMAYKFHEDDHGEVISAITKPGLEPYLGLHYPATDIPQAARFLFMKNKVRMICDCDAKPVKVFQDEKLVFDLTLCGSTLRAPHSCHLQYMANMNSIASLVMAVVVNEGEEDDSLEPGQQQQRKRKRLWGLIVCHNTTPRFVPFPLRYACEFLMQVFAIHVNKELELESQIQEKNIFRTQTLLCDMLMRDTPLGIVSQNPNVMDLVKCDGAALLYKKKIWRLGLTPSETQIHDISFWLSEYHMDSTGFSTDSLNDAGYPGALAIGDAVCGMAAVWITSKDMLFWFRSHTAAEVRWGGAKHDPDDKDDNRGMHPRSSFKAFLEVVKTRSLPWKDNEMDAIHSLQLILRGTFKDVENSHTKTMIYSQLNDLKLEGMEELQAVTNEMVRLIE

SEQ ID NO: 2034 - protein, 475 aa, Lactobacillus acidophilus
MTESIFPKKFLWGGAVAAHQLEGGYNEDGKGISIADLMTLGSHEYPRELTATIEEGKYYPNHKAIDFYHHYQEDIKLMAEMGFKAFRTSIAWTRIFPNGDETQPNEEGLAFYDKVFDECLKYNIEPVVTLSHFEMPYHLVTKYGGWSNRKLIDFFTRLAHVCFEKYHTKVKYWMTFNEINNQANYESDISVYENSGIKFNEDDDKQKIMYQAAHYEMVASAEAVQIGHAIDPSLRIGCMLAFCPIYPASPKPEDILFAQRAMDSRLYFGDVQVNGEYPSWLKQYFKNNNYNLDITDNDLQILKQGTVDYIGFSYYMSFTTKYTDHLDYREYQDLVENPFIKANDWGWPIDPVGLRYALNWMSTRWHKPLFIVENGLGAYDKLTEDHEVHDQYRINYLHDHILEIKKAITEDGIDVIGYLPWGCIDLVSASTGEMKKRYGFIYVDEDDHGNGSMKRYKKDSFYWYQNVIKTNGQEL

SEQ ID NO: 2035 - protein, 465 aa, Sarcandra glabra
SGKPFYAIMHRIDVGPVIDLEPVNPADVPVTAAGALKSYKLAAKAISRLQSLPSGNISLLCDVLVREVSELMGYDRVMAYKFHEDEHGEVIAECRRSDLEPYLGLHYPATDIPQASRFLFMKNKVRMICDCSAAPVKVIQDKRLGQPMSLCGSALRAPHGCHAQYMANMGSIASLVMSVTINEDDDETESDPQQQQEKPRKLWGLVVCHHTGPRFVPFPLRYACEFLIQVFGIQLNKEVELAAQLREKHMLKTQTVLCDMLLRDAPMRIVTQSPNVMDLVKCDGAALYYRNQFWLLGTTPTEAQIRDIAEWLLDYHDGSTGLSTDSLMEAGYPGASVLGDAVCGMAAVKITSKDFLFWFRSHSAKEIKWGGAKHDPINKDDDGRKMHPRSSFKAFLEVMKQRSLRWEDVEMDAIHSLQLILRGSLQEESENDSKAIVNASLDVAKIQGMDELRFVTNEMVRLIET

SEQ ID NO: 2036 - protein, 497 aa, Oryza sativa
MVLSHASSGRDDAVRCTFATRYACETLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 2037 - protein, 423 aa, Smilax rotundifolia
SGKPFYAIVHRVTGCLIIDFEPVTPTEVPMPAAGALQSYKLAAKAIAKLQSLPGGSMEGLCSTVVQEVFELTGYDRVMAYKFHEDDHGEVFAEITKPGLEPYRGLHYPATDIPQAARFLFMKNKVRMISDCRAKPVKVYQDEKLPFDITFCGSTLRAPHSCHLQYMENMNSIASLVMVVVINEGEEDEEQGQQQHNRKRLWGLVVCHHESPRFVPFPLRYACEFLMQVFAIHVNKEFELENQIREKNILRTQTLLCDMLLRDSDPLGIVTQSPNIMDLVKCDGAALLYENEIWQIGLTPTESQIREIAFWFAEFHADSTGLSTDSLYDAGYPGAVALGDTVSGMAAARITSTDILFWFRAHTAAEIRWGGAKHDPSDKDDGKRMHPRSSFNAFLEVVKGRSLPWNNYEIDAIHSLQLILRGTL

SEQ ID NO: 2038 - protein, 326 aa, Aspergillus nidulans
MALKRTFKLNTGYEIPAVGLGTWQSKPSEVEEAVTAALNIGYRHIDAAAVYGNERDVGNGIKASGVPRGEIFLTSKLWNTHHDPENVEAAVDRSLSDLQTDYLDLYLIHWPVAFRYSTTTIQPVDEKTGLIDVIDVPIKDTWAAMEALVAKGKVRSIGVSNFNRRRIEELLKTAKIPPAVNQIEAHPYLQQRELLEWSKEKGILITGYSPLGNNIYNIPRTVDDPLVIEVAKFLNRTPAQVLISWAVQRGTAVLPKSVTPERIKSNFRDFILPEDAFQAIQSLERHQRMNFPARLGVDIFDEVGEESARRSALEWAEGQRLSKSQA

SEQ ID NO: 2039 - protein, 478 aa, Geobacillus kaustophilus
MEHRHLKPFPPGFLWGAASAAYQVEGAWNEDGKGLSVWDVFAKQPGRTFKGTNGDVAVDHYHRYKEDVALMAEMGLKAYRFSVSWSRVFPDGNGAVNEKGLDFYDRLIEELRTHGIEPIVTLYHWDVPQALMDAYGAWESRRIIDDFDRYAVTLFQRFGDRVKYWVTLNEQNIFISLGYRLGLHPPGVKDMKRMYEANHIANLANAKVIQSFRHYVPDGKIGPSFAYSPMYPYDSRPENVLAFENAEEFQNHWWMDVYAWGMYPQAAWNYLESQGLEPTVAPGDWELLQEAKPDFMGVNYYQTTTVEHNPPDGVSEGVMNTTGKKGTSTSSGIPGLFKTVRNPYVDTTNWDWAIDPVGLRIGLRRIANRYRLPILITENGLGEFDTLEPDDIVNDDYRIDYLRRHIQEIQRAITDGVDVLGYCVWSFTDLLSWLNGYQKRYGFVYVNRDDESEKDLRRIKKKSFYWYQRVIATNGAEL

SEQ ID NO: 2040 - protein, 445 aa, Mortierella alpina
MATPLPPSFVVPATQTETRRDPLQHEELPPLFPEKITIYNIWRYLDYKHVFGLGLTPLIALYGLLTTEIQTKTLIWSIIYYYATGLGITAGYHRLWAHRAYNAGPAMSFVLALLGAGAVEGSIKWWSRGHRAHHRWTDTEKDPYSAHRGLFFSHIGWMLIKRPGWKIGHADVDDLNKSKLVQWQHKNYLPLVLIMGLVFPTVVAGLGWGDWRGGYFYAAILRLVFVHHATFCVNSLAHWLGDGPFDDRHSPRDHFITAFVTLGEGYHNFHHQFPQDYRNAIRFYQYDPTKWVIAICAFFGLATHLKTFPENEVRKGQLQMIEKRVLEKKTKLQWGTPIADLPILSFEDFQHACKNDNKKWILLEGVVYDVADFMTEHPGGEKYLKMGVGKDMTAAFNGGMYDHSNAARNLLSLMRVAVVEYGGEVEAQKKNPSMPIYGTDHVKAE

SEQ ID NO: 2041 - protein, 394 aa, Smilax rotundifolia
DLEPVNPADVPVTAAGALKSYKLAAKAISRLQSLPSRNISLLCDVLVREVSELTGYDRVMAYKFHEDEHGEVISECRRSDLEPYLGLHYPATDIPQASRFLFMKNKVRMICDCSAASVKVIQDKKLAQPLSLGGSTLRAPHGCHAQYMANMGSIASLVMSVTINEDDEEMDGDQQQKGRKLWGLVVCHHTSPRFVPFPPRYACEFLLQVFGIQLNKEVELAAQAKGKHIFWMQTLLCDMLLRDAPIGIFTQSPNVMDLVKCDGAALYYRKQFWLLGITPTEAQIKDIVAWLLECHDGTTGLSTDSLTEAGYPGSSALGNAICGMAAIKITSKDFIFWFRSHTSKDIRWGGAKHEPADRDDESQKMHPRSSFKAFLEVVKLRSLPWEDMEMDAIQ

SEQ ID NO: 2042 - protein, 247 aa, Antirrhinum majus
MGRGRVELKRIENKINRQVTFAKRRNGLLKKAYELSVLCDAEVALIIFSNRGKLYEFCSSSNMLKTIERYQKSSYGSLEVNHQAKDIEASSYKEYLKLKSKYESLQGYQRHLLGDDLGPLNMNDLEHLEHQLETSLKHIRSTRTQVMLDQLSDLQTKEKMMVDANKALERKLEEIYAANHLQQSWGGGGDHSNAYNDHQHAQSQGFFQPLECNSTLQIGFNDPVASSQMTAPTDAQNMHGLVPGWML

SEQ ID NO: 2043 - protein, 243 aa, Antirrhinum majus
MGRGRVELKRIENKINRQVTFAKRRNGLLKKAYELSVLCDAEVALIIFSNRGKLYEFCSNSGTMLKTLERYQKCNYGAPEANVSTREALELSSQQEYLKLKARYEALQRSQRNLLGEDLGPLNSKELESLERQLDMSLKQIRSTRTQAMLDTLTDLQRKEHALNEANRSLKHRLMEGSQISLQWNPNAHDMGYGRQAAAQPQGDGFFHPLECEPTLQMGFQSEITVGAAGPSVNNYNMTGWLP

SEQ ID NO: 2044 - protein, 408 aa, Chlamydophila felis
TVAKEIELEDKHENMGAQMVKEVASKTADKAGDGTTTATVLAEAIYSEGLRNVTAGANPMDLKRGIDKAVKVVVDEIKKISKPVQHHKEIAQVATISANNDAEIGNLIAEAMEKVGKNGSITVEEAKGFETVLDVVEGMNFNRGYLSSYFTTNPETQECVLEESLVLIYDKKISGIKDFLPVLQQVAESGRPLLIIAEDIEGEALATLVVNRLRAGFRVCAVKAPGFGDRRKAMLEDIAILTGGQLISEELGMKLENTTLSMLGKAKKVIVSKEDTTIVEGLGNKEDIEARCENIKKQIEDSTSDYDKEKLQERLAKLSGGVAVIRVGAATEIEMKEKKDRVDDAQHATLAAVEEGILPGGGTALVRCIPTLEAFIPILTNEDEQIGARIVLKALSAPLKQIAANAGK

SEQ ID NO: 2045 - protein, 740 aa, Cucumis sativus
METCYCIEPQWPADELLMKYQYISDFFIALAYFSIPLELIYFVKKSAVFPYRWVLVQFGAFIVLCGATHLINLWTFTMHSRTVAVVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPINLPVISQVFSSNRAVKISPNSPVASLRPRAGRYVAGEVVAVRVPLLHLSNFQINDWPELSTKRYALMVLMLPSDSARQWRVHELELVEVVADQVAVALSHAAILEESMRARDPLMEQNVALDLARREAETANHARNDFLAVMNHEMRTPMHAIIALSSLLQETELTPEQRLMVETILKSSNLLATLINDVLDLSRLEDGSLQLDIGTFNLHAVFKEVLNLIKPVTLVKKLSLTLHLGLDLPVFAVGDEKRLMQAILNVVGNAVKFSKEGSISISAIVAKAETFREIRVPDFHPVPSDSHFYLRVQVKDTGSGISPQDIPKLFTKFAQTTVGPRNSCGSGLGLAICKRFVNLMEGHIWLESEGLGKGCTATFIVKLGIAEQSNESKLPFTSKIHENSIHTSFPGLKVLVMDDNGVSRSVTKGLLVHLGCEVTTAGSIEEFLRVVSQEHKVVFMDICTPGVDGYELAIRIREKFAKCHERPFMVVLTGNSDKVTKESCLRAGMDGLILKPVSIDKMRSVLSELIERRVLFETS

SEQ ID NO: 2046 - protein, 637 aa, Cucumis sativus
MMESCDCIDAQWPPDELLVKYQYISDVLIALAYFSIPLELIYFVQKSAFFPYRWVLMQFGAFIVLCGATHFINLWTFSMHSKAVAVVMTVAKVACAIVSCATALMLVHIIPDLLSVKTREMILKNKAEQLDREMGLILTQEETGRHVRMLTHEIRSTLNRDTILKTILVELGKTLGLEECALWMPSRNGLSLQLSHALNYQIPVGTNIPINLPVVNEVFNSNRAICVPYTCQLARVRTSVGGRYLPPEVVAVRVPLLNLSNFQMNNWPDGSSRSYAIMVLILPTDSARKWRDHELELVDVVADQVAVALSHAAILEESMRARDQLVDQNVALDLARREAETAIHARNDFLAVMNHEMRTPMHAIIALSSLLLETELTPEQRVMIETILKSSNLLATLINDVLDLSRLEDGSLVLDMGSFNLHAIFKEALDLVKPIASVKKLSMALILASDLPICAVGDEKRLMQIILNIVGNGVKFTKEGHVSIIASVAKLDSLRDWRPTEFYPMQSDGQFYLRVQVKDSGCGIPPQDIPHLFTRFTQLQTRSNKTNSGVGLGLALCKRFINLMGGHIWIESEGPDKGTTAVFIVKLGICNANPNDLSVKQVVPIVNHRSADLHGQRPIFRETGQVSFSSSRYQRSL

SEQ ID NO: 2047 - protein, 249 aa, Arabidopsis lyrata
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGWEGGEQNVTYAHHQAQSQGLYQPLECNPTLQMGYDNPVCSEQITATTQAQAQQGNGYIPGWML

SEQ ID NO: 2048 - protein, 355 aa, Triticum aestivum
  misc_feature (139)..(139): Xaa can be any naturally occurring amino acid
  misc_feature (189)..(189): Xaa can be any naturally occurring amino acid
  misc_feature (207)..(207): Xaa can be any naturally occurring amino acid
  misc_feature (211)..(211): Xaa can be any naturally occurring amino acid
  misc_feature (237)..(237): Xaa can be any naturally occurring amino acid
  misc_feature (244)..(245): Xaa can be any naturally occurring amino acid
  misc_feature (259)..(259): Xaa can be any naturally occurring amino acid
  misc_feature (273)..(273): Xaa can be any naturally occurring amino acid
SLRSTNPRTQPYSLPSSAPPIRPIGRGAYGIVCAAVSSDTGEEVAIKKIGNAFDNHIDAKRTLREIKLLRHMDHENILAIKDLIRPPRRDDFKDVYIVTELMDTDLHQIIRSNQSLTDDHCQYFLYQLLRGLKYVHSAXNVLHRDLKPSNLFLNANCDLKIADFGLARTTSETDLMTEYVVTRWYRAPXELLLNCSQYTAAIDVWSXGCIXGEINTRQPLFPGRDYIQQLKLITELXGSPDDSXXLDFFRSDNARRYMXKQLPQYPRQDFRLXFRNKSDGGVDLLERMLVFDPSRRITVDEALHHPYLASLHDINEEPTCPAPFSFDFEQPSFTEEHMKELIWRETLAFNPDPPY

SEQ ID NO: 2049 - protein, 609 aa, Streptomyces aureofaciens
MCGIVGVVDYDAPAEHRRDLLQAMTDTMACRGPDAEGLWFGRAAGLGHRRLSVIDPEHGRQPMTAEHEGRGAAITFSGEIYNFRELRAELTSHGHRFRTSCDTEVVLRGYLQWGAALVERLNGMFAFAVWDEHSEELLLVRDRMGVKPLYYWPTAAGVRFGSEPKAVLADRTLSRRVGPDGLCEVLDMVKTPEAAVFSGLVEVRPGQLVRVGRGGVRRQTYWRLEAREHTDDLPTTIGTVRDLLADTVTRQLVSDVPLGTLLSGGLDSSAVTALAARSGPVRSFSVDFRGAADAFASDAVRREADAPYVRELAGHVGADHLEVLLDSPGLSDPAVRSAVLRATDLPPAYWGDMWPSLYLFFRAVRENVTVALSGEAADELFGGYRWFRNPLALRAATFPWLTPGSARYFGGSSLFQAGLLDKLDLDGYRAARYAEALAEVPVLPGESAPERRMREIGHLNLTRFVQTLLDRKDRMSMAVGLEVRVPFCDHRLVEYVFNVPWEMKSFDGREKSLLRAAVADLLPRSVVERVKTPYPATQDPGYEGALRAELAGVLADPDAPVLPLLDRERALAAAARPTGAVSRPYDRGSLELVLWLNSWLAEYEVTLDL

SEQ ID NO: 2050 - protein, 506 aa, Acinetobacter calcoaceticus
MNDDTKKCPFSQLTTDFGAPVVDNQNSMTAGARGPLLAQDLWLNEKLANFVREVIPERRMHAKGSGAFGTFTVTHDITQYTRAKIFSEIGKKTEMFARFTTVAGERGAADAERDIRGFALKFYTEEGNWDMVGNNTPVFFLRDPRKFPDLNKAVKRDPKTNLRSATNNWDFWTLLPEALHQVTIVMSDRGIPASYRHMHGFSSHTYSFINSVNERFWVKFHFRTQQGIKNLTDAEAGELVGHDRESHQRDLFDAIERKDFPKWTLYVQVMPEQDAEKVPYHPFDLTKVWPHGDYPLIEVGEFELNRNPENFFLDVEQSAFAPSNLVPGISASPDRMLQARLFNYADAQRYRLGVNYQQIPVNAARCPVHSNHRDGQGRIDANYGGLPHYEPNSFGQWQEQPQYKEPPLKINGDADFWNYREDDNDYFSQPRALFELMTPEQQQALFDNTERAMGDALDFIKYRHIRNCYACHPAYGEGVAKALGLTVENAQAARETDPARGLPSFI

SEQ ID NO: 2051 - protein, 249 aa, Brassica napus
RAPRPPVFDQLMALEALSSPRLASPVPPLFEDSSRFHGVEHWTKGKRSKRSRSDFNQQNLTEEEYLAFCLLLLARDGNRSNRQPLPPVTAAEKSSSSSYKCSVCDKSFSSYQALGGHKASHRKNSSQTQSGGGDDQSTSATTTSAVTTGSGKSHVCTICHKSFPSGQALGGHKRCHYEGNNNNTSSVSNSEGAGSTSHVSISHRGFDLNIPPIPEFSLVNGDDEVMSPMPAKKPRFDFSENSTLSCYMF

SEQ ID NO: 2052 - protein, 573 aa, Cucurbita pepo
MGNTCVGPSISKNGFFESVSAAMWRSKTPENSVSNHTNGENVREVVASEPESPLPVQNQPPEKVTMPESVAKPEPPMEPKVRPVMKRVGSAGLRGGSVLQTKTGNFKEYYSLGKKLGQGQFGTTYMCVEKATGKEYACKSIAKRKLVNEDDVEDVRREIQIMHHLSGHPNVISIKGAYEDAVAVQVVMELCAGGELFDRIIQRGHYTERKAAELTRTIVGVLEACHALGVMHRDLKPENFLFVSKEEESLLKTIDFGLSMFFKPGEKFNDVVGSPYYVAPEVLRKRYGPEADVWSAGVIVYILLSGVPPFWAESEEGIFEEVLHGDLDFSSDPWPSISDSAKDLVRRMLVRDPRKRLTAYEVLCHPWVQVDGVAPDKPLDSAVLTRLKQFSAMNKLKKMAIKVIAESLSEEEIAGLKEMFKMIDTDNSGQITFEELKAGLKKFGANLKESEIYDLMQAADIDNNGTIDYGEFVAATLHLNKIEKEDHLLAAFSYFDKDGSGFITHDELQQACKEFGIEDLQMEEMMREVDQNNDGSIDYNEFVAMMQKGNVVNTGKKGLQSSFSIGFREALKL

SEQ ID NO: 2053 - protein, 367 aa, Carica papaya
QMGLAENQLCFNLIHEWLLKNPEASICTAQGAAEFRDIAIFQDYHGLAELREAVAKFMGKVRRNRASFDPDRIVMSGGATGAHEMIAFCLADPGDAFLVPTPYYPGFDRDLRWRTGVKLIPVVCESSNDYQITIEALEAAYETAQEADIKVKGLLITNPSNPLGTIITKDTLEALVTFTNHKNIHLVCDEIYAATVFSQPEFTSIAEIIEEDKICCNRDLIHIIYSLSKDMGFPGFRVGIVYSYNDAVVSCARKMSSFGLVSSQTQYLIASMLADDEFVDKFIVESRKRLAMRHSFFTQRLAQVGINCLKSNAGLFVWMDLRRLLKEQTFEAEMVLWRVIINEIKLNVSPGSSFRCSEPGWFRVCFA

SEQ ID NO: 2054 - protein, 953 aa, Bacteroides fragilis
MKYLTFPFLLLLLPLIGSGCSSEEKETDSLILSSDSEIFFEQGIDFAATSGTRNLSFSSGRPWRISLTTDTDTRRAADWCTVSPSSGTAGDASVTISIQENADYDSRSVKLTLVAGGIEKSFTVSQKQKDALTLTASRFEVGKEGGTVQVEVKANITFEVEIPEVDRSWISQANTRGLVVTNLAFTVAPNEGVAGREGEIVIRSGSLSEKIRITQEGRCDDGLSFRPETPDADRQLTLYFKATKTSPLYGYAGDVYVHTGVVSEGTWMYVPAEWNTNVDKCKMVRVADNIWSITLAPSIRQWFGSNETPVRQLGVVIRSADGSKKGTDGDSFVSVTDHLYKPFEPAAVRYASMPGGLQEGINLIDASTVTLVLYDKDKKGGHKDFAHVVGDFNDWKLSNESNSQMNRDDAAGCWWITLTGLQPTREYAFQYYVGTRAGEILRLADAYSRKILDPDNDKYIPSSTYPDAKEYPKGAVGIASVFKIQRDSYEWKVKNFRIPDKNNLMIYELLLRDFTATGDLNGAMEKIGYLKSLGFNAVELMPVQEFDGNDSWGYNPCFHFALDKAYGTDHMYKAFIDKCHEVGMAVLFDVVYNHASGSHPFARLYWDTKNNRTAADNPWFNVKEPHPYGVFHDFNHDSPLVRAFVKRNLKFLLEEYRIDGFRFDMTKGFTQNSSTEATAGSYDASRIAILKDYNETVREVNPEAVVILEHFCDEKEESELAEEGMQLWRNLNNAYCQSAMGYPSNSDFTPLVTFGTTMPYGGWVGFMESHDEERTAFKQIAYGEGPLKSDINVRMKQLAANASFFFTAPGPKMVWQFGEMGYDVSIEEGGRTGRKPLHWEYLDNEARKGLCNTYAKLLKLRREHSELFNPGSTFSWLVKTANWTGGRFLTLAATNGKRLVVVGNFTAKPIEAITSFPVTGVWTNYLDGTKLHVTSIPTGLMIPAHECRVYINF

SEQ ID NO: 2055 - protein, 206 aa, Glycine max
  misc_feature (78)..(78): Xaa can be any naturally occurring amino acid
TSSPSKAKFSFHSVSKGYYGECGQRGGYFEMTNIPPETVDEIYKVASISLSPNVPAQIFMGVMLNPPQPGDISYDKLXRESTGILESLRRRARIMTDGFNSCRNVVCNFTEGAMYSFPQIRLPPRALEAAKQAGKVPDVYYCLKLLEATGISTVPGSGFGQKKGVFHLRTTILPAEEDMPDIMDSFKKFNDEFMEQYEDDRGYSRL

SEQ ID NO: 2056 - protein, 367 aa, Carica papaya
QMGLAENQVSFDLLEEYLEQHSEASTWGKGAPRFRENALFQDYHGLKSFRQAMASFMEQIRGGRAKFDPERIVLTAGATAANELLTFILANPGDALLVPTPYYPGFDRDLRWRTGVKIVPIHCDSSNNFQITPEALESAYNEAESMNMRVRGILITNPSNPLGITIPRHVLEQLLDFVTLKNIHLISDETYSGSVFTSPDFTSVAEILHSRNNVAECAERVHIVYSLSKDLGLPGFRVGTIYSYNDKVVTTARRMSSFTLIFSQTQHLLASMLSNQKFTENYINTNRDRLRRRYEMIVEGLRSAGIECLKGNAGLFCWMNLSSFLDEPTREAELNLWDSILHRVKLNISPGSSCHCSEPGWFRVCFA

SEQ ID NO: 2057 - protein, 487 aa, Oryza sativa
MMLKDLAEIQQQQLLAAAEENMSNLTSASGDQASVSSHPAPPPAKKKRSLPGNPDPEAEVIALSPRTLMATNRYVCEICGKGFQRDQNLQLHRRGHNLPWKLKQRNPKEVVRKKVYVCPEPGCVHHDPARALGDLTGIKKHFSRKHGEKKWKCDKCSKRYAVHSDWKAHSKVCGTREYRCDCGTLFSRRDSFITHRAFCDALAEESARAVTAAAAVAGQQQHGGGMLFSQVADVLDHQAAMAMGGHGLMQELCLKREQQQQQQQFAPSWLTAQQQQQQLEAMAGAGNPAAMYGSARLDQEFIGSSTPESGGAQQAGLSFGFSSTSSAPPHPAASSAHMSATALLQKAAQMGATLSRPSSHAHMAAAAAASTHNSSSSAATTNAPPPPPTSNVSSTCVGAGGYGLAFEASHFIAADESSRGARSDRDTGNGVAGAGNDGLTRDFLGLRAFSHGNIMSMAGFDPCMSTTSASSAAPYDHHHHSNKPWHS

SEQ ID NO: 2058 - protein, 484 aa, Xylella fastidiosa
MRVVGLSLAISVVLLSFSLSAKNPSGVVMSPPVEEMEMPESNDVNVPLDEIRRFVSVYNAIKQAYVDPVNDRKLMHSAVRGLLSDLDPHSTYFDKEDADAFDEQTSGVYDGIGVELQEQSDNTLKVIAPIDDTPAARAGLRPGDLIVAINGKPLANVDAMKPLRGAPGSQVTLTIVRDKNGKPFDMTIKRETIHIASVRSRMLEPGYGYIRISVFQADTGNDFHKHLGQLKQQAGGRLRGLLLDLRSNPGGLLTAAVQVADALLDKGNIVSTRGRISASDTRFDATPGDLLDGLPLVVLVDAGSASASEVLVGALSDNHRARVIGSCTFGKGSVQTLLPLDNGDSVKLTTARYYTPSGRSIQARGIVPDLLLKPDGVGAADLSGSGIDRSEAGLPGHLRGTDEGVPGCTSSDPLPGDTPIMTALLELKQPGSAVQAKKAIPVKVVSDVKSATKSPLSVFGKDRAVKRVPVVSPTSEQVDGQPSK

SEQ ID NO: 2059 - protein, 392 aa, Spathiphyllum wallisii
PYEVPMTAAGALQSYKLAAKAISRLQSLPGGSMQKLTDTVVQEVFELTGYDRVMAYKFHEDDHGEVVSEITKPGLEPYLGLHYPATDIPQAARFLFMKNKVRMICDCHAKPVKVYQDEKLTFDLTFCGSTLRAPHSCHLLYMKNMNSIASLVMAVVVNEGDEEDEPLEHGQQLQQKRKRLWGLVVCHNTTPRFVPFLLRYACEFLMQVFAIHVNKEFELENQIREKNILRTQTLLCDMLLRDAPLGIISRSPNIKDLVKCDGAALLYQNKIWRLGSTPTESHIRDIASWLSEYHMDSTGLSTDSLYDAGYPGALTLGDAVCGMAAARITSKDILFWFRSHTAAEIRWGGAKHDPADEDDGRRMHPRSSFKAFLEVVKTRCLPWKDYEMEAIH

SEQ ID NO: 2060 - protein, 1356 aa, Oryza sativa
MGSEAAAAARAVVVAVNGERYEAVGVDPSTTLLEFLRTRTPVRGPKLGCGEGGCGACVVVVSKYDAVADEVTEFSASSCLTLLGSLHHCAVTTSEGIGNSRDGFHAVQRRLSGFHASQCGFCTPGMCMSIYSALAKADKASGRPAPPTGFSKITAAEAEKAVSGNLCRCTGYRPIVDACKSFAADVDLEDLGLNAFWKKGVDDEHADINKLPAYSGGAAVCTFPEFLKSEIRSSMGQANGDTSAVVVTGDGWFHPKSVEEFHRLFDSNLFDERSVKIVASNTGSGVYKDQDLHDKYINISQIPELSAINRSSKGVEIGAVVSISQAIDILSDGGAVFRKIADHLSKVASPFVRNTATIGGNIIMAQRLSFSSDIATVLLAAGSTVTIQVAAKRMCITLEEFLKQPPCDSRTLLVSISIPDWGSDDGITFQTFRAAPRPLGNAVSYVNSAFLARSSVDGSSGSHLIEDVCLAFGPFGAKHAIRAREVEKFLKGKLVSAPVILEAVRLLKGVVSPAEGTTHPEYRVSLAVSYLFKFLSSLTNGLDEPENANVPNGSFTNGTANGIVDSSPEKHSNVDSSYLPIKSRQEMVFSDEYRPIGKPIEKTGAELQASGEAVYVDDISAPKDCLYGAFIYSTHPHAHIKGVNFRSSLASQKVITVITLKDIPTNGKNIGSCSPMLGDEALFVDPVSEFAGQNIGVVIAETQKYAYMAAKQSVIEYSTENLQPPILTVEDAVQHNSYFQVPPFLAPTPIGEFNQAMSEADHKIIDGEVKLESQYYFYMETQTALAIPDEDNCITLYVSAQLPEITQNTVARCLGIPYHNVRIITRRVGGGFGGKAMKAIHVATACAVAAFKLRRPVRMYLDRKTDMIMAGGRHPMKVKYSVGFKSDGKITGLHVDLRINCGISPDCSPALPVAIVGALKKYNWGALSFDIKLCKTNVSSKSAMRAPGDAQGSFIAEAIVEHIASTLSVDTNAIRRKNLHDFESLKVFYGNSAGDPSTYSLVTIFDKLASSPEYQQRAAVVEHFNAGSRWKKRGISCVPITYDVRLRPSPGKVSIMNDGSIAVEVGGVEIGQGLWTKVKQMTAFALGQLCDDGGEGLLDKVRVIQADTLSMIQGGFTGGSTTSETSCEAVRKSCAALVERLKPIKEKAGTLPWKSLIAQASMASVKLTEHAYWTPDPTFTSYLNYGAAISEVEVDVLTGETTILRSDLVYDCGQSLNPAVDLGQVEGAFVQGIGFFTNEEYTTNSDGLVINDGTWTYKIPTVDTIPKQFNVELINSARDHKRVLSSKASGEPPLLLASSVHCAMREAIRAARKEFAGAGGSSLTFQMDVPATMPIVKELCGLDVVERDLESFAAKA

SEQ ID NO: 2061 - protein, 423 aa, Debaryomyces hansenii
MTGIQISSLKNTDLFKSLKVGQNTLSNKVVYPPTTRMRALEDHTPSDLELEYYGSRSKYPGSLLIAEATFVSEQAGLNGSVPSTWNSEPAGYVPGIWNEKHVKGWKKITDRVHENDSFISSQFWFLGRVGDPQLLKDHGLDYVAPSAIYPDQDFRNKAEAAENPLRALTEEEIHELIYETYTNAAKNAIAAGFDYIELHAAHGYLLDQFLNPATNQRTDKYGGSIENRARLVLELVDHLTTLVGASKLAIRISPWAKFQGMDAEKDSTHPITTLSYVLHELQKRADNGKGLAYVSVVEPRAQGGDDVEKSQQVGDNTFVGQIWKGVILKSGNYTYDAPNFKTLLNDISDNRTMVGFARYYTSNPDLVKRLYEGWDLTPYDRLTFYGSSNWGYNTFNSYNENREFTKDVESDILPEAIEEIDVK

SEQ ID NO: 2062 - protein, 465 aa, Spathiphyllum wallisii
SGKPFYAIMHRIDMGLIIDLEPVNPADVPVTAAGALKSYKLAAKAISRLQSLPSGNISLLCDVLVREVRELTGYGRVMAYKFHEDEHGEVVSECRRPDLEPYLGLHYPATDIPQASRFLFMKNKVRMICDCSAQPIKVIQDKRLAQPLSLCGSTLRAPHGCHAQYMANMGSIGSLVMSVTINEDEDDDSSGEQQQKGRKLWGLVVCHHTSPRFVPFPLRYACEFLMQVFAIQLNKEVELAAQTREKHILRTQTLLCDMLLRDTPVGIFTQSPNVMDLVKCDGAALYYQNQFWLLRVTPTEAQIRDIAAWLIDCHNSTTGLSTDSLSEAGYPSASTLGDAVCGMAAIKITSRDLIFWFRSHTAKEIKWGGAKHDPVDRDDDGRKMHPRSSFKAFLEVVKRRSLPWEDVEMDAIHSLQLILRSSLQDENVRDNSKGIVNVISDDAKKIQGVDELRTVANEMVRLMET

SEQ ID NO: 2063 - protein, 1355 aa, Oryza sativa
MGSEAAAARPVVVTVNGERYEAVGVDPSTTLLEFLRTRTPVRGPKLGCGEGGCGACVVVVSKYDAVADEVTEFSASSCLTLLGSLHHCAVTTSEGIGNSRDGFHAVQRRLSGFHASQCGFCTPGMCMSIYSALAKADRCSSRPSPPPGFSKLTAAEAEKAVSGNLCRCTGYRPIVDACKSFAADVDLEDLGLNAFWKKGADDERADVGKLPAYSGGAAVCTFPEFLKSEIRSSMGQANGGAPAVAVTGDGWFHPKSVEEFHRLFDSNLFDERSVKIVASNTGSGVYKDQDLHDKYINISQILELSAINRSSKGVEIGAVVSISKAIEILSDGGAVFRKIADHLSKVASSFVQNTATIGGNIIMAQRLSFPSDIATVLLAAGSTVTIQVAAKRMCITLEEFLKQPPCDSRTLLVSISIPDWGSDDGITFESFRAAPRPLGNAVSYVNSAFLARSSVDGSSGSHLIEDVCLAFGAFGAEHAIRAREVEEFLKGKLVSAPVILEAVRLLKGVVSPAEGTTHPEYRVSLAVSYLFRFLTSLANGLDEPENANVPNGSCTNGTANGSANSSPEKHSNVDSSDLPIKSRQEMVFSDEYKPVGKPIEKTGAELQASGEAVYVDDIPAPKDCLYGAFIYSTHPHAHIKDINFRSSLASQKVITVITAKDIPTGGENIGSCFPMLGDEALFVHPVSEFAGQNIGVVIAETQKYAYMAAKQAVIEYSTENLQPPILTIEDAVQHNSYFPVPPFLAPTPIGDFNQAMSEADHKIIDGEVKLESQYYFYMETQTALAIPDEDNCITLYVSAQLPEITQNTVARCLGIPYHNVRIITRRVGGGFGGKAMKAIHVAAACAVAAFKLRRPVRMYLDRKTDMIMAGGRHPMKVKYSVGFKSDGKITGLHFDLGMNGGISPDCSPVLPVAIVGALKKYNWGALSFDIKVCKTNVSSKSAMRAPGDAQGSFIAEAIVEHIASTLSVDTNAIRRKNLHDFESLKVFYGNSAGDPSTYSLVTIFDKLASSPEYQQRAAMVEHFNAGNRWKKRGISCVPITYDVRLRPTPGKVSIMNDGSIAVEVGGVEIGQGLWTKVKQMTAFALGQLCDDGGEGLIDKVRVIQADTLSMIQGGFTGGSTTSETSCEAVRKSCAALVERLKPIKEKAGTPPWKSLIAQASMASVKLTEHAYWTPDPTFTSYLNYGAAISEVEVDVLTGETTILRSDLVYDCGQSLNPAVDLGQVEGAFVQGIGFFTNEEYTTNSDGLVINDGTWTYKIPTVDTIPKQFNVELINSARDHKRVLSSKASGEPPLLLASSVHCAMREAIRAARKEFAGAGGSPLTFQMDVPATMPIVKELCGLDVVERYLESFAAKA

SEQ ID NO: 2064 - protein, 467 aa, Tacca chantieri
SGKPFYAIIHRVTACLIVDFEPVKPSELPMTAAGALQSYKLAAKAIARLQSLPGGSMERLCDTVIEEVFELTGYDRVMVYKFHEDDHGEVFREITKPGLEPYQGLHYPATDIPQAARFLFMKNKVRMICDCRAKPVKIYQDDKLPLDLTFCGSTLRAPHSCHLQYMENMNSIASLVMAEVVNEGEEDDENLEPGQTQQQKKKRLWGLVVCHHESPRFVPFPLRYACEFLMQVFAIHVNKEFELENQIREKNILRTQTLLCDMLLRDTTPVGIMNQSPNIMDLVKCDGAALLYQNKVWRLGLTPTEAQIRDIAYWLAEYHMDSTGLSTDSLHDAGYPGALGLADVVCGMAAARITSKDMLFWFRSHIAAEIRWGGAKHDPADKDDGRRMHPRTSFKAFLEAVKMRSLPWKDYEMDAIHSLQLILRGTFSDSRNVNSRASLDARVNDLKLEGMVELQAVTNEMVRLMET

SEQ ID NO: 2065 - protein, 465 aa, Tetracentron sinense
SGKPFYAIVHRVTGSLIIDFEPVKPYEVPMTAAGALQSYKLAAKAIARLQSLPSGSIERLCDTVVQEVFELTGYDRAMVYKFHEDDHGEVVSEITKPGLEPYLGLHYPATDIPQAARFLFMKNKVRMICDCRAKHVKVLQDEKLPFDLTLCGSTLRAPHSCHLQYMENMNSIASLVMAVVVNEEDEEGESSSSEQSQKRKKLWGLLVCHHTTPRFVPFPLRYACEFLAQVFAIHVNKELELENQILEKNILRTQTLLCDMLMRDAPLGIVSQSPNIMDLVKCDGAVLLYKNRIWQLGSTPSEFHIHDITSWLSEYHMDSTGLSTDSLYDAGFPGALALGDGVCGMAAVRITSKDMLFWFRSHTAAEVRWGGAKHEPGEKDDGRKMHPRSSFKAFLEVVKTRSLPWKDYEMDAIHSLQLILRNAFKDVENEGLNTSTIRTQLNDLSIEGTEELEAVTNEMVRLMET

SEQ ID NO: 2066 - protein, 682 aa, Cryptococcus neoformans
MTAVSLSDGTAVLKTDPWLEPFSGALRERYAAYQKQRTIIEEHEGGLAEFSKGYKSMGFQIDKNGGVRYREWASNATEARLIGEFNNWSHTANPMTKSPFGVWECYVPPVSPGVCAIPHDSMVKISMTLPGGESIDRIPTWITRVTQDLNISPIYDGRFWNPPKEQQYQFKHGHSTRPVEGLKIYEAHVGISSPNMRVTTYKEFEVDVLPKIKQLGYNCIQMMAIMEHAYYASFGYQVTNFFAASSRFGTPEELKSLVDKAHELGLTVLLDVVHSHASKNILDGINMYDGSDHLYFHEGGRGRHDQWDSRLFNYGQHEVLRFLLSNLRFWMDIYMFDGFRFDGVTSMMYKHHGIGSGFSGGYHEYFGDSVDLEAMVYLMLANAMLHETYPHVVTIAEDVSGMPTLCRPVAEGGVGFDYRLSMAIPDMWIKLLKEYTDDQWEMGQIVHNLTNRRHLEKSVAYAESHDQALVGDKTLAFWLMDKEMYDFMSDLSPLTPIIDRGLALHKMIRFIVHTLGGEAYLNFEGNEFGHPEWMDFPREGNGNSFAHARRQFNLVDDKLLRYKYLYEFDVAMNWLEDKYKWLNSPQAYVSLKHEGDKMIVFERAGLLFIFNFHPTQSFTDYRVGVDTAGEYKVILTSDETRFGGHNRIDMGGRYFTTPMEWNGRKNWLQVYSPSRTVLVLGL

SEQ ID NO: 2067 - protein, 390 aa, Tetracentron sinense
DLEPVNPADVPVTAAGALKSYKLAAKAISRLQSLPSGNLSLLRDVLVQEVSDLTGYDRVMVYKFHEDEHGEVVAECLISDLEPYLGLHYPATDIPQASRFLFMKNKIRMICDCLAPPVKVIQDKRLVQPLSLCGSTLRAPHGCHAQYMENMGSIASLVMSVTINDDDDEIESDKRGRKLWGLVVCHHTSPRFVPFPLRYACEFLIQVFGIQLNKEVELVAQLREKQTLRTQTVLCDMLLRDAPVGIVTQSPNVMELVKCDGAALYYRSTFWLLGVTPTEAQIRDIAEWLLEYHNGSTGLSTDSFMEAGYPGAAVLGDAVCGMSAVKITSKDFLFWFRSHTAKEIKWGGAKHDPFDKDDGKKMHPRSSFKAFLEVVKWRSLPWEDMEMDAI

SEQ ID NO: 2068 - protein, 305 aa, Arabidopsis thaliana
YSFINVYTHLFTSTTLPSIFHFLQLLQISYFPENHFPKKNKTFPFVLLPPTAITAYQSELGGDSSPLRKSGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQSQPFDSRNYFQVAALQPNNHHYSSAGRQDQTALQLV

SEQ ID NO: 2069 - protein, 221 aa, Ginkgo biloba
MGRGKIEIKRIENTTNRQVTFCKRRNGLLKKAYELSVLCDAEVALIVFSSRGRLYEFANNSVKRTIDRYKKTCADNSQGGAISECNSQYWQQEAGKLRQQIDILQNANRHLMGDALTSLSVKELKQLEIRLERGISRVRSKKNEMLLEEIEIMQRREHILLAENQFLRTKIAECESSQNANMLPGPEFDALPGFDSRHFLHASIMDAHHYAQQDQTALQLG

SEQ ID NO: 2070 - protein, 372 aa, Unknown
  Malus x domestica
  misc_feature (21)..(21): Xaa can be any naturally occurring amino acid
  misc_feature (23)..(23): Xaa can be any naturally occurring amino acid
RIRPLVGRYVPPEVVALRVPXLXLSNFQINDWPDVSAKSYAIMVLILPTDGTRKWREHELELVDVVADQVAVALSHAAILEESMRARKQLTEQNDALDLAWREAEMAIHARDDFLAVMNHEMRTPMHAIIALSSLLLETELTPEERLMIETALKSSNLLETLVNDVLDLSRLEDDSLELDTERFNLHGVFREVMNLVQPVASVKKLSMTLIQSPDLPVYAVGDENRLLQTILNVAGNAVKFTKQGYISITASVAKSESSRDWQPPEFYPASTDGYFYLRVQVKDSGCGVLPEDIPHLFTKFSQPRNGSNQININNGAGLGLAICKRFVNTMGGHIWIESEGIDRGSIVAFIVQLGICDNHSDTTTHQVQIAT

SEQ ID NO: 2071 - protein, 354 aa, Hordeum vulgare
RRSRPWSPELWMQRKQDILQGSIKSRSRAHDIITKMLASLGDPYTRFLSSSDFSKMSKYDMTGIGLNIREIPDDNGSLRLVVLGLILDGPANSAGVRQGDELLSVNGSDVRGKSAFDVSSMLQGPKETFVTIKVKHGNCGPVESMKVQRQMAARTPIFYRLEKRDNENSSVGYIHIKEFNAVAKKDLVSALKRLQNSGASYFVLDLRDNLGGLVQAGIEIAKLFLNKGDTVIYTTAGDRQVQNTIVADSGPLVTTPVMVLVNNRTASASEIVASALHDNCKSCVSSARRTFGKGLIQSVFELHDGSGIVVTVGKYVTPNHKDINGDGIKPDYRRLPDLNEARDYLLRCQSKKLS

SEQ ID NO: 2072 - protein, 551 aa, Oryza sativa
MLTRTITYCMVSVTHRIHHPSIMNKLFSTAWILRHVLRWFKVKMDGNAKGGGHSEALKNYNLGRTLGIGSFGKVKIAEHKLTGHRVAIKILNRRQMRNMEMEEKAKREIKILRLFIHPHIIRLYEVIYTPTDIYVVMEYCKFGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIREHQWFQIRLPRYLAVPPPDTAQQAKMIDEDTLQDVVNLGYGKDHVCESLRNRLQNEATVAYYLLLDNRFRATSGYLGADYQESLERNFNRFASSESASSNTRHYLPGSSDPHASGLRPHYPVERKWALGLQSRAQPREIMIEVLKALQDLNVSWKKNGQYNMKCRWSVGTQATDMLDVNNSFVDDSIIMDNGDVNGRLPAVIKFEIQLYKTRDEKYLLDMQRVTGPQLLFLDFCADFLTKLRVL

SEQ ID NO: 2073 - protein, 135 aa, Zea mays
MRRHRIVSLLAALLVLLALAAVSSTRSAQEESVADNAGMLAGGIKDVPANENDLQLQELARFAVNEHNKKANALLGFEKLVKAKTQVVAGTMYYLTIEAKDGEVKKLYEAKVWEKPWENFKQLQEFKPVEEGASA

SEQ ID NO: 2074 - protein, 445 aa, Desulfotalea psychrophila
MPLRKKQWGEDMRTDIVHIGAGELTYEIRNIVEVGQRLQRLGVEVNWENIGDPIAKGEEVPSWMKALVAEAVQDDASYGYSPTKGVLATRRFIAAETNKKGAVQISAEDIIFFNGLGDAISKIFGFLKRTARVLVPTPSYTTHSSAEAAHSGDKPLTYKLDPHNDWYPDIADIERRVKYNPMVAGILIINPDNPTGAVYPVEILRAIVDIARRYDLFLICDEVYQNIIYNGKKTASLAEVIGEVPGFAMRGASKEMPWPGARCGWIEVYNADRDPMFQRYIDSIFNAKMLEVCSTTLPQIVYPRVVTHAEYPGYLQSRIARYQRFSKIAYDCLKDIEGILVNQANGAFYMSVCFEDGVLNSGQSLAIARDEVRTMVEDLVFSADTALDKRFVYYLLGATGVCVVPLTSFASDINGFRVTLLERDEAEFIRIFTVIAAAIRTYLKS

SEQ ID NO: 2075 - protein, 490 aa, Hordeum vulgare
MVVTVAATGPDTAETLHSTTFASRYVRDQLPRYRMPENSIPKEAAYQIISDELMLDGNPRLNLASFVTTWMEPECGKLIMDSVNKNYVDMDEYPVTTELQDRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVEKNKETGWNVPIHVDAASGGFIAPFLQPELEWDFRLPLVKSINVSGHKYGLVYPGVGWVIWRSKDDLPEELIFHINYLGADQPTFTLNFSKGQQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIIGELDAHAVHAIKLSTAAAGGDGASKSAVDAATEAFKDLAGKKKAGVC

SEQ ID NO: 2076 - protein, 119 aa, Glycine max
  misc_feature (96)..(96): Xaa can be any naturally occurring amino acid
MAASPSSSAAANIMLAIFEKKTNSVDLYRPLRNYVAFHYSEREAQNLEDDLQTLKQLRSDVERHSDPSLPTRRDLLQTYYKSLCLVETRFPISFDXDHVNALPLSGSTAFKAQQNALQQ

SEQ ID NO: 2077 - protein, 528 aa, Aspergillus nidulans
MVTTAQSQCRHATEVRPPEACLWPQTRFFFRNSSTSTGRSCWSAWFILANSSGGSGAFGHFEVTKDVSDLTKAHFLRSPGIKTPVFIRFSTVTLGREYPDLARNPRGFAVKFYTGEGNYDIVGLNFPVFFCRDPIQGPDVIRSQYRNPQNFLLDHNSLFDLLANTPEGNHAGMMFFSDHGTPAGWQNIHGYGCHTFKWVNAEGKFVYIKYHFLADHGQKQFNADEALRYGGEDPDYSKRELWRTIENGKELSWTAYVQVMKPEDADPEKLGFDPFDVTKVWPKKQFPLQEFGKLTLNKNPENFHRDVEQAAFSPGSMVPGIEDSPDPLLQFRMFFYRDAQYHRIGVNLHQVPVNCPFMASSYSSLNFDGQLRVDANHAMNPQYAPNSFVHKFRTDTAEAPYQLADGTVSRKSHFFHEGKASEYDQPRELYERVMDEKARQHLHTNTARLLKLVEYPKIQAKYLGQLLRISEKYARGVYDLLPEKKFGFDEVQSFAKGAEVAGKEAKFRPNMPTDKLLGLCPAMAVYGP

SEQ ID NO: 2078 - protein, 637 aa, Adiantum capillus-veneris
MACTIVWFRRDLRVEDNPALVAAVRAGTVVPLFIWTPEEEGQFLPGRVSRWWLKQSLIQLHQSLTSLGSPLIMRRAQSAISVLSQIIKQTGATQVFFNHLYDPVSLVRDHKVKQELLQAGVTVTTFNADLLYEPWEINDEQGRPFTTFAGFWSLCMDMAIEPEAPLLPPKRITKWPGIAATSPIEDLELENESEKGSNDLLARAWAPGWANADRALEAFVSGPLMEYASNRQKVDSATTSLLSPHLHYGELSVRKVFHSVRMKQVLWVKEGNADAEESVNLFLRSIGLREYSRYLCFNFPFTHERSLLSNLKFFPWRNDEGYFKVWRQGRTGYPLVDAGMRELWATGWLHNRIRVIVSSFFVKFLQLPWRWGMKYFWDTLLDADLESDVLGWQYISGSLPDGHELYRIDNPQLEGYRYDPCGEYVRRWLPELSRLPSEWIHHPWDAPPNVLRAAGIELGSNYPRPIVEVAAARERLEQALAEMMEKEAAATRAAFEGSLQGVGLEPSQADNMDIDRGPSDAPGRNLSDRSPHDQMVPSMFMETGRPAADGVGSHASERGANVQEAHDNGSAPVASREGGSCRRNWQPFKVGTVTPTLLRSHHLRTGITLSLPLQVYQLGRAIGHLIQLCIRMTLRYL

SEQ ID NO: 2079 - protein, 679 aa, Adiantum capillus-veneris
MAAHTIVAHTIVWFRRDLRIEDNPALVAAVRAGPVLPVFIWSPEEEGQFLPGRVSRWWLKQSLVHLNESLTILGAPLVMRRASNVLAALLEIKKATGATQVFYNHLYDPVSLVRDHRVKQGLSQAGIIVNSFNADLLYEPWEVNDDNGQAFTTFSGFWAKCMDMPAEPEAQILPPKRILKFPGPSLSCSIEDLDLEDELEKGSNALLARAWQPGWANADRALESFINGSLMEYAANRQKVDSATTSLLSPHLHYGEVSVRKIFHNVRMKQVLWVKEGRVEAEESVNLFLRSIGFREYSRYLSFNFPFTHERSLLYNLKFFPWRVDESYFKAWRQGRTGYPLVDAGMRELWATGWLHNQIRVIVSSFCVKFLQLPWRWGMKYFWDTLLDADLESDVLGWQYISGSLPDGHELDRIDNPQIEGYKFDPYGEYVRRWLPELSRLPTEWIHHPWDAPPSVLRAAGIELGSNYPRPIVEIAAARERLEQALAEMWANEAADKATLANGLEEGLGDTVEVQGMRNGFPANMDIDRGPGEKALLVRSPHDQMVPNVGVRRSTTGAVQGGAANQGSALQAVLREVPANGHVQAVQAQSQRMAAPPMAMQNGYDDTHSTAESTSARHWSLAIGLPVWSQYVPVCLHMRQDDSQVPLVPDLHHGVMSRRLPHAPPMVNFEATKTSSLSV

SEQ ID NO: 2080 - protein, 605 aa, Caulobacter crescentus
MAPSKGEDSRLVRIALTEAYVPIARGYLLAAAIYNSLIAIAHPFYEKGLAFVMLTSLTGATAIYAFSAWFLLRRRRIVGGHLEWLVLGMNALFLGHVTAFHLFHLEPQKLIYFVLLALVFATSAPSRRVANVSVGAALVSLVFIARGAPGDMVNQYLFVGLAGAFAAVGMSTLMRGVVGREVRARLASQALNDELERELTENRRLRTEAQALALAAEKANRAKSEFLATMSHEIRTPLNGVLGMAQIMASGKLQVDQRRRLETITASGQSLLGLINTILDVSRIEDGKMEIVEGPFDLTAQMHTLSLLYGGLARDKHLDFSLEVSPTVAGCRQGDGERLRQVLSNLISNAIKFTDSGAVRVTLDGDDQGLVARVLDTGVGIPEAQRERLFTKFAQLDSSSTRRVGGSGLGLAICKSLAELMGGEIRFLAPAEGGACFELTLPMARIDPPPAVAAPPAPALAPASADEDAAPRILVVDDNQTNRAVLLTLLGHLGADAHFAVDGRDAVAMWEQDRWDVILMDIHMPEMDGLQACQVIREGERQGGRLRTPVVAVTASVLPHERSLYVEAGMDAVVPKPVEVPKLLEVLANVLADADEAAVETRGAA

SEQ ID NO: 2081 - protein, 718 aa, Adiantum capillus-veneris
MAKSCTVVWFRRDLRLEDNPALAAAARAGAVVPVFIWSPDEEGQFRPGRVSRWWLKQSLIQLDISLRSLGVSLVMINANDTVSALLELVKTTGASQVVYNHLYDPVSLVRDHRVKQSLVQNGIQVQSFNGDLLYEPWEVLDDHGKPFTYFESYWAKCLTMPFEPESPLLPPRRLTAAPAGIVHSLTPDELGLEDEADKSSNALLARAWAPGWSNADKALEAFLAGPFLNYSRNRHEIDGPTTSLLSPHLHFGEVSVRKVFHSVRRLQVLWAKDGSMLGEESINYFMRSIGFREYSRYLCFNFPFTHERSLLSNLKSFPWRVDEGLFKAWRQGRTGYPLVDAGMRELWATGWLHNRVRVIVSSFCVKFLQLPWRWGMKYFWDTLLDADLESDILGWQYISGSLPDGHELDRMDNPQTEGYKHDPLGEYVRRWLPELVRLPTEWIHHPWDAPPGVLRAAGVELGSNYPRPVVEVAAARERLRDAVTHMWEQEAALKAAGDKGIEEASVGDSIAKVNCQPEVAAQPCKIPKASVSQATNGDMEVSSAGSSRRDQMVPTFAKELKTQADALCGDYGSIALPLPSQQNLPCPSTNFSAIRGVSKLSPGNRGDMVDTTEALRNTHSEPLPPVSDTNPMTESSSSSSPREQISSIKDDPPMIWVPAIAHQRPSSDFGCVPYAGDAEQLRKHLLILQNARTDDKVEDGVQLNGSQWARGSKRKAKS

SEQ ID NO: 2082 - protein, 610 aa, Pseudomonas aeruginosa
MCGITGWTDWSRDLGEQRSILERMTRTLAPRGPDAEGLWLSRHALLGHRRLAIIDLENGAQPMLAEAGGRVALTYSGEVYNFRELRAELETLGQVFRTRSDTEVVLRAYLQWGEASFARLRGIYGFALWDEREQSLWLVRDRFGVKPLYYYPTAGGVLFASEPKAIFANPEANPVLDASGIAELFALTTAPTPGHGLYKGLRQVRPGQALRFDRNGVRELVYWALRAERHEEGAEDSAERAGQLLREAVAEQLVADVPLGSLLSGGLDSSAISAFAVAALDGDARRLPTFSVDFPGEGRGFVPTPWQSSWDEPYAQLAANFLGTPHRTVLVAPEEVLEQDEAVLQARDLPGWGELDASLYLLFRQVREHTTVALSGESADEVFGGYPFFHDPSALAHDGFPWLAGKSGPWQLLRREVAERVAAPEYIRARYREALAEVPRLDGEDAAQRRQREVAYLALSRWLPAMLERKDRMSMAVGLEVRVPFCDHRLVEYVWNLPWALKSVAGESKSLLRRALRGHLPQAILERRKSGFPANPDPRYLALLRERVGRLLADGRSPLFELVDAGRVRQALEQGTPLPSPRASASPTAGLAYLLNLDRWLTRHGVDISL

SEQ ID NO: 2083 - protein, 481 aa, Unknown
  Bradyrhizobium sp. BTAi1
MSFSPIVVWFRESLRLSDHPALHAAATSGAPVICCYVYDTESAALRPLGGASRWWLAQSLRALQDELDALGVKLVIRRGPSAKAISELAREASTSAVYWNDVAQTGPRAVAAEVEAALDAIGVKSRVFADDLLIDPAELRGKDGRGPRVFTPFWKRVLALGDPPKPLPVPVRLSSPSGVASLTVDKLALEPTSPDWAGGLRTTWRAGERAAQARLAKFLETTVRGYAADRDRPDIEATSRLSPHLRFGEISPRQIWHAARFAAEQQPAFARGIDKFLSELGWREFSRHLLFNNPDLATRNLQPSFDAFPWSQDAAALRAWQRGQTGYPIVDAGMRELWHTGSMHNRVRMVAASLLVKHLLIDWRLGEQWFWDTLVDADPGSNPASWQWVAGSGADAAPYFRVFNPVLQGEKFDSSGTYVRRWVPELARLPAALIHQPWAAKPLELAEAGVVLGRSYPAPVVDHRHGRERALAAYASLRTSD

SEQ ID NO: 2084 - protein, 276 aa, Bacillus subtilis
MPTSLKDTVKLHNGVEMPWFGLGVFKVENGNEATESVKAAIKNGYRSIDTAAIYKNEEGVGIGIKESGVAREELFITSKVWNEDQGYETTLAAFEKSLERLQLDYLDLYLIHWPGKDKYKDTWRALEKLYKDGKIRAIGVSNFQVHHLEELLKDAEIKPMVNQVEFHPRLTQKELRDYCKGQGIQLEAWSPLMQGQLLDNEVLTQIAEKHNKSVAQVILRWDLQHGVVTIPKSIKEHRIIENADIFDFELSQEDMDKIDALNKDERVGPNPDELLF

SEQ ID NO: 2085 - protein, 482 aa, Vibrio fischeri
MSKKLTTAAGCPVAHNQNVQTAGKRGPQLLQDVWFLEKLAHFDREVIPERRMHAKGSGAYGTFTVTHDITKYTKAKLFSEIGKQTELFARFTTVAGERGAADAERDIRGFALKFYTEEGNWDLVGNNTPVFFLRDPLKFPDLNHAVKRDPRTNMRSAKNNWDFWTSLPEALHQVTIVMSDRGIPATYRHMHGFGSHTFSFINSDNERFWVKFHFKSQQGIKNLSDAEAAQVIGQDRESHQRDLLESIDNQDFPKWTLKVQIMPEADAATVPYNPFDLTKVWPHKDYPLIEVGEFELNRNPQNFFAEVEQSAFNPANVVPGISFSPDKMLQGRLFAYGDAQRYRLGVNHQHIPVNAPRCPVHSYHRDGAMRVDGNFGSTLGYEPNNEGQWAEQPDFAEPALNLDGAAAHWDHREDEDYFSQPGDLFRLMTAEQQAILFDNTARNLNGVPKEIQLRHLRHCYKADPAYGEGIGKLLDIDVSEFN

SEQ ID NO: 2086 - protein, 465 aa, Xanthorhiza simplicissima
SGKPFYAIVHRVTGSLIIDFEPVKPYEVPMTAAGALQSYKLAAKAIARLQSLPSGSIERLCDTVVQEVFELTGYDRAMVYKFHEDDHGEVVSEITKPGLEPYLGLHYPATDIPQAARFLFMKNKVRMICDCRAKHVKVLQDEKLPFDLTLCGSTLRAPHSCHLQYMENMNSIASLVMAVVVNEGDEEGESSSSEQSQKRKKLWGLLVCHHTTPRFVPFPLRYACEFLAQVFAIHVNKELELENQILEKNILRTQTLLCDMLMRDAPLGIVSQSPNIMDLVKCDGAVLLYKNRIWQLGSTPSEFHIHDITSWLSEYHMDSTGLSTDSLYDAGFPGALALGDGVCGMAAVRITSKDMLFWFRSHTAAEVRWGGAKHEPGEKDDGRKMHPRSSFKAFLEVVKTRSLPWKDYEMDAIHSLQLILRNAFKDVENEGLNTSTIRTQLNDLSIEGTEELEAVTNEMVRLMET

SEQ ID NO: 2087 - protein, 391 aa, Xanthorhiza simplicissima
DLEPVNPADVPVTAAGAMKSYKLAAKAISRLQSLPSGNITVLCDVLVQEVSDLTGYDRVMVYKFHEDDHGEVVAECRVPELEPYLGLHYPATDIPQASRFLFMKNKVRMICDCSAAPVKVIQDNKLAQPLSLGGSALRAPHGCHALYMANMGSVASLVMSVTINEDDDQMETDQQKGRKLWGLLVCHHTRPRFVPYPLRYACEFLIQVFGMQINKEVELATQFREKHILQTQTVLCDMLLRDAPIGIVTQSPNIMDLVKCNGGALYYRSRFWLLGVTPTEAQIKDIAEWLLQYHNASTGLSTDSLMEAGFPGASVLGNEVCGMAAIKITTKDFLFWFRSHTAKEVKWGGAKHNPTEKDDGWKMHPRSSFKAFLEVVKHRSLPWEDVEMDAI

SEQ ID NO: 2088 - protein, 463 aa, Zea mays
MARSGREADPGEEERKLVLGKYELGRLLGQGTFAKVYYARDLSAGAGTGHSCSVAIKVIDKARLRRTEGMVEQLRREISIMRMVRHPNVVGIREVLASRSRVFVVMEYARGGELFAKVARGRLPEDHARRYFQQLVAAVGFCHRRGVAHRDLKPENLLLDEAGRLKVTDFGLAALPEQLRHDGLLHTQCGTPAYVAPEVLRKRGYDGARADLWSCGVVLYVLLCGFLPFQHDNYVKLYQKIFKADYQVPPWVSGDARRLIARLLVVDPAKRASIAEIMCTPWFRKGFVPPVLSPPVTPKKQQLDEGAALFDNDDDDDNSNHSGATSPRSCNAFQLISSMSSGFDLSGLFESEQKTATVFTARAPAATVVEKLESVARALGFEVTRGKGWKVRMEAKAEGTNGRLAATAEVLEVAVDVAVVEFVHDAGDALDFNKFCAVDVRPGLTEIVWAWQGDSPAAAVGTA

SEQ ID NO: 2089 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTCQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 2090 - protein, 259 aa, Brassica oleracea
LDRTIQFYTECFGLKVLRKRDVPEEKYSNAFLGFGPETSNFVVELTYNYGVSSYDIGTGFGHFAISTQDVSKMVEAVRAKGGNVTREPGPVKGGGSVIAFVKDPDGYTFELIQRGPTPEPLCQVMLRVGDLDRAIKFYEKALGMRLLRRIERPEYKYTIGMMGYAEEYESIVLELTYNYGVTEYTKGNAYAQIAIGTDDVYKSAEVVKIANQELGGKITREAGPLPGLGTKIVSFLDPDGWKTVLVDNEDFLKELNEEE

SEQ ID NO: 2091 - protein, 1112 aa, Arabidopsis thaliana
MESLPQPQNQSSPATTPAKILLGKYELGRRLGSGSFAKVHLARSIESDELVAVKIIEKKKTIESGMEPRIIREIDAMRRLRHHPNILKIHEVMATKSKIYLVMELASGGELFSKVLRRGRLPESTARRYFQQLASALRFSHQDGVAHRDVKPQNLLLDEQGNLKVSDFGLSALPEHLQNGLLHTACGTPAYTAPEVISRRGYDGAKADAWSCGVILFVLLVGDVPFDDSNIAAMYRKIHRRDYRFPSWISKQAKSIIYQMLDPNPVTRMSIETVMKTNWFKKSLETSEFHRNVFDSEVEMKSSVNSITAFDLISLSSGLDLSGLFEAKKKKERRFTAKVSGVEVEEKAKMIGEKLGYVVKKKMMKKEGEVKVVGLGRGRTVIVVEAVELTVDVVVVEVKVVEGEEDDSRWSDLITELEDIVLSWHNDIIDQRDALLEVQKELHVPTTTWNKNVDCCSWDGVTCDAILGELVLSRCKLQGEIPSSIGNLSHLTYLDLSNNQLVGEVPASIGNLNQLESMRLWDNDLKGNIPTSFANLTKLSELYLFGNQFTGGDTVLANLTSLSIIDLSLNYFKSSISADLSGLHNLERFSVYNNSFSGPFPLSLLMIPSLVHIDLSQNHFEGPIDFRNTFSLSRLRVLYVGFNNLDGLIPESISKLVNLEYLDVSHNNFGGQVPRSISKVVNLTSVDLSYNKLEGQVPDFVWRSSKLDYVDLSYNSFNCFAKSVEVIDGASLTMLNLGSNSVDGPFPKWICKVKDLYALDLSNNHFNGSIPQCLKYSTYFHTLNLRNNSLSGVLPNLFIKDSQLRSLDVSSNNLVGKLPKSLINCERIEFLNVKGNKIMDTFPFWLGSLPYLKVLMLGSNAFYGPVYNPSAYLGFPSIRIIDISNNNFVGSLPQDYFANWLEMSLVWSGSDIPQFKYMGNVNFSTYDSIDLVYKGVETDFDRIFEGFNAIDFSGNRFSGHIPGSIGLLSELRLLNLSGNAFTGNIPPSLANITNLESLDLSRNNLSGEIPISLGKLSFLSNTNFSYNHLEGLIPQSTQFATQNCSSFLGNLGLYGFREICGESHHVPVPTTSQQPEEPLSESEDQLLNWIAAAIAFGPGMFCGLVIGHIFTS

SEQ ID NO: 2092 - protein, 375 aa, Bacillus thuringiensis
MTSSNKKSASIYEGTNVNAWGSFENVAETKLFNSIQIGSWPLRNRIAMAPMTRCFADNETGAVGADVVEYYRKRAADGVGLIITEGIVISPRAKGNPGVPGIYTQEQIDSWKPVTEAVHKEGGTIIAQIWHVGRMSHHEIIGGQMPQAPSAIAAEGNVPRFRKPFDTPEAMTLEEIQEVIGQYAQAAKNAIEAGFDGVEIHGAHGYLIDQFTYEFANKRTDKYGGDLKQRLTFMKEVTEAVIEAIGADKTLLRFSAFKGDNPTYMWENPELAIETFVNMFKEVGLTMIHPSTMNYTQVIADGKNFHQLVRKYWDGAIVGVGNLNPKEAEEALQEGTIDVAAFGRPLIANPDFVHRIKSAESLVEYDAKEHLATLI

SEQ ID NO: 2093 - protein, 447 aa, Triticum aestivum
  misc_feature (358)..(358): Xaa can be any naturally occurring amino acid
MYKARRQASLKVRRRVGKYELGRTIGEGTFAKVRFAKDTESGDPVAIKILDKAKVHKHGLVEQIRREICTMKLIQHPNVVRLHEVMGSKARIFIVLEYVTGGELHDIIAARGSLKEDEARRYFQQLINAVDYCHSRGVYHRDLKLENLLLDTAGNLKVSDFGLSAISEQAKADGLLHTTCGTPNYVAPEVIQDKGYNGALADLWSCGVILFVMLAGYLPFEDDNVSALYKKISGAQFTCPSWFSDGAKRLIPRILDPNPSTRITIPQLLKDPWFKKGYKPPVFDEKHQTSLDDVDAAFGDSEEKQVEEEMEGQPASMNAFELISLNKGLKLDNFFEADKKYRRETRFTSQCPPEEIIXRIEEAAKPLGFDIQKKNYKMRMKNLEAGRKGNLNVATEVFQVAPSLFVVELKKAKGDTLEFQKFYITLSAQIKDAVWVCESEAEERGST

SEQ ID NO: 2094 - protein, 391 aa, Hordeum vulgare
MTRSRPTTTMGGSVPDQHHQQQQHDGEVDGGQLQHGGEHVETVMPGFRFHPTEEELIEFYLRRKVDGKRFNIDLIASVDLYRYDPWDLPALASIGDKEWFFYVPRDRKYRNGDRPNRVTPSGYWKATGADRMVKVVEGNRSIGLKKTLVFYVGKAPKGLRSSWIMNEYRLPHGETERYQKEISLCRVYKRPGIDDNLHLTGTTTRSSGSRAAATRHSTAAHRTSAVATHRQQPPVFVEGAGHHSSSALKAYNAHTTQGTNAASTMTSLSAAGVTPPAMFRSTASVASLSSTNSTEEDGTSLYHHHLKGHNNPAVMQLHSSTHAALLNTNSSAMATIPIDELSRAIGSYSQASNPNQPTAPMQGPLLNFPSLEKIWDWNPLLESPKVCTSFK

SEQ ID NO: 2095 - protein, 137 aa, Thermus thermophilus
MMRFDPFKELEELQERLVRAFGAPQQGPRVYAPPVDVWEDEEGLHLLVYLPGVEPEKVEVVAEEGVLSVKAERPFERKENAAYHRLEGTYGTFVRSFNVPSTYDLSKVQARFRHGVLHLLVPRAEATKPKKIQVQVE

SEQ ID NO: 2096 - protein, 80 aa, Triticum aestivum
PAWYKTEKQVTDEMLKNPKPEWGNDIPDTKEAYWYRCMFDEHLPPHCASTVMRWTPTWSKQTDPSGRAIATHNAKYDSAA

SEQ ID NO: 2097 - protein, 173 aa, Pseudomonas putida
MSLNDLNTLPGVTAQADPATAQFVFNHTMLRVKDIEKSLDFYTRVLGFKLVDKRDFVEAKFSLYFLALVDPATIPADDDARHQWMKSIPGVLELTHNHGTERDADFAYHHGNTDPRGFGHICVSVPDVVAACERFEALQVPFQKRLSDGRMNHLAFIKDPDGYWVEVIQPTPL

SEQ ID NO: 2098 - protein, 395 aa, Pleurotus djamor
MPLSSNAPVPGAKEFYPLNDPEIGTDEKIPLLFQPVTIGGTTFKNRIFVSPMCQYSSSNGHATDWHLVHIGGFATRGAAAIIMEATAVVPEGRISPEDAGIWTDSQIEPLRRIVQFCHAQGTKIGIQLAHAGRKASTLALWVKNNYAAASVEQGGWPDDVYGPSTIPFADKFATPKEMDEAHLTYVENAFVEAIERCEEVGFDFIEIHSAHGYLFHSFLSNLSNVRTDSYGGQPLENRLRFPLRVIKSCREAWSKPLFVRISASDWAEGPEKADDGTWKQWGIEQSKVLAGELVKIGVDLVDCSSGGNWAQQKIPFSHGYQVPFAESLKKAYPSLNVGAVGLISDPEKAEGYLQEGKADIILLARELLRNPHWPLTAAKALGVSMKVANQYERAA

SEQ ID NO: 2099 - protein, 252 aa, Vibrio fischeri
  misc_feature (159)..(159): Xaa can be any naturally occurring amino acid
MLSVKSIPAFNDNYIWLIHNNDNHCVVVDPGDATPVLECIKEHDFILDAILITHHHHDHIGGVPELVRQFPNVNVVGPENEPIPTLTHPVGDGDFVELFDEQFMVLGVPGHTNGHVAYIGDEKLFCGDALFSAGCGRLFEGTAEQMFNSLQKMAALPDXTEVYCAHEYAASNLAFALAVEPDNDYLLRYREKVLHLRAHGKSTIPSTLQREKLINPFLRTSEANVKKSVASKVQDSTEVEIFTALRRWKDEF

SEQ ID NO: 2100 - protein, 115 aa, Glycine max
DKKEDQKKKEKQMAALGGFTDITGAQNSIDIENLARFAVDEHNKKENAVLEFVRVISAKKQVVSGTLYYITLEANDGVTKKVYETKVLEKPWLNIKEVQEFKPITVAVNPLSVTV

SEQ ID NO: 2101 - protein, 282 aa, Brassica oleracea
MAENADLVEWPKKDKRRFLHVVYRVGDLDRTIQFYTECFGMKVLRKRDVPEEKYSNAFLGFGPETSNFVVELTYNYGVSSYDIGTGFGHFAISTQDVSKMVEAVRAKGGNVTREPGPVKGGGSVIAFVKDPDGYTFELIQRGPTPEPLCQVMLRVGDLDRAVKFMEKALGMRLLRRIERPEYNTIGMMGYAEEYESIVLELTYNYGVTEYTKGNAYAQIAIGTDDVYKSAEVVKIVNQELGGKITREAGPLPGLGTKIVSFLDPDGWKQVLVDNEDFLKELE

SEQ ID NO: 2102 - protein, 462 aa, Zea mays
MPSYAHHHSSPLVRNGAGRVVRRRLRGTERDSLDVFLCFLYLYREINKKKNPETKKLFFLNRPASPLVLGICDFDIRPVWVFFRPVKDDTRMDALKCNNNCAPPEETAEDADAAGALVEKDGFSVEDLLDLEEFGEPDKDGAEHEDDDAPPVPAAAEERSKDDSQPLSVVTYDLPSPPPEMVDLPSHDVEELEWVSRIMDDSLSELPPQAQPPPAVVASLAGRPPLAQQRRPFAHDGAYRAVAPPPGPLRTPTICALSTEAMIPVKAKRSKRSRGPAWWRSGAPFLSDSASSSSTTTTSSCSSSGSFSPFLRLDSPPFGGLELGEGYYGHLLPRPPSKKSKHGAKGSKHKPKKRGRKPKHLPTNSSGAGAAASQPGPSDRRCSHCGVQKTPQWRAGPEGAKTLCNACGVRYKSGRLLPEYRPACSPTFVSSIHSNSHRKVLEMRRKKEGDMVATAAPAVASF

SEQ ID NO: 2103 - protein, 401 aa, Arabidopsis thaliana
  misc_feature (146)..(146): Xaa can be any naturally occurring amino acid
MGLFGTKKIGKYEIGRTIGEGNFAKVKLGYDTTNGTYVAVKIIDKALVIQKGLESQVKREIRTMKLLNHPNIVQIHEVIGTKKKICIVMEYVSGGQLSDRLGRQKMKESDARKLFQQLIDAVDYCHNRGVYHRDLKPQNLLLDSKXGDMLSTACGSPCYIAPELIMNKGYSGAAVDVWSCGVILFELLAGYPPFDDHTLPVLYKKILRADYTFPPGFTGEQKRLIFNILDPNPLSRITLAEIIIKDSWFKIGYTPVYHQLSDSIKDNVAEINAATASSNFINAFQIIAMSSDLDLSGLFEENDDKRYKTRIGSKNTAQETIKKIEAAATYVSLSVERIKHFKVKIQPKEIRSRSSYDLLSAEVIEVTPTNCVIEISKSAGELRLYMEFCQSLSSLLTAEVS

SEQ ID NO: 2104 - protein, 492 aa, Solanum tuberosum
MDPSKYRPSSAYDTPFLTTNAGGPVYNNVSSLTVGPRGPVLLEDYYLIEKLATFDREKTPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKSMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPACVLNGRRTNCVIPKENNFKQAGERYRSWESDRQDRYITKWVESLSDPRVTHEIRSIWISYLSQADKSCGQKVASRLTVKPTM

SEQ ID NO: 2105 - protein, 491 aa, Oryza sativa
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSQETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIAVRRRVAHPKVSPELRAIWVNYLSQCDESLGVKIANRLNVKPSM

SEQ ID NO: 2106 - protein, 673 aa, Burkholderia pseudomallei
MTFYPHLTAPLELGFTSLKNRVLMGSMHVGLEEAANGFERMAAFYAERARGEAGLIVTGGIAPNERGRMMPGGSMLTTEEEAERHRIVTRAVHDAGGRIAMQILHFGRYAYHPALVAPSALKAPINTFTPHALSASEVDATIDDFARCAALAQYAGYDGVEIMGSEGYLINEFIAAHTNHREDEWGGAYENRIRFPVEIVRRVRERVGTNFIIIYRLSMLDLVEGGSTLDEVIRLAQAIEAAGATILNTGIGWHEARIPTIATKVPRAAYAWVTKRLVGRVGIPLVATNRINTPEIAEQLLAEGYCDMVSMARPFLADAQFVRKAREGRADEINTCIGCNQACLDHIFSGRITSCLVNPRACHETELVIEPAERRKRIAVVGAGPAGLSFAVTAAERGHDVELFEASPEIGGQFNIAKKVPGKEEFHETLRYFRRQLELRGVTLHLNTRADVARLAGGGFDEIVLATGVTPRRPDIEGIGHARVMGYLDVLRDGKPVGASVAVIGAGGIGFDVSEYLTHTGESASVAPSTFYAQWGIDIDYGARGGVRMPHVEAAPRNVHLLQRKASKVGDGLGKTTGWIHRTSLKARRVAMSSGVSYERIDDAGLHVRIDGEPRTLAVDSVVVCAGQEPQRELYDGLRAAGCSVHLIGGAHVAAELDAKRAILQGTTLAASI

SEQ ID NO: 2107 - protein, 705 aa, Picrophilus torridus
MIKLYNTCMDFKCLNDVECSHPEKILGPHLEDAYIIRAYIPIARAAFILIDNKKYQMIDNGKVFEYRSDNEINDYKILYIDDSGYEKTIDDPYRFRPEISDYDIYLYGTGRLFEAYKTFGAHLKTIKDVSGCNFVVWAPSALSVSVVGNFNHWTPGMHPMINVNDSGIWALFIPGIKENEVYKFAIKTKNNEIKMKTDPFAFYTEKRPRTGSIVINDDFHWTDNSFKRSENALSIYEMHLGSWKRNNGDYYNYREIADMLIDHLKKTGFNCVEIMPVMEHPLDISWGYQVVNYFAPTSRYGKPDDFKYLVNRLHENNIMVILDFVPAHFPDDDYGLYMFDGTHLYDYEDPRMGRTPDWGTNIFDFGRNGVRSFIASAAVFWIDKYHVDGLRFDAVTSMIYLDFGRKPGEWIPNINGGNINLEAVSLLKEINDYIHNKYYNVITVAEESSTYPGITSESGLNFNYKWNLGWMHDTLDFFHEDPLYRKYRINNLTFSVMYMYSENFILPVSHDEVVYGKGSLYRKMPGNKNEKISNVKLFLSYMFSYPGKKLLFMGNEFAQKNEWNVLSQLSWNDLDDGKYVMELIHDLNNLYKNDFNFYNDKNFSWIDFNDKTNTVISFNRGNAVCIFNFTPVERENYAIGVDYPSRYIEIINTDSKKYNGGNILNESIYACKYPMHGRRYSIEIDLPPLAAVIMEPEDLNGSSGN

SEQ ID NO: 2108 - protein, 657 aa, Caulobacter crescentus
MFCRATLLSDGSEALGTFRHTLAKSEVLGAMSENRNHNVSSHAPLQARIAGVALATTVLALVAACLCFMLQQWSVARQEARANHEVLVQMAAAGAAAPLADHNMVGVYRALEAVAKAPGVAGVRIIDAKGRAVAQLGEANPSNADTLQRPIKLSSQTVGTLVLVAKRPGLAQTLARDLALTGALFFGAAGMAILLANSLARRLAQPMERLSEAMHETAVGGRFKALEETADDDVFRSLIASFNHLVARLECNDQDLRGAMAELVKARDDANAANVLKSHFLANMSHEIRTPLNGVLAMADVMAMDQLSDIQRERLAVIRESGAVLLGVLNDVLDLSKIEAGRLEIQDRPFDIAQLAQSIRETFVPQARAKGLAFEVGVAPEAQGLWRGDADRLRQILGNLISNALKFTLDGAVAVRFASAEDGSGLRIDVADTGIGISPEILPRLFDKFVQADSTTTRRFGGSGLGLAICRELAAMMNGSIKVQSREGRGSTFTVLVGLPREETLTDVHYIDDGDPIMAPPAAEPPRLRVLAADDNPTNQKVVAAVLAPLNADVTLVDDGAACVEAWKTGDFDVVLMDIHMPVMDGLEAARSIRATEQAEMRRRTPIIAVTANALTHQIEEYLSVGMDGHVAKPIEVSKLYDAIEAAMAGTRLSRAA

SEQ ID NO: 2109 - protein, 354 aa, Thermobifida fusca
MSHLFEPLKLRDTLIPNRVWVSPMCQYSAHNGVPNDWHLVHLGQFALGGAGLVIAEATAVVPEGRISPADTGLWNDEQASAWRRITDFLRAHGAVPAIQLAHAGRKASTAVPWEGEHTVPETEGGWPTVSSTNQPFGSLAAPRALTTDEVAALPEHFAAAARRAETAGFDVVELHFAHGYLAHQFYSPLVNDRTDRYGGSFDNRVRLLLEITEAVRQVWPAHRPLFARISATDWVEGGWTGDDSVRLARLLADRGVDLIDTSSGGAVPDARIPVRPGYQVPFARQIRTEAHVPTGAVGLITAPEQAEEIIASGSADAVLLGRAMLRDPHWPLHAADRLRAGNLWPKPYERARLN

SEQ ID NO: 2110 - protein, 939 aa, Marinomonas mediterranea
MLALNSVSLRSKLFFAIYTPCLILSIIASFAFTLSRFDTIDRNFKEGVEKSVSQMTVSAEHALSHSDEGMLNDTLRTLLKHDHINTVQLYNAEEKLITELGKTSEGNTLPFTNANESDENPHFFATIAPIKHPVTRLEHQSNTNFITSSYSVPQVSGWLKVEASKEASIVSKYRYLSATLGTFFIFNLLAIFALLNVTASLLRPIEKISDTVNKITQGHFGATKGLNLPTQYSTVVSDLNDISSRLENHRAEILSNVDQATEDIRRNMDSLEEKSAQLHIANKEATESNRLKSQFLANISHEIRTPLNAIMGYIQILQKDQLDKQQRLYMDTIAQSTTNLLTIISDILDFSKIEAGKLSLDLTDINIRDIVDEVYQILSSANLVNASKELDLIPEFDLDVPTWVIGDPVRIRQVLTNLIGNAIKFTHEGSVRTTVKILEKSNSSLKLSFQIIDTGVGIPENKLDNLFKPFSQVDTSTTRKFGGTGLGLVITKKLVKQMGGNVEVSSEHGIGSNFRFTIVLKPSQKEQKVEDPISKSLLVFEPSLNYRNYLKTYLNHVGANCTFTSSLEQTVTLLNSQTSLDAVLLNIDSHTEKLEEIQELVAYITQQFRLPCILLTKRPHDISKSSILHTLCSEILMTPISHNRLNKSLRSLEEPKLLSEDRLYADETTTTELTTELELEAVEPPEETSPLSGIQILAVDDTQINLQLLGHWLEPHGLQVDLAYSGKQAIEMAKETQYDLILMDIQMPEMDGMEATQRLRKLTNYVHTPIVALTAHALGSEQKQIVSSGMNAYLTKPVNEDILLETITQWCQSKKSYQDLADEKVVALFDIDKALSIANGKSVIAKDMFDMLLNTLEADKKLILHHFEEKDLAKLIHVVHRLHGGSKYTGAIELSKHAGFLETHLKELQFDDVEGVLEDFTDSIDALIDIAPLIKWPQE

SEQ ID NO: 2111 - protein, 250 aa, Arabidopsis thaliana
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLDANRALSMKLEDMIGVRHHHIGGAWEGGDQQNIAYGHPQAHSQGLYQSLECDPTLQIGYSHPVCSEQMAVTVQGQSQQGNGYIPGWML

SEQ ID NO: 2112 - protein, 168 aa, Arabidopsis thaliana
MAKPWAHFVNTNVVVSTFNGLIAELRHVFTMAAKEIGLGLTGFGVFFSFLGIVFVFDKGLLAMGNILFISGVSLTIGFKSTMQFFMKRQNYKGTISFGVGFFFVIIGWPILGMMLETYGFFVLFSSLTSTGASECRSSLPSRAERRFTELDAAEQAIKVFGRRSFVIL

SEQ ID NO: 2113 - protein, 396 aa, Pleurotus djamor
MPLRGNAPVPGAKEFYPLNDPEIGTDEKVPLLFQPITIGGTTFKNRIFVSPMCQYSSSNGHATDWHLVHIGGFATRGVGAIIMEATSVVPEGRISPEDAGLWTDTQIEPLKRIVQFCHAQGTKIGIQLAHAGRKASTLAPWARGGAYIAPVEQGGWPDDVYGPSTLPFHEKFPTPKEMDEPHLTYVENAFVEAIERCEEVGFDFIEIHSAHGYLFHSFLSNLSNDRTDSYGGQPLENRLRFPLRVIKSCREAWSKPLFVRISASDWADRPEQGDDGLWKQWGIEQTKVLVGELLKIGVDFVDCSAGGNWAEQKIPLSHGYQVPFAESLKKAYPGLNVGTVGLISDPEKAEGYLQEGKADVILLARELLRNPHWPLTAAKALGVYLKVANQYERAVV

SEQ ID NO: 2114 - protein, 274 aa, Enterococcus faecalis
MTLDKTKKLANGNEMPRLGLGVWRVEDGSEATNSVKWALEVGYRLIDTAAVYKNEVGVGEGIRQSGIPREEIFVTTKLWNEDQGYENAIKAFDKSLEKLGLDYVDLYLIHWPVAGKYKESWKALEEIYASGRAKAIGVSNFHQHHLEDLLTEANVVPMVDQIELHPTLTQEPLRKYLAENKIAVEAWSPLGQGNLLSEPVLVKIGEKYGKSAAQVIIRWHLQNDIIVIPKSVHEKRIQENFAVFDFELTPEEITAINQLNKDHRFGADPDNFDF

SEQ ID NO: 2115 - protein, 433 aa, Thermosynechococcus elongatus
MGITHRTLVVSTTVVMTALVAVTGAGLHWSRSLAGFRQSPKELVDEVWQVIDREYVDATFNGNDWRAVRREFLSRNYTKPEEAYKAAREMLEKLNDPYTRFMDPEQFRSMQIETSGELTGVGITITQDEKTKEITVVSPIEGSPAAEMGLMAKDVILKIDGKSTKGMDLNQAVSMIRGPVNTKVRLTIRRGNQILNYEITRARIEIHPVRYSLRQTPQGPVGYIRLVTFSSNAAGEMRAAIRELEKQGVEGYVLDLRSNPGGLLFASAEIARMFLKQGDIVSTVNRQGEAERLRAGRGFLTDKPLVVLIDGGSASASEILAGALQDNNRAILVGTKSFGKGLVQSVQPVGEGAGIAVTIAKYFTPSGRDINKKGIEPDVEVTLTEQQREQLTRDDIATDRDPQFMRALAVLNERILAQRRNPQSARPTQGPNP

SEQ ID NO: 2116 - protein, 124 aa, Enterococcus faecalis
MKMAHTCVRVKDLEASLDFYQKAFNFEESRRRDFPENKFTLVYLTLPGDDYELELTYNYDHEAYDLGNGYGHIAISTDDLEGLHEKHQAAGFTVTDLKGLPGTAPSYYFVVDPDGYKIEVIRER

SEQ ID NO: 2117 - protein, 365 aa, Triticum aestivum
  misc_feature (312)..(312): Xaa can be any naturally occurring amino acid
MRRWFCCSQFHASYREHEHEFPSSPDEKEGNGFDSKSDPTKAPPPIEIPELSLDELKEKTDNFGSKALIGEGSYGRVYYAILDSGKHLAVKKLDTSADPEPDNEFLTQLSIVSRLKHENFVEMLGYCVEGNQRLVAYEFATMGSLHDILHGRKGVPGAQPGPALDWMQRVKIAIDAAKGLAYLHEKVQPSIVHRDIRSSNVLLFEDYRAKVADFNLSNQSPDMAARLHSTRVLGTFGYHAPEYAMTGQLTQKSDVYSFGVVLLELLTGRKPVDHTMPRGQQSLVTWATPRLTEDTVKQCIDPRLKGECPPKXGVAKLAAVAALCVQYESEFRTSMSIVVKALSPLLQQKPQAPPAAAPNTTTSEA

SEQ ID NO: 2118 - protein, 576 aa, Neurospora crassa
MPGTSRMPVSLRQSIDSVKRSRPRNPMQVLNLNVDLIRNIVFFLFLLRWTRRALWKLKGRGLFGTLFELFTDARRILYGYFLRLPGVRTKVRAQIDDALTKMQAKMIPAGQTRYLSLPKEGWTEEAVRKELEALATMDHTRWEDGYVSGAVYSGEDELLKLQTEAYGKFTVANPIHPDVFPGVRKMEAEVVAMVLSLFNAPPGAAGVSTSGGTESILMAILSARQKAYHERGVTEPEMIIPETAHTAFRKAAEYFNIKLHLVACPAPTYQVDTKRVARLINRNTIMLVGSAPNFPHGIIDDISALSKLALRKKIPLHVDCCLGSFLVPFLDKAGFDSQPFDFRLKGVTSISCDTHKYGFAPKGNSTVLYRTAELRSYQYFVDPSWSGGVYASPGIAGSRPGALIAACWASLMSVGEEGYLKSCTQIVGATKKLAEHIRSHPTLQQELEILGNPLVSVLAFQARGDLNIYDIADGMSSRGWHLNALQNPPAIHVAVTAPVAKNWERLAQDLEGVVEEEREKERVRQVEALKMGISGKTGKQKAAGDTAALYGVAGSLPNKSVVVDLARGFLDLLYKA

SEQ ID NO: 2119 - protein, 259 aa, Zea mays
MLNMMTDLSCGPSSKVKEQVAAAPTGSGDRQGQGRGKIEIKRIENTTNRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAIIKIRARKNELLYAEVDYMQKREMDLQTDNMYLRSKIAESNETGQPAMHMTMGAPPTSEYDHMAPFDSRNFLQVSMPQHYSHQLQPTTLQLG

SEQ ID NO: 2120 - protein, 142 aa, Bacteroides thetaiotaomicron
MVPVKTNQNWLPSIFNDFFDNEWMARANATAPAINVIENEKDYKVELAAPGMTKNDFKVSVDESNNLVICMEKKDEKKEEKKDGKYLRREFSYSRFQQSILLPDNVEKDKISAKVEHGVLFIDIPKVVDKKVQETTKTIDVK

SEQ ID NO: 2121 - protein, 75 aa, Triticum aestivum
  misc_feature (15)..(15): Xaa can be any naturally occurring amino acid
  misc_feature (57)..(57): Xaa can be any naturally occurring amino acid
SSHYRYPLNSDPRGXFGHIGVTVDDVYKGMRAFRKSWGRGFVKKPDDGKMKGIAFIXDPDGYWIEIFDLKQNRGG

SEQ ID NO: 2122 - protein, 545 aa, Streptococcus pyogenes
MNMAKDIKFSADARAAMVRGVDMLADTVKVTLGPKGRNVVLEKAFGSPLITNDGVTIAKEIELEDHFENMGAKLVSEVASKTNDIAGDGTTTATVLTQAIVHEGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMTALGQAAKITVDKDSTVIVEGSGSSEAIANRIALIKSQLETTTSDFDREKLQERLAKLAGGVAVIKVGAPTETALKEMKLRIEDALNATRAAVEEGIVAGGGTALITVIEKVAALELEGDDATGRNIVLRALEEPVRQIALNAGYEGSVVIDKLKNSPAGTGFNAATGEWVDMIKTGIIDPVKVTRSALQNAASVASLILTTEAVVANKPEPAAPAPAMPAGMDPGMMGGF

SEQ ID NO: 2123 - protein, 400 aa, Arxula adeninivorans
  misc_feature (380)..(380): Xaa can be any naturally occurring amino acid
MADFIRTQIFGTCFEITSRYVDLNPVGMGAFGLVCSARDQLTNQNVAIKKIMKPFSTPVLAKRTYRELKLLKHLRHENLITLSDIFISPLEDIYFVTELLGTDLHRLLTSRPLEHQFIQYFLYQILRGLKYVHSAGVVHRDLKPSNILINENCDLKICDFGLARIQDPQMTGYVSTRYYRAPEIMLTWQKYDVEVDIWSAGCIFAEMLRGKPLFPGKDHVHQFSIITELLGNPPDDVIETIGSENTLNFVKSLPKRERIPLSQKFPNADPDAVDLLEKMLVFDPRKRINAADALAHPYLAPYHEPSDEPVASEKFDWSFNDADLPVDTWKVMMYSEILDFHNVDSSAVEQQQQQPQPPQPQLQQQQQPPQQPQQPQQPQXAQQPVQPVQGDYVPQVAPRS

SEQ ID NO: 2124 - protein, 110 aa, Zea mays
MAEVHNERPVGMVGDVRDAPVGRENDLEAIELARFAVAEHNSKTNAMLEFERLVKVRHQVVAGTLHHFTVEVKEAGGGEKKLYEAKVWEKAWENFKQLQSFELVGDAAVA

SEQ ID NO: 2125 - protein, 727 aa, Yersinia pseudotuberculosis
MSVLPDRQVINQLISGHYGDPFSILGMHETSQGLQICALLPDAREVWLVETENGRRIAQLTLEDPRGFFIAQLTRRKKSFRYQFAVTWQESPQIIEDPYRFGPLLQDIDSWLLAEGTHLRPYERLGAHLMSLDGVSGVSFAVWAPNAQRVSVVGDFNFWDGRRHPMRLRRENGIWELFLPGIEAGQLYKFEIIDCHGQVRLKADPYAFEAQMRPETASLISPLPDVVKSSAARQKANDLCSPVSIYEVHLGSWRRHTDNNFWLSYRELADQLVEYVKYMGFTHVELLPINEHPFDGSWGYQPLGLYAPTRRYGTPEDFKAFVAKFHQAGINVILDWVPGHFPSDEHGLSTFDGTALYEYADPREGYHQDWNTLIYNYGRNEVRNYLAGNAFYWMERFGIDALRIDAVASMIYRDYSRAEGQWVPNYYGGRENLEAIAFLRYTNKTIGVERPGSVTMAEESTDFPGVTLPPDIGGLGFNYKWNMGWMHDTLNYMQCDPVHRKYHHNLMTFGMLYAYTENFILPLSHDEVVHGKRSILDRMPGDAWQKFANLRAYYAFMWAHPGKKLLFMGCEFAQGREWNFETSLDWHLLDDENGWHSGVQRLVRDLNHCYRQYAPLYEWDYQPAGFEWLVVDDHENSVFAFLRRDAEGHELIAISNFTPVPRYHYRVGIPQGGHYREVLNSDSAFYCGSNLGNQGGIDSHHVRSHNHEHSLLLTLPPLATIYLLREN

SEQ ID NO: 2126 - protein, 435 aa, Arabidopsis thaliana
MPEIEIAAGSGDNNDALFGKYELGKLLGCGAFAKVFHARDRRTGQSVAVKILNKKKLLTNPALANNIKREISIMRRLSHPNIVKLHEVMATKSKIFFAMEFVKGGELFNKISKHGRLSEDLSRRYFQQLISAVGYCHARGVYHRDLKPENLLIDENGNLKVSDFGLSALTDQIRPDGLLHTLCGTPAYVAPEILSKKGYEGAKVDVWSCGIVLFVLVAGYLPFNDPNVMNMYKKIYKGEYRFPRWMSPDLKRFVSRLLDINPETRITIDEILKDPWFVRGGFKQIKFHDDEIEDQKVESSLEAVKSLNAFDLISYSSGLDLSGLFAGCSNSSGESERFLSEKSPEMLAEEVEGFAREENLRMKKKKEEEYGFEMEGQNGKFGIGICISRLNDLLVVVEARRRGGDGDCYKEMWNGKLRVQLIRVCDQTSSTNAAI

SEQ ID NO: 2127 - protein, 510 aa, Pseudomonas syringae
MPLLNWSRHMVCLTAAGLITVPTVYATDTLTRDNGAVVGDNQNSQTAGAQGPVLLQDVQLLQKLQRFDRERIPERVVHARGTGVKGEFTASADISDLSKATVFKSGEKTPVFVRFSSVVHGNHSPETLRDPHGFATKFYTADGNWDLVGNNFPTFFIRDAIKFPDMVHAFKPDPRTNLDNDSRRFDFFSHVPEATRTLTLLYSNEGTPAGYRFMDGNGVHAYKLVNAKGEVHYVKFHWKSLQGIKNLDPKEVAQVQSKDYSHLTNDLVGAIKKGDFPKWDLYVQVLKPEELAKFDFDPLDATKIWPDVPEKKIGQMVLNKNVDNFFQETEQVAMAPANLVPGIEPSEDRLLQGRVFSYADTQMYRLGAIGLSLPVNQPKVAVNNGNQDGALNTGHTTSGVNYEPSRLEPRPADDKARYSELPLSGTTQQAKITREQNFKQAGDLFRSYSAKEKTDLVQRFGESLADTHTESKNIMLSVLYKEDRHYGTRVAEVAKGDLSKVKSLAASLKD

SEQ ID NO: 2128 - protein, 503 aa, Glycine max
MVLSKTASESDVSVHSTFASRYVRTSLPRFKMAEESIPKEAAYQIINDELMLDGNPRLNLASFVTTWMEPECDKLIMAAINKNYVDMDEYPVTTELQNRCVNMIAHLFNAPLEETEAAVGVGTVGSSEAIMLAGLAFKRKWQNRRKQEGKPYDKPNIVTGANVQVCWEKFARYFEVELKEVKLRDDYYVMDPEKAVELVDENTICVAAILGSTLNGEFEDVKRLNDLLIEKNKITGWDTPIHVDAASGGFIAPFIYPELEWDFRLQLVKSINVSGHKYGLVYAGIGWVIWRSKQDLPEELIFHINYLGADQPTFTLNFSKGSSQVIAQYYQLIRLGFEGYRNVMENCRDNMLVLKEGLEKTGRFSIVSKDNGVPLVAFTLKDHTHFDEFQISDFLRRFGWIVPAYTMPPDAQHVTVLRVVIREDFSRTLAERLVSDVEKVLHELDSLPARVISSTTVTLSAEENGKVVVAKKNPMETQREITAIWKKFVLERKKNNDKMNGVC

SEQ ID NO: 2129 - protein, 160 aa, Zea mays
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFMRKFVLPDNADVDKVAAVCRDGVLTVTVEKLPPPEPKKPKTIEIKVA

SEQ ID NO: 2130 - protein, 323 aa, Candida shehatae
MSPSPIPAFKLNNGLEMPSIGFGCWKLDKSTAADQVYNAIKAGYRLFDGAEDYGNEQEVGEGVKRAIDEGIVTREEIFLTSKLWNNYHDPKNVETALNKTLKDLKVDYVDLFLIHFPIAFKFVPIEEKYPPGFYCGDGDNFVYEDVPILETWKALEKLVKAGKIRSIGVSNFPGALLLDLFRGATIKPAVLQVEHHPYLQQPKLIEYAQKVGITVTAYSSFGPQSFVEMNQGRALNTPTLFEHDVIKAIAAKHNKVPAEVLLRWSAQRGIAVIPKSNLPERLVQNRSFNDFELTKEDFEEISKLDINLRFNDPWDWDNIPIFV

SEQ ID NO: 2131 - protein, 140 aa, Glycine max
  misc_feature (22)..(22): Xaa can be any naturally occurring amino acid
  misc_feature (43)..(43): Xaa can be any naturally occurring amino acid
  misc_feature (56)..(56): Xaa can be any naturally occurring amino acid
  misc_feature (61)..(61): Xaa can be any naturally occurring amino acid
  misc_feature (97)..(97): Xaa can be any naturally occurring amino acid
QQRDVAHTVGPAHHECICTVSXGIGAIEHVLYHSVTYEVTTIXASSPRFLMSRKTXSLGVXWVIFAEGLDQIFGGYMYLYEAPHKALFHQMTIGMVXALAKHDCLRDNRSTSAWGLEARVPMLVKQCVRVAMIFGPEYNM

SEQ ID NO: 2132 - protein, 692 aa, Vibrio fischeri
MKNHSEKEQFQEILLELKRSKEREAQLHKENQVILRGVSAISDAQTKEDIFNGLLNVIKEFVEFDNAIVVSSTDKDSFSVLASTNPYFDHLTWRYNDLFHRACHDETIILFQPHKTNEFLFKNTELQSLFSSVAICGLKSHSGYAVIILACSKFGAYSTLEKEKIERFMPLVERAVIDIDYKERLNAMVSLKTKELFLSKERFQDFAETVGDWFWETDPQFNFTYLSDTKINNTSIISQNLLSLISNDFINSTIIESEKRLVPFHEVEWNPDIFNNKVWLSLSGKPFFDEFGTFVGYRGTAKDISARKKRIRDIQTAKTEAEKANKAKSQFLAMMSHEIRTPLNSILGLVDVFHSSLLSEEQLDWLNQMESSSQLLLTIISDVLDISRIEAGTFVLNEQPIDLLRSLNTSINFLDTRAKDKGITLTVTASQNVPKYVFADATRLSQVIFNLVGNAIKFTNHGHVAVKIEKLPNNSISISVSDTGIGIASTTLEQLFKPFVQADSSITRKYGGTGLGLAIIKRLVELMQGTITVESRLNIGSTFKITLPLKEISDLPKQLNNEAKELVNQRSLNILLAEDNKANQAVLQILLEKQGHHVSIVSNGEEAISIFKHQTNGCFFDVVLMDVSMPVKDGISATTELRKLGIELPIIAITAHAMETEKEMCLEAGMNDFISKPIRAKDLSDILIKYSC

SEQ ID NO: 2133 - protein, 247 aa, Arabidopsis lyrata
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLEANRALSMKLEDMIGVRHHHIGGAWEGGDQHNVAYGHPQAHSQGLYQSLECDPTLQIGYSHPVCSEQMAVTAQGQSQPGNGYIPG

SEQ ID NO: 2134 - protein, 381 aa, Mannheimia succiniciproducens
MMNPKYQPLFEPYTLNNGVEIKNRLTVAPLTIYDSGKDGEMTETGRRFWQNRFEGFGLYIMPFTNVHPSGIGFESPNAFDERHLPTLREYAEMAHSQGAKAVVQIAHSGLRADPAMTQGAELVAATGDYYGCFRTMSEQEVWDMVTNYAYAAELVLRAGFDGVEIHGANGWQIQQFFSASTNLRNDYWGGTLEKRMRFPLAIIDGIDEMRQKHNRPDFIIGYRFSPEEPGEDGITMKETLALVDALLEKPLQYLHISLWDFYKKVRRGADTHLTRMQVVHDRIAGRLPFFGSGNLYTADDMLKAYQTGWVESVSIGKSIMLNPNLVELIETGRESEIESAFDWDKADYYRYTPAMLDGTRAGTDFFPPSKQNGVRYKTNHF

SEQ ID NO: 2135 - protein, 485 aa, Porphyromonas gulae
MEKNKLTTAAGAPVADNQNVATAGKRGPMLLQDVWFLEKLAHFDREVIPERRMHAKGSGAFGTFTVTHDITKYTKAAIFSEIGKQTELFVRFSTVAGERGAADAERDIRGFAIKFYTEEGNWDLVGNNTPVFFLRDPLKFPDLNHVVKRDPRTNMRSPQNNWDFWTLLPEALHQVTITMSDRGIPASYRHMHGYGSHAFSFINAEGVRHWVKFHLHTQQGIKNLTDAEAEALIGKDRESHQRDLFESIERGDYPRWTLKVQIMTEEEAKALPYNPFDLTKVWSQKDFPLIEVGVMELNRNPENYFADVEQSAFNPANVVPGISFSPDRMLQGRLFSYGDTQRYRLGVNHHQIPVNRSRCPFLNMYHRDGAMRVDGNFGSRLGYEPNSYGHWQDQNEYKEPPLELDGAAYQWDFREDDSDYYSQPRKLFHIMSPDQQQVLFDNTARAMGDIPKEIKLRHIANCYKADPDYGKGVAKALGLDVNEAL

SEQ ID NO: 2136 - protein, 268 aa, Hyacinthus orientalis
ALRFLAMAIALAASSVLAVDEADVRPTPVKFSKSSFPSGFVFGSASAAYQIEGAAKEGGRGPSIWDYFIDKHPVFFTEKIADRSNADVAIDFYHRYKEDIELMKDTGINAFRLSLSWSRILPNGKISGGINKEGVEFYNNVFNELLSKGIQPYVSIFHWDLPQSLDAEYGGFLSHRIVEDYKAYTDLVFELYGDRVKHWITFNEPFSFCFYGYASGDVCAWALLQISWGVPRGTLAVSLTSLPITCCLLMPLLLSSTETNFRHHKREP

SEQ ID NO: 2137 - protein, 194 aa, Triticum aestivum
FDGFRFDGVTSMLYHSRGAGQGFSGHYDEYFGLNVDTDALIYLMLANYMLHKFYPNCITIAEDVSGMPSSCRPVSEGGLGFDYRLGMAIPDMWIKLLKDVQYDDWNMGNIVHTLTNRRWMEKTVAYAESHDQALVGDKTVAFWLMDKEMYTHMAVSSDPSLIIDRGIALHKMIRIITNSLGGEAYLNFIGNEFG

SEQ ID NO: 2138 - protein, 247 aa, Zea mays
MRVAATRTAAAAAAHPPSAFLLLLVLLCCASLAIGGAAMAGHVLGGVKENPAAANSADSDGLGRFAVDEHNRRENALLEFVRVVEAKEQVVAGTLHHLTLEAVEAGRKKLYEAKVWVKPWLDFKELQEFSHKGDATAFTNADLGAKEGGHEPGWREVPVEDPVVKDAAHHAVKSIQERSNSLFPYELLEILRAHAQVVEDFAKFDILMKLKRGSKEEKIKAEVHKSLEGAFVLNQHQPAEHAESSSQ

SEQ ID NO: 2139 - protein, 173 aa, Zea mays
MMPRRALLFAAVLLAASAAAVSGFHLGGDESGLVRGVLAALRERAEAEDAARFAVAHYNKNQGAALEFTRVLKSKRQVVTGTLHDLILEAADAGKKSVYRAKVWVKPWEDFKSVVEFRLVGDSESEPEPSVASDVSSGQAIAKLSLEADIVQEEARLHTIENDGLSGDFTSSS

SEQ ID NO: 2140 - protein, 457 aa, Lactobacillus sakei
MIKFPEYFMWGAATSAPQSEGYALNYGKSASTWDKWFEMHPEKFNGDQGPDSASDTYRLYKEDVQNMQKIGLNSFRTSIAWTRLMPDGEHVNPEAVAFYRDYFERLKAANITPIINLFHFDMPWWLMEKGGWENRESVMAFARYAKTAFELFGDLVDRWTTFNEPIVHIECGYLTGYHYPDIIDFKKAVQVGYHTLLAHAAAVAEFRKVKPDGQIGIILNITPAYAKSDAPADLAAKEKADLLLAKSFLEPTVLGQVPPALITLLAEHQLTPVTEVGDRDLLAANRVDFIGVNYYQPLRVQAPTNPHFPALTTDDLYENYVWPERRINPYRGWEIYPEALYDVAMMMKNDYQNIPWYVSENGMGVADEERFMAADGEIQDDYRIEFMQEHLRQLHRAIADGSSCFGYHTWTFNDCWSWLNGFRNRYGFFRVDLEHNAQRTMKKSGHWYRQLTENNGF

SEQ ID NO: 2141 - protein, 633 aa, Saccharomyces cerevisiae; identical to SEQ ID NO: 157

SEQ ID NO: 2142 - protein, 721 aa, Thiomicrospira crunogena
MSNVPLNHAIQFDQFKLVIKNSTVSSFGNIAVATFLTYLIVDALSNTLVFFWLAYMVLVSVFRTGYGRYIRTNVSLDTFKYFQKRYFVFILLTALGWGYASFALFVENDTTLQSFLVMSIAGISSSSVSSLSPVKSYFYSFIIIVITPLFLKFATSYEVYGVAFSLILLLFLIFMIKSAKHYQEAINDSLSLNYQNVGLIKELNQAKQEADASNQLKSEFLANMSHEIRTPMNGIIGMTGLLLDTSLKKEQRDLTLTVKESAESLLAIINDILDFSKIEAGKMELNYESVKLVPFLDGVMEMVASSAQSKGLNLAYFIDPILPAEIETDGVRLRQVLINLLSNGIKFTDHGYVYLTVSALDSDSNRLQFKVTDTGIGISEEGQAKLFNAFSQVDGSSMRVFGGTGLGLTISKQILSLLGGHISVKSALGKGACFCFDIPYRVMDSNNCLAAFEAEIPLIWLMPNDALKPKMVDFFKELNIVVHCDTFDELLEQSDENRRPVWIDMAEVMKTGGKPFELIRALKMKHSFLTLLLTHQQANEWYQQIADLEINTRIKPVKYSHLSDWLFANQEEKILKETPVHSKFDASLSHLKLLLAEDNLVNQKLATALLKKLGITPDIANNGEEALQKLEDNLYDLVLMDCQMPIKDGYQATKELREWARPIKDVVVIALTANAMQGDEQKCYAAGMNDYITKPVSPMVLQEKLQKWAAFIQDNSLSSKG

SEQ ID NO: 2143 - protein, 372 aa, Schizosaccharomyces pombe
MASATSTPTIADGNSNKESVATSRSPHTHDLNFELPEEYEMINLIGQGAYGVVCAALHKPSGLKVAVKKIHPFNHPVFCLRTLREIKLLRHFRHENIISILDILPPPSYQELEDVYIVQELMETDLYRVIRSQPLSDDHCQYFTYQILRALKAMHSAGVVHRDLKPSNLLLNANCDLKVADFGLARSTTAQGGNPGFMTEYVATRWYRAPEIMLSFREYSKAIDLWSTGCILAEMLSARPLFPGKDYHSQITLILNILGTPTMDDFSRIKSARARKYIKSLPFTPKVSFKALFPQASPDAIDLLEKLLTFNPDKRITAEEALKHPYVAAYHDASDEPTASPMPPNLVDLYCNKEDLEIPVLKALIFREVNFR

SEQ ID NO: 2144 - protein, 178 aa, Glycine max
  misc_feature (93)..(93): Xaa can be any naturally occurring amino acid
  misc_feature (122)..(122): Xaa can be any naturally occurring amino acid
  misc_feature (125)..(125): Xaa can be any naturally occurring amino acid
  misc_feature (144)..(144): Xaa can be any naturally occurring amino acid
  misc_feature (165)..(165): Xaa can be any naturally occurring amino acid
  misc_feature (174)..(174): Xaa can be any naturally occurring amino acid
  misc_feature (177)..(177): Xaa can be any naturally occurring amino acid
MASSMISSPAVTTVNRAGAGMVAPFTGLKSMAGFPTKKTNNDITSIASNGGRVQCMQVWPPIGKKKFNTLSYLPDLNNTQLAKEVEYLLKKRXIPYLQFDLNHNFIYHNHNESPRYYNKLYXTIXNLPIFNYTNTSHVCKDLQXTKTTYPSNCIPIIRFYNSHQXQYINFISYXPAXF

SEQ ID NO: 2145 - protein, 486 aa, Unknown
  Bradyrhizobium sp. BTAi1
MPNDVSRRDLAKLAGLAAMGAAAGPAHAEEAAVTDDAGRRFPSDFVWGTATSSYQIEGGATADGRGPSIWDVFTHTPGKIEDGSTGDVACDHYDRYKHDVRLIKELGCRAYRFSIAWPRLFPDGGLTPNPKGLDFYSRLVDELLANGIEPYATLYHWDLPQALQDRVGGWRSAETAAAFAHYAGYVAQTLSDRVKTIFTINECGRFIPFGYGLGIDAPGLKLPQQEVNQARHHVALAHGLAVQAIRAKGRAGTRVGMAENITACLPAIDTPENIRAAEIATREMNAGFLNVILEGRYTDAFLAWSGKDAPTFTADELKTISTPVDFVGLNIYAPQAYVVASERAPGFDVLPMPSSFPHMSSPWLLVGPETAYWVPKLAAKIWNLKTIYITENGTSSDDKVTADGKVHDLDRVMYLRNYLAQLQRATSEGVPVKGYFLWSLMDNFEWVFGYKQRFGVYHVDFDTQLRTPKLSASYYRHVITRNAVSA

SEQ ID NO: 2146 - protein, 185 aa, Brassica juncea
MASEAKESPANNPGLSTVRDEATKGYIMQQTMFRVKDPKASLDFYSRVLGMSLLKRLDFSEMKFSLYFLGYEDTSTAPTDPTERTVWTFGRPATIELTHNWGTESDPEFKGYHNGNSEPRGFGHIGVTVDDVHKACERFEQLGVEFVKKPHDGKMKNIAFIKDPDGYWIEIFDLKTIGTTAGNAA

SEQ ID NO: 2147 - protein, 404 aa, Streptococcus suis
MKQFNKSTKLDDVAYDIRGPVLEEAMRMRANGEQILRLNTGNPAEFGFTAPDEVIRDLIHNARKSEGYSNSKGIFSARKAIMQYCQLKKFPNVDIEDIYLGNGVSELIVMSMQGLLDNGDEVLVPMPDYPLWTAAVSLAGGKAVHYVCDEAAEWYPDLADMESKVTSRTKAIVLINPNNPTGALYPKEILKGIIDIARRHELIIFSDEIYDRMVFDGAVHIPIATLAPDLFVVTMNGLSKSHRICGFRVGWMVLSGPKKHVKGYIEGLNMLSNMRLCSNVLAQQVVQTSLGGYQSVDELLMPGGRLYEQREFITKAINDIPGLSAVKPKAGLYVFPKIDREMYRVEDDEQFVLDFLKQEKVLLVHGRGFNWKDPDHFRIVYLPRVDELAEIQEKMSRFLRQYRR

SEQ ID NO: 2148 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRLIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2149 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKDSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAHYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPAGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2150 - protein, 300 aa, Streptococcus thermophilus
MHFYLISFKIILLQLEKENRMETYTLSNGVTIPKIGFGTWQIPEGEEAYNSVSFALKAGYTHIDTAQIYGNEVSVGKAIADSDVAREDLFLTTKLWNDKHDYDLAKASIDESLERLGVDYLDLFLIHWPNPKALRENDAWKVGNAGAWKAMEEAYKEGKVRAIGVSNFMQHHLEALFETAEIVPHVNQILLAPGCTQEDLVAYCRERDILLEAYSPLGTGSIFGNEDVEAVAERNGKSVAQVALRWSLQKGFLPLPKSVTPKNIEANLDIFDFDLSEEDMAVLDKIQGIKTQVDPDTVNF

SEQ ID NO: 2151 - protein, 1231 aa, Agrobacterium tumefaciens
MDCRGVEYRLTEGCGLLEKACRAVAALELPACIKDGELRYVVVNEAYGRVMGRAPSAFEGQTSLSLSGDIRDAEREDRERRSLVFATDEAIACHAALSAQSHMLRCERFIGDDGSLFLFEVFEEMPSAVSRKSAAVGGASDILFSSGVMDFIDAGIVVYDRDNQLVYCNARFAEFYSDLDIELKPGIRLEALMKTLYSSSVYRCAKNDGPSFEDWMQKQLHDFSLPYLERVEQFADGRWVRMVNKRLENGMLVGLRVDVTEFKAHETLLSTQIRETWLLRAALEQLPVGVFLRDQDRRLTYANAAYNTFLGGNLADHIGKTETEMFPQNGPRFRQENERILQTGEAIERTGNMPWRDGGAVPVITRLGRVATPDDEYYLVGSVTDVSLLQDREKALIAAQAEAEALHRQLQAVLRALPVGVLLLNADLVIEYVNPFFYQVWGEIGGEKSLVGKSYREFMEMNFDSGLYDYGDRPFDDVYEERVQRLLKADAFAPREVRSKSGKVTVISKTRLEGGKILSTYADVTDVRMRDAEISKARAELERVGEYMQGATRAMAQGLVLVEQGTIIMSNEAMARMFDVPPHLLEKGRNWAGFFAHCAGRGDFGTAAEAGETLRIWRENIAANRPFSWLVHVAGKSWLNLEATNSSGNYWLIIVTDVTEMKVREEELQRLLSRAEAADRAKSEFLANMSHEIRTPMNGVLGMAELLAKSKLDTRQKTFTDIIVKSGNALLTIINDILDFSKIEAGQMKLRSVPFDPAEAVEDVVSLLSSAALEKDIELIVRIDASVSGKVIGDAGRFRQIVTNIVGNAVKFTETGHVLVELSAQSAEASESIFSLRVEDSGIGIPVDKLETIFDKFSQVDGSATRRHEGTGLGLAITVGLVGLFDGKINVVSEVGRGSAFEVDIPFQVMERRRDVPLLSVAIDDIRVLVIDDNDVNRRILTEQLRSWGIDGHAVENGPSGIAVLQEAASLGFAIDAIILDYHMPVMNGLDVVERIRADKRFDDIAIVFLTSMDVVGDETLFTDLSVQAHLMKPARARLLRSTLFDVVRDVRLKRIRQHPLAQGTGGEKARPESRPAEKKQRAEAPATVPERSRPCLLDVLVAEDNDVNQIVFSQILQQAGLRFLIVGNGKRAVQAWEEYNPALILMDVSMPVMNGHQATQAIRAAEQAAGDSRHVPVIGVTAHTQEADRERCLEAGMDDYLSKPISPESLEDKIAQWLGENVLRRDAPGV

SEQ ID NO: 2152 - protein, 634 aa, Lactobacillus sakei
MCGIVGFAGGLFDLPKKKEVLNQQMDVIKHRGPSGAGDFIDDKVALGFRRLSIIDLTKGGQPIYNEDHTKLIFFNGEVYNYREIRKELEPLGHEFKTDSDTETILHAYEQWGKDVLKKIRGMFVFVIYDLQTKTLFGARDFFGIKPLYYTTLDDGTFMFSSEIKTFMRHPEFKRTLNKKALKSFMMNQYNDLQETFFEGVFRFPAGHYFTYKDGQLDIEKYWDMQFDPSNLSFEEEVKKIDASVEESIKMHNVADVPVGAFLSEGVDSSYVTSILQPQEVFSVGFDDQTYNEVTAAHALADELGLNFNETKVKADDAFAEFDKIQYYLDEPDGNPSCVPLWFLSRFAREKVTVALSGEGADELFAGYVNYGMHSHNTTIKAFTSSLKKLPKGARAKLAKTVKKMPAFPGRVHLYTNLANPKEFYAGQSVIYDIENPSIFGSDEANQYLKPAYQNDTTIQENYQADFDRVKDADPVSQMQYIDMHHFMLNDILQKADKLSMAHSLELRVPFLDPEVAKTAGQVPTEYLINSKDTKYAYRQASAKHLPAAWANRPKLGFPVPIKQWLETDKYYEQVKALFSEDFVSEFFDQGQLLALLDANKEQRINGRRKIWTIYTFLTWYKVYFINIEDYLVLG

SEQ ID NO: 2153 - protein, 286 aa, Zea mays
MHIREEEATPSTVTGIMSTLTSAGQQKLKEPISPGGGSASVAGSAAERNNGGRGKGKTEIKRIENTTNRQVTFCKRRNGLLKKAYELSVLCDAEVALIVFSSRGRLYEYANNSVKGTIERYKKATSDNSSAAGTIAEVTIQHYKQESARLRQQIVNLQNSNRALIGDSITTMSHKELKHLETRLDKALGKIRAKKNDVLCSEVEYMQRREMELQNDNLYLRSRVDENERAQQTANMMGAPSTSEYQQHGFTPYDPIRSFLQSNIVQQPQFYSQQEDRKDFNDQGGR

SEQ ID NO: 2154 - protein, 411 aa, Debaryomyces hansenii
MIGVQTSPLKNTDIFKPLKVGEHVLSNKVVYAPTTRLRALEDYTPSDLTLEYYNKRSRYPGSLLITEATLVSEQAGLYGTTPGIWNEKQVKEWKKIADKIHENGSFVSNQLWFQGRVGDPQLLRDHGLDLVAPSAIYPDDTSKEKAEAAGNPIRALTEKEIHEIIYDTYTNAAKNAIAAGFDYIELHAAHGYLLDQFLQPATNQRTDKYGGSIENRARFVLELVDHLTTVVGANKLAIRISPWAKFQGMKAEQDSTHPIITFSYLLHELQKRADNGNELAYVSVIEPRVNNNIDIDVSQQAGDNIFVGQIWKGIILKSGNYTYDAPHFNTLLNDISDNRTLVGFSRYYTSNPDLVKRLYEGWDLTPYDRDTFYTTNNWGYNTWNNYNENDEIDKNSEVNRKAKAIEEVKVK

SEQ ID NO: 2155 - protein, 411 aa, Debaryomyces hansenii
MSGVQIAALKDTDLFKPLKVGEHTLSNKVVYPPTTRLRALDDHTPSDLELEYYDKRSKYAGSLLITEATFVSEQAGLYSNVPGIWNEKHVKGWKEITDRIHENGSFISSQFWFLGRVGDPQLLKDRGLDFVAPSAIYPDDTTKEKAEAAGNPIRALTEKEIHDIIYDTYTNAAKNAIAAGFDYIELHAAHGYLLDQFLQPATNQRTDKYGGSIENRARFVLELVDHLITVVGANRLAIRISPWAKFQGMKAEQDSTHAVTTFSYLLHELQKRADNGNELAYVSIIEPRVLGIIDVEKSQQVGDNTFVGQIWKGIILKSGNYTYDAPHFKTLLHDISDNRTMVGFARYYTSNPDLVKRLYEGWDLTPYDRDTFYATNNWGYNTWNNYDEKAEITKDAEISRLAKAIEEIKAN

SEQ ID NO: 2156 - protein, 509 aa, Bdellovibrio bacteriovorus
MLKGSFKIQERMHDMAQSKKGLTTSAGAPVSDNQNSLTVGPRGPLVLQDVALIEKLAHQNRERVPERTVHAKGSGAFGTLTINGDISKYTRAKFLQPGTKTDLLIRFSTVAGERGAADAERDVRGFALKFYTEEGNFDLVGNNTPVFFVRDPYKFPDFIHTQKRDPRTNLRSPTAMWDFWSLSPESCHQVTILFSDRGLPASYRHMHGFGSHTYSLINSKEDRHWVKFHFKTQQGIKNLTNDEGAELVGRTRESHQEDLYNSIEEKSFPKWRMYVQIMSEEQAKKTWYNPFDLTKVWPHGEFPMIEVGTMELNRNPTNYFAEIEQAAFNPNNMVPGVSWSPDKMLQSRTFAYADAHRYRIGTHYEMLPVNKPKVEVNHYHLDGAMRLDVPEYNHAYYEPNSFGGPAQQEQYREPPLKLDDATMDRFDHHQGNDDYRQAGDLFRLMDADKKRQLLDNIAEHMKRGNVPEEIVRRQIEVFMRCDPAYGSGLAERMGVKVYSDKYESGSAHH

SEQ ID NO: 2157 - protein, 151 aa, Desulfitobacterium hafniense
MFDLVPFEGRNSGLPRKSRNLFDIDSIFENFFNDTLFPAFYNQSGQMRVDVRENEKEFIVEAELPGVNKEEIQIDCTEDRLTITVQKTESTEEQKDNYIRKERKASSMARSFAIANIRHEEITAKYENGLLTVTLPKHEKTAPKGKKIDIQ

SEQ ID NO: 2158 - protein, 238 aa, Ceratopteris richardii
MVRRKIKIKRIENATTRQVTFSKRRGGLLKKAHDLSVLCDAEVAVIIFSSKGKLFQFANPSMETVLGRYVKASRDPEAGDNGSSTDNVEADRLTVFTEKLKMLQSNVIGDDLERLSLRDLIHLEQQVHESLGHIRAKKDELILEQIDEFKQKMADTRRTTNANTSMLDRLVDFCSSGITGSQNIVESEPGYVVGVPRTDTLRAGWIATSDQSNDGPEYVPCAKRFRITEDLNESPASE

SEQ ID NO: 2159 - protein, 1158 aa, Methylobacillus flagellatus
MSGYQANNIDQTSFKRILRRNIMLPLGVGIASAALFVILIFNLLDSMNWVEHSERVIGKAQEVSKLAVDMESGMRGYLLSGDNSFLQPYLLSKPKIQAEISGLALLVKDSPAQTDRLKRTQAYIDQWHEYASQMISKRQASEDFMPILRQGNGKMQFDAIRNELAAFVAEEERILKTRSDSARKTTSFSLASYLLFVLGLTGFLGYFGRRELLSLSQNYEEVLRHQQEHADHQQRQTWLRTGQTALAELGIGQMALPQLGRTSLDFLARYIGAQVGAMYVREDDGALRRFSTYGFSPEHEQQDSVIRAHQGLLGQAVAENRTLDLDDLPSDYIKINSALGDATPRHLVIVPINNDGRINGVIELGFMRKPEPLDMEFLSLISGNLGIAIEAALSRQRLQDLLAETQQLNEELQVQQEELRTSNEELEEQSRILEESQATLENQKAELEQTNDKLAEQALRLDERNAALQEVQAQLRERAEDLERASQYKSEFLANMSHELRTPLNSSLILAKLLADNREGNLSEEQVKFAQTIYSAGNDLLNLINDILDISKVEAGKLELKPQELAVQHLANSLQAVFEPLAQQKKLDFSIDISPQTPDTIYTDRQRLEQILKNLLSNAIKFTDKGSISLHISNNAHDQISFTVKDSGIGIDPSMHEAIFAPFRQVDGTSSRRYGGTGLGLSISRNLAALLGGSINVESARGEGSSFTLLVPRQWQPAAMLPPPQPSPDPIQPVQQQEPPTKQPKQFSGPTFPDDREQAHGSKRLVLVIEDEPAFARILFDLAHEMGYQCLVAHAADEGLLVAEKYQPQAILLDIRLPDESGLSVLQTLKQNGLTRHIPVHVVSSEDHSEAALHLGAIGYALKPTTLEELKQVFARLEEKLSQKIKRVLLVEDDARQRESVHQLIADDDVEIIAVEFGEQALEQLRHNIFDCMIIDLKLPDMQGSELLQRMSSEDICAFPPVIVYTGRNLSRDEEEELLKYSRSIIIKGARSPERLLDEVTLFLHKVESELSSERQRMLQALRSRERVFDGRHILLVDDDVRNVFALTSALEQKGMKIEVARNGLEAIEKLNRIPDINLVLMDVMMPEMDGLEATRRIRADSRFERLPIIAITAKAMKDDQEQCMKAGMNDYLAKPIELSRLYSLLRVWLPAGLNHTE

SEQ ID NO: 2160 - protein, 269 aa, Lycopersicon esculentum
MVFPINQELLVDESSSQLRKTSGGTGGGGRGKIEIKRIENTTNRQVTFCKRRNGLLKKAYELSVLCDAEVSLIVFSSRGRLYEYANNSVRATIDRYKKHHADSTSTGSVSEANTQYYQQEASKLRRQIRDIQTYNRQIVGEALGSLSPRDLKNLEGKLEKAIGRVRSKKNELLFSEIELMQKREIELQNANMYLRAKIAEVERAQEQMNLMPGGGGGGGGGGGGGSDHQYHHQPNYEDARNNSLPVNLLEPNPHYSRRDNGDQTPLQLV

SEQ ID NO: 2161 - protein, 614 aa, Bacillus subtilis
MCGITGWVDFKKQLVQEKQTMDRMTDTLSKRGPDDSNVWGEHHVLFGHKRLAVVDIEGGRQPMACTYKGDTYTIIYNGELYNTEDLRKELRARGHQFERTSDTEVLLHSYIEWQEDCVDHLNGIFAFAVWDEKRNLLFAARDRLGVKPFFYTKEGSSFLFGSEIKAILAHPDIKARVDRTGLSEIFGLGPSRTPGTGIFKGIKEIRPAHALTFSKDGLNIWRYWNVESEKHTDSFDDTVANVRSLFQDAVTRQLVSDVPVCTFLSGGLDSSAITAIAAGHFEKEGKAPLHTYSIDYEENDKYFQASAFQPNDDGPWIEKMTEAFGTTHHKCVISQKDLVDHLEEAVLVKDLPGMADVDSSLLWFCREIKKDFVVSLSGECADEIFGGYPWFHTADVESGFPWMRSTEERIKLLSDSWQKKLNLKEYVNAKYEETLAETPLLDGETGVDKARRQLFYLNMLWFMTNLLDRKDRMSMGASLEVRVPFADHRLVEYVWNIPWEMKMHDNREKGILRKALEGILPDDILYRKKSPYPKTHHPEYTKGVSEWLKTIRSQKDSVLHTLLDRKQLDQLLETEGSSFKVPWFGQLMKGPQLIAHLAQIHTWFEAYRIDIDER

SEQ ID NO: 2162 - protein, 223 aa, Lycopersicon esculentum
MGRGKIEIKRIENNTNRQVTFCKRRNGLLKKAYELSVLCDAEIALIVFSTRGRLYEYSNNNVKATIERYKKATAETSSAYTTQELNAQFYQQESKKLRQQIQMMQNTNRHLVGEGLSSLNVRELKQLENRLERGITRIRSKKHEAILAETEDLHKREIQLEQENAFLRSKIAENERLQELSMMPSGGEEYNAFQQYLARNMLQLNMMETALPSYDPLSPDHKR

SEQ ID NO: 2163 - protein, 366 aa, Sorghum bicolor
RPLEYAWNKAANILFAESPAGVGFSYSNTSSDLSMGDDKMAQDTYTFLVKWFERFPHYKYREFYIAGESGHFIPQLSQVVYRNRNNSPFINFQGLLVSSGLTNDHEDMIGMFESWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSQKAPFY

SEQ ID NO: 2164 - protein, 254 aa, Brassica napus
MGRGRVELKRIENKINRQVTFAKRRNGLLKKAYELSVLCDAEVALIIFSNRGKLYEFCSSSNMIKTLERYQKCSYGSIEVNNKPAKELENSYREYLKLKGRYESLQRQQRNLLGEDLGPLNSKELEQLERQLDGSLKQVRSIKTQYMLDQLSDLQSKEQMLLETNRALAMKLDDMIGVRSHHMGGGGGGGWEGNEQNVSYEHHHQAQPQGLFQPLECNPTLQIGYDNPVGSEQITATTQAQAQPGNGYIPGWML

SEQ ID NO: 2165 - protein, 503 aa, Oryza sativa
MEGAGSDGNPLGGYRIGKTLGIGSFGKVKIAEHILTGHKVAIKILNRRKSMEMEEKVKREIKILRLFMHPHIIRLYEVIDTPADIYVVMEYVKSGELFDYDVEKGRLQEEEARRFFQQIISGVEYCHRNMVVRRDLKPENLLLDSKCNVKIADFGLSNVMRDGHFLKTSCGSPNYAAPEVISGKLYAGPEVDVWSCGVILYALLCGTLPFDDENIPNLFKNIKGGIYTLPSHLSPLGRDLIPRMLVVDPMKRITIREIREHQWFTVGLPRYLAVPPPDTAQQVKKLDDETQNDVINMGFDKNQLIESLHKRLQNEATVAYYLLLDNRLRTTSGYLGAEFHESMVSSLAQVTPAETPNSATDHRQHGHMESPGFGLRHHFAADRKWALGLQSRAHPREIITEVLKALQELNVCWKKIGHHNMKCRWSPSFPSHESMMHNNHGFGAASAMIETDDSEKSTHTVKFEIQLYKTRDEKYFLDLQRLSGPQLLFLDLCSAFLTQLRVL

SEQ ID NO: 2166 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAANEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMNIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2167 - protein, 656 aa, Thermobifida fusca
MKPRETTQFTHLFTPIRVGRMDLPNRIMATPHATPIGNLWSPDEAEADRNIAYWAARARAGLAWVGGISAALENHLVPGFEPTGVGAAARGVFRLPYFHDRIRKLTDTLHEAGAYVTAQLIMQGGMPHGPSPTVTAYVANQVSHALDRDEIAWFINEYAESARRGKAAGLDGVELHANHDDLLEWFLSPASNHRDDEYGGDLAGRMRFLLEIIDAIRAEVGPDFTLGVRMNLYEALDGGYDAAEGVDIAKALEATGKIDYLSVVVGDNWGAPSYIQPHYYQPAQWADLAAQVTRAVSLPVIYTGRVTDPHTAEKVIAQGQADLVGMARAIITDPEIITKTAQGRVHEIRPCIGCNECIHRRLVDKLPFACAINPYASRELDGPLPPARTPRRVLVVGGGPAGMELAGLLAERGHEVTLWEREEQLGGQMRIAARAAENAAYHDFVTWQEGRLRRAGVTVELGRTATVDNVLSFDADVVAVATGAVPRRLPIPGADAPFVVDGHAVLAGTAQIGERVLLTAAEDHMQPLTIAGYLADHGHHVHLVYQTPGPAPLVGKYTIGAPLAKLTAAGAAFTFMQRVVQIEEGRVATRNIYSDIPGEITGFDSVVVAAGGVPDDSLYHELKRHGKANVHLLGDAYAPRRITFATQQAYALAALV

SEQ ID NO: 2168 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSITGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAVGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2169 - protein, 1144 aa, Populus tremula
MASQSQRQSNQPAHNQVQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2170 - protein, 671 aa, Escherichia coli
SYPSLFAPLDLGFTTLKNRVLMGSMHTGLEEYPDGAERLAAFYAERARHGVALIVSGGIAPDLTGVGMEGGAMLNDASQIPHHRTITEAVHQEGGKIALQILHTGRYSYQPHLVAPSALQAPINRFVPHELSHEEILQLIDNFARCAQLAREAGYDGVEVMGSEGYLINEFLTLRTNQRSDQWGGDYRNRMRFAVEVVRAVRERVGNDFIIIYRLSMLDLVEDGGTFAETVELAQAIEAAGATIINTGIGWHEARIPTIATPVPRGAFSWVTRKLKGHVSLPLVTTNRINDPQVADDILSRGDADMVSMARPFLADAELLSKAQSGRADEINTCIGCNQACLDQIFVGKVTSCLVNPRACHETKMPILPAVQKKNLAVVGAGPAGLAFAINAAARGHQVTLFDAHSEIGGQFNIAKQIPGKEEFYETLRYYRRMIEVTGVTLKLNHTVTADQLQAFDETILASGIVPRTPPIDGIDHPKVLSYLDVLRDKAPVGNKVAIIGCGGIGFDTAMYLSQPGESTSQNIAGFCNEWGIDSSLQQAGGLSPQGMQIPRSPRQIVMLQRKASKPGQGLGKTTGWIHRTTLLSRGVKMIPGVSYQKIDDDGLHVVINGETQVLAVDNVVICAGQEPNRALAQPLIDSGKTVHLIGGCDVAMELDARRAIAQGTRLALEI

SEQ ID NO: 2171 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2172 - protein, 463 aa, Listeria innocua
MNNNFLWGGATASYQCEGAWNVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTQKTMIAAYNVMYASALGVKTFKEGGYPGQIGIVHSYTPVNGVDESIETKIAMRYADNYCNNWILETAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIESQGKLIKRREF

SEQ ID NO: 2173 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMNIIGAFCFLQIVSPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2174 - protein, 563 aa, Zea mays
MAPLLAAAMNHAAHPVLRSHLGPNNESFSRHHLSSSPQSSKRRFNLSFTPRSARVGNQNGVQLLSPSEIPRRDWFPSDFIFGAATSAYQIEGAWNEDGKGESNWDHFCHNFPERIMDGSNADIGANSYHMYKTDVRLLKEMGMDAYRFSISWPRILPKGTVEGGINQDGIDYYKRLINLLLENGIEPYVTIFHWDVPQALEEKYGGFLDKTQKRIVNDYKNFAKVCFDNFGDKVKNWLTFNEPQTFTSFSYGTGVFAPGRCSPGLDCAIPTGNSLVEPYIAGHNILLAHAEAVDLYNKYYKGENGRIGLAFDVMGRVPYGTSFLDEQAKERSMDINLGWFLEPVVRGDYPFSMRSLARERLPFFSDKQQEKLVGSYNMLGINYYTSIFSKHIDISPKYSPVLNTDDAYASQETYGPDGKPIGPPMGNPWIYLYPEGLKDILMIMKNKYGNPPIYITENGIGDVDTKEKPLPMEAALNDYKRLDYIQRHISTLKESIDLGANVHGYFAWSLLDNFEWYAGYTERYGIVYVDRKNNYTRYMKESAKWLKEFNTAKKPSKKIITPA

SEQ ID NO: 2175 - protein, 248 aa, Debaryomyces hansenii
MTATKISPLKETDLFKPIKVGQHTLTNKVTFAPTTRNRALKDHTPSDLELEYYDKRSKFPGSLLITEATFVSEQGGLYANVPGIWNDKHVNAWKRITDKVHQNGSFISCQFWFLGRVADPKLLKEHGLDLVSSSALYPNDDFKKKAETAGNPVRALTEQEIHDLIYDSYTKAAKNAMAAGFDYIELHSAHGYLLDQFLQPATNERTDKYGGSVENRARFLLELIDQLITIVGANKLAIRISLGLNFKV

SEQ ID NO: 2176 - protein, 140 aa, Nicotiana tabacum
KEEFHKETCRKIKALHQYDCLRANKSTSAWGLEARVPFLDKEFINVAMSIDPEWKLIKPEQRRIEKWALRRAFDDEEHPYLPKHILYRQKEQFSDGVGYSWIDGLKAHAEQHVTNRMMLNASHIFPHNTPITKEAYYYSM

SEQ ID NO: 2177 - protein, 411 aa, Debaryomyces hansenii
MRGVKIEELKEKELLKNLKVGEKKLYKKVVYKKNKRLRELDDHTPSDLELEYYDKRSKYAGSLLITEATFVSEQAGLYSNVPGIWNEKHVKGWKEITDRIHENGSFISSQFWFLGRVGDPQLLKDRGLDFVAPSAIYPDDTTKEKAEAAGNPIRALTEKEIHDIIYDTYTNAAKNAIAAGFDYIELHAAHGYLLDQFLQPATNQRTDKYGGSIENRARFVLELVDHLITVVGANRLAIRISPWAKFQGMKAEQDSTHAVTTFSYLLHELQKRADNGNELAYVSIIEPRVLGIIDVEKSQQVGDNTFVGQIWKGIILKSGNYTYDAPHFKTLLHDISDNRTMVGFARYYTSNPDLVKRLYEGWDLTPYDRDTFYATNNWGYNTWNNYDEKAEITKDAEISRLAKAIEEIKAN

SEQ ID NO: 2178 - protein, 159 aa, Nicotiana tabacum
MAMIPSFFGGRRSNIFDPFSLDIFDPFEGFPFSGTVANVPSSARETSAFANARIDWKETPDSHIFKMDVPGIKKEEVKVEVEEGRVLQISGERSREQEEKNDTWHRMERSSGKFMRRFRLPGNAKMEEIKAAMENGVLTVTVPKEEEKKSEVKAIDISG

SEQ ID NO: 2179 - protein, 775 aa, Unknown
  Synechococcus sp. WH 8102
MGGAAVLDWMVQDGERLANCRHDHPLAILGPQPSDAGWTVRVWMPEAHSVTLLEGGREALMTAPNHPWVFETTLSHDPGSNYKVRVERGGITHEQHDPWAFRDEWMGDMDRHLFAQGNHHHIWQRMGAHLTQRDGISGVMFCLWAPHALSVSILGDLNSWDGRHHPMQQRLGGIWELFIPGLAEGSLYKYEIRTQDGHCYQKADPYGFQHEVRPDNSSVVARLDGFQWSDGSWMQRRDSSNPLEQPISVYEMHLGSWIHASAEEPWIQPDGSPRAPVPAADMKPGARLLTYAELAARLIPYVKERGFTHIELMPITEHPFDGSWGYQVTGWYAPTSRYGTPDEFRAFVDRCHAEGIGVIIDWVPGHFPKDAHGLAFFDGTHLYEHGDPRIGEHKEWGTLIFNYSRNEVRNFLVANLVFWFEQFHIDGIRVDAVASMLYRDYLRPDGEWLANEHGGRENTEAVQFLQQANHVLFQHFPGALSIAEESTTWPMVTQPTEIGGLGFNLKWNMGWMHDMLDYFELDPWFRQFHQNNITFSIWYTYTENFMLALSHDEVVHGKSHLLHKMPGDDWQKYANTRALLAYMWTHPGKKTIFMGMEFGQRAEWNVWGDLQWDLLNYEPHKGIQLLVDDLNTLYKAEPALWRDDFDQFGFQWIDCNDNRHSVISFMRRESSSGTWLVVVANFTPQSHSHYRVGVPLAGFYEEIFNTDAARYGGSNLGNMGGKPTDEWSIHGYENSLDLCLPPLSLLVFRHDPKRSLQAASASACDKADDETADTN

SEQ ID NO: 2180 - protein, 378 aa, Fagus sylvatica
MCGGAIISDFIAPTGSRRLTADYLWGDRKKPISGKRFSKPVVDLDDEFELDFQGFKDEEESDIDEEEVLVQDVKPFTFSAPPSSGSKPVKSVEFNGQAEKSAKRKRKNQYRGIRQRPWGKWAAEIRDPRKGVRVWLGTFNTAEKAARAYDAEARRIRGKKAKVNFPDETPRASPKRSVKANLQKPLAKANLNSVQPNLNQNFNFMNNSDQDYTMGLMEEKPFTNQYGYMDSIPANADVGLKPFASNNTTPYFNSDQGSNSFDCSDYGWGEQGSKTPEISSVLSATLEGDESQFVEDAMPTKKLKSDSGNAVFIENNTAKTLSEELSAFESQMNFQMPFLEGSWESNMEALFSGDTTQDGNSMDLWSFDDLPVMAGGVL

SEQ ID NO: 2181 - protein, 115 aa, Zea mays
  misc_feature (106)..(106): Xaa can be any naturally occurring amino acid
HASSNTLDGLNGFDGTDTHYFHSGPRGHHWMWDSRLFNYGNWEVLRFLLSNARWGLEEYKFDGFRFDGVTSMMYTHHGLQVTFTGNFNEYFGFATDVDAVVYLMLXNDLIHGLYP

SEQ ID NO: 2182 - protein, 246 aa, Lycopersicon esculentum
MGRGRVELKRIENKINRQVTFAKRRNGLLKKAYELSVLCDAEVALLVFSNRGKLYEFCSTSNMLKTLDRYQKCSYGTLEVNRSIKDNEQSSYREYLKLKAKYESLQRYQRHLLGDELGPLTIDDLEHLEVQLDTSLKHIRSTRTQMMLDQLSDLQTKEKLWNEANKVLERKMEEIYAENNMQQAWGGGEQSLNYGQQQHPQSQGFFQPLECNSSLQIGYDPITTSSQITAVTNAQNVNGMIPGWML

SEQ ID NO: 2183 - protein, 409 aa, Zea mays
  misc_feature (371)..(372): Xaa can be any naturally occurring amino acid
  misc_feature (395)..(395): Xaa can be any naturally occurring amino acid
  misc_feature (399)..(399): Xaa can be any naturally occurring amino acid
MSAAATKVKRRVGKYELGRTIGEGTFAKVRFAKNTETGEPVAVKILDKEKVLRHKMAEQIKREISTMKLIKHPNVVRIYEVMGSKTKVYIVLEYVTGGELFDTIANQGRMREGEARSYFQQLINAVDYCHSRGVYHRDLKPENLLLDSYGNLNVSDFGLSALSQQIKDDGLLHTTCGTPNYVAPEVLEDQGYDGAMADLWSCGVILFVLLAGYLPFEDSNLMTLYKKISNAEYTFPPWTSFPAKRLLTRILDPNPMTENSCDFRITIPEILEDEWFKKGYKRPEFDEKYDTPLDDVDAVFNDSEEHHVTEKKEEEPVALNAFELISRSAGLNLGNLFDSEQEFKRETRFTSKCPPKEIIRKIEEAAKPLGXXVQKKNYKLRLEKDKAGEERDNLXVCYXRILQVAPSLH

SEQ ID NO: 2184 - protein, 92 aa, Triticum aestivum
  misc_feature (15)..(15): Xaa can be any naturally occurring amino acid
  misc_feature (38)..(38): Xaa can be any naturally occurring amino acid
SGGAPVEAKVHQCSXCHRTFPSGQALGGHKRLHYEGGXAGAGTGKDKEAAKAKAAALLRDFDLNLPASGVAGDEAESPPPEAKRARLMLLAI

SEQ ID NO: 2185 - protein, 115 aa, Zea mays
HASSNTLDGLNGFDGTDTHYFHSGPRGHHWMWDSRLFNYGNWEVLRFLLSNARWGLEEYKFDGFRFDGVTSMMYTHHGLQVTFTGNFNEYFGFATDVDAVVYLMLVNDLIHGLYP

SEQ ID NO: 2186 - protein, 115 aa, Zea mays
HASSNTLDGLNGFDGTDTHYFHSGPRGHHWMWDSRLFNYGNWEVLKFLLSNARWGLEEYKFDGFRFDGVTSMMYTHHGLQVTFTGNFNEYFGFATDVDAVVYLMLVNDLIHGLYP

SEQ ID NO: 2187 - protein, 219 aa, Lactococcus lactis
GGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMFLAKEIEKTGMFEIMNDGSQLPIVCYKLKEDSNRGWNLYDLADRLLMKGWQVPAYPLPKNLENEIIQRLVIRADFGMNMAFNYVQDMQEAIEALNKAHILYHEEPENKTYGFTH

SEQ ID NO: 2188 - protein, 489 aa, Talaromyces emersonii
MTTTETPTTTTTSTLPPDFLWGFATASYQIEGAFDEDGRLPSIWDTFSKTPGKVEDGTNGDVACDSYHRTGEDIEILKKYGAKIYRFSLSWPRIIPLGGRNDPINEKGLQFYSKFLDDLHAAGIEPFVTLFHWDLPDELMKRYGGMLNKEEFVADYANYARVVFNALGSKVKHWITFNEPWCSSVLGHNTGKHAPGRTSDRTKSPEGDGTREPWIVGHNLLVAHGTVVDIYRREFKEKQGGEIGITLNGDWAEPWDPENPADVEACDRKIEFAISWFADPIYHGKYPDSMVKQLGDRLPKFTPEEIAFVHGSNDFYGMNHYCENYIRNRTGEPDPEDIAGNLDILMEDKNGNPIGPETQCEWLRPFPLGFRKLLKWLADRYNNPKIYVTENGTSVKGESDKPLEEVLNDEFRVQYYRDYIGAMVDAVAQDGVNVKAYMAWSLLDNFEWSEGYRSRFGVTYVDYKNGQKRIPKKSALVIGELFNKYIRKE

SEQ ID NO: 2189 - protein, 426 aa, Triticum aestivum
  misc_feature (349)..(349): Xaa can be any naturally occurring amino acid
  misc_feature (365)..(365): Xaa can be any naturally occurring amino acid
PRVRSHASNNTLDGLNGFDGTDTHYFHGGSRGHHWMWDSRVFNYGNKEVIRFLLSNARWWLEEYKFDGFRFDGATSMMYTHHGLQVTFTGSYHEYFGFATDVDAVVYLMLVNDLIHGLYPEAVTIGEDVSGMPTFALPVQVGGVGFDYRLHMAVADKWIELLKGNDEAWEMGNIVHTLTNRRWLEKCVTYAESHDQALVGDKTLAFWLMDKDMYDFMALNGPSTPNIDRGIALHKMIRLITMGLGGEGYLNFMGNEFGHPEWIDFPRGPQVLPSGKFIPGNNNSYDKCRRRFDLGDAEFLRYHGMQQFDQAMQHLEEKYGFMTSDHQYVSRKHEEDKVIVFEKGDLVFXVFNFHWSNSYFDYRVXGCLKPGKYKVVLDSDAGLFGGFGRIHHTAEHFTSDCQHDNRPHSFSVYTPSRTCVVYAPMN

SEQ ID NO: 2190 - protein, 163 aa, Lactococcus lactis
GGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMYLAEEIEKTGMFEIMNDGSQLPIVCYKLKENSNLGWNLYDLADRLFNEGMASACLSTS

SEQ ID NO: 2191 - protein, 340 aa, Alkaliphilus metalliredigenes
MSALFSPFTLKDLTLKNRIVMAPMCQYSASETGYANQWHQVHYVSRAVGGVGLILLEATAVEPRGRISQKDLGIWENGHVTGLKSIVTACKQYGARVGIQLAHAGRKCHIPSEKIVAPSAIAFNEEYATPTSLSQNEIQTIVQAFIHGAARALEAGFDVIEVHGAHGYLINEFLSPLTNHREDQYGGSPENRVRFLKEVLEGIQGVWPKNLPIILRVSAEDYIKEGNHPEDLAEMINLVKEYGIDMVNVSSGAVVPAKIKPYPGYQIPFSETIKKQTNLPTIAGGLITTATMAEEVLRNERADLVYLGRELLRNPYWPLHSAKEVRDDILWPLQYEMSKV

SEQ ID NO: 2192 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2193 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNINIIGAFCFLQIASLELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPASAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2194 - protein, 280 aa, Pleurotus djamor
MERYNTRTASNFPGLVFDCAEEAQSGYKHIDTAYNYHTEKYVGNAVRESGIPREELFITTKLPWHHYARVAESFQESLDALGLGYIDLYLIHWPQPILYDPNDPLPKNPDGTPKTTNYPFTKIWADMERLLDTGKVRAIGVSNFSIKNLEILLESAKVVPAVNQVELHPYLAQPELVDYCKQKGIAITAYTPTGYQTVRDDPVIVELASKYRVSPAQVILAWHMSRGVIVTPKSANAERQRENINVSFLHFPINSFDVLFLASTAATCPGACRSSAYISS

SEQ ID NO: 2195 - protein, 306 aa, Pleurotus djamor
MSAYPPIVLNTGARMPALALGGWAGLTEEERTQAKEWFLTALKSGYRHIDTAQIYYTEKSVGNAIRESGIPREELFITTKLPWNHHSRVAESFQKSLENLGTEYIDLYLVHFPQRVFYDETTDFPRNPDGSIKVVNSPTLNDVWADVETLLDTGKVKAIGVSNYSIKTLEELLKTAKVVPAVNQVELHPFLAQSKLLAYCKEKGIAVTAYTPTGYQTVLTDPTIVELAGKYGVSPAQIVLAWHLSRGVAAAPKSANESRQKENLNLPFLQPEDVAKISALDRGQRIANKADERGQVWGLTLEELGW

SEQ ID NO: 2196 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMNIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVKLHREGMVPKIQFQGLSVCQGRLIWLSFPENTTVALYPLTIWFLLLHRHQSRSITHT

SEQ ID NO: 2197 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSKGEVVGKMLVGEVFGNCCKLKGPNALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKPEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVKLHREGMVPKIQFQGLSVCQGRLIWLSFPENTTVALYPLTIWFLLLHRHQSRSITHT

SEQ ID NO: 2198 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCKLKGPNSLTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVKLHREGMVPKIQFQGLSVCQGRLIWLSFPENTTVALYPLTIWFLLLHRHQSRSITHT

SEQ ID NO: 2199 - protein, 230 aa, Unknown
  Nocardioides sp. JS614
MTEAHDYTGAVRPGGPPDVRTLAHLSITKVAVDEQMSNNCYLLRCRETGAQLLVDAAAEPATLLPLIGETGLTAVVTTHQHWDHHRALADIVAATGAEVVVGLPDAAAVTEQTGVEVTRTVSEGDTVAVGTCTLQVITIAGHTPGSVALLYDDTASEGGRPHLFTGDSLFPGGVGNTFGDEAAFAQLIDDVETKIFQRLPDDTWFYPGHGDDSTLGAERPHLGEWRARGW

SEQ ID NO: 2200 - protein, 245 aa, Unknown
  Malus x domestica
GKVELKRIENKSNRQVTFSKRRNGLLKKAFELSVLCDAEVALIIFSGRGKLYEFSSSLSMMKTLERYQRCSYSSLDANRPANETQNSYQEYLQLETRVEALQQSQRNLLGEDLATLNTKKLEELEHQLETSLNKIRSTKTQFMLDQLSDLQNREQMLVEANKALRRKLEETSVQAPQFMAWEAAGDGHNNIQQTWLPSNSEAFFHPFGGNNSTSQIGYAHLGSHNGMDVGNPGQHVNGYIPGWML

SEQ ID NO: 2201 - protein, 116 aa, Schizosaccharomyces pombe
MSADGLDYTNLLPIANVARIMKSALPENAKISKEAKDCVQDCVSEFISFVTGEASEQCTQEKRKTITGEDVLLALNTLGFENYAEVLKISLTKYREQQARSASMKETKQSRSEEPQ

SEQ ID NO: 2202 - protein, 121 aa, Zea mays
ASAHASGLTDDDLEELKGCVDLGFGFSYREIPELCGTLPALDLCYSMSQRFMDEHHHHHHHHHHQQLGKAEEAPPLAPASPAQPAATTNWKISSPGDSPDEVKARLKYWAQAVACTVRLCS

SEQ ID NO: 2203 - protein, 515 aa, Saccharomyces cerevisiae
MSKLGQEKNEVNYSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKLYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 2204 - protein, 365 aa, Cryptococcus neoformans
MADFVKLSIFGTVFEVTTRYVDLQPVGMGAFGLVCSAKDQLSGTSVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAGDIWSTGCIFAEMLEGKPLFPGKDHVNQFSIITELLGTPPDDVIQTIASENTIRFVQSLPKREKVPFSTKFPNADPVSLDLLEKMLVFDPRTRISAAEGLAHEYLAPYHDPTDEPVAAEVFDWSFNDADLPVDTWKVMMYSEILDFHNLGDISQNEAEGPVTGEVPAAPAS

SEQ ID NO: 2205 - protein, 211 aa, Corynebacterium efficiens
MAHDGLKVENIVTSGIFALDGGEWEVDNNIWIVGNNEEVYIIDAAHNATPIMNAVGGRKVKGILCTHAHNDHITVAPELSREFDAPIFVHPGDRMLWEETHGDLKHEELVDGQRFDIAGTELIVLNTPGHSPGSCSFYVPEAAELFSGDTLFQGGPGATGRKYSSFDTIIESLKTSILDLPAETTVRTGHGDHTTVGAEAPHLEEWIKRGY

SEQ ID NO: 2206 - protein, 248 aa, Unknown
  Malus x domestica
MGRGRVELKRIENKINRQVTFAKRRNGLLKKAYELSVLCDAEVALIIFSSRGKLYEFCSSFSMMKTLEKYQSCSYGSLEANLPANETQNSYQDYLMLKARVEVLQQSQRNLLGEDLSHLNTKELEHLEHQLETSLKQIRSRKTQFILDQLSDLQNREQMLVEANKALKRKLEETSVHAPEGMAWEAAGHGPNNIQQTRLPSHSEAFFHPLEGNNSSSQIGYTHMGSDNEMNVGNPGQYVNGYIPGWML

SEQ ID NO: 2207 - protein, 486 aa, Shewanella oneidensis
MSQQYLTSQSGSPIADDQNSLSAGERGPLLLQDWHLIEKLAHFNRERIPERVVHAKGTGVYGTFTLTKDLSDYTIADHFNGVGKQTETFVRFSTVGGEMGSADAERDPRGFGLRFYTARGNHDIVGNNTPTFFLRDGIKFPDFIHTQKRNPLTNLKDPQAMWDFWSLNPEAMHQVTILMSDRGIPANYRQMHGYGSHTFSFWNAKGERFWVKFHFKSQQGVVNLSNEQADKLKGIDPDSSQRDMVVAITDGNFPRWTVNVQIMPEADANTYHINPFDLTKVWPHGDYPLIEIGVLELNRLPQNYFAEVEQVALAPSNLVPGVGASPDKMLQARLFAYADAQRYRIGANYNQLPVNCPHAAKANHHQRAGAMAGTQCPYHGSQTGGDASANYGPNSTIGALVEPANFAEPPLRLDGETARYSRYNQDDYTQAGNLYRIFSEEEKARLVATISGSLRQASMDVQQRMLAHFQKADADYGQRIKMALGL

SEQ ID NO: 2208 - protein, 207 aa, Unknown
  Malus x domestica
MGRGKIEIKRIENTTNRQVTFCKRRNGLLKKAYELSILCDAEVALIVFSTRGRLYEYSNNNSIRNTIERYKKACSDSTGSSSVTEINAQNSNRHLMGDALSTLTVKELKQVENRLERGITRIRSKKHELLLAEIEYFQKKEIELENENVYFRTKVSEVERLQQANMVSGSEMNAIQALASRHFFSQNMIEGGEATFPQQDKKNLHLG

SEQ ID NO: 2209 - protein, 94 aa, Nicotiana plumbaginifolia
QWREGPLGPKTLCNACGVRYRSGRLFPEYRPAASPTFIPTLHSNSHRKVVEMRKKAIYGETSALEEPHNVIVEGPPMSPAPEFVPMSSYLFDVY

SEQ ID NO: 2210 - protein, 903 aa, Oryza sativa
MDSCALFLSTPRPPPPLVPAHRRRPLASRSGLRRREGCPCSCASSSSSSGRAGSQDRPPRPWQQKQRTQRPGRGEAIDPVGFLAKHGISDRAFAQFLRDRYKALKDRRWELHSRLIDLKEASSGFELMGMHRHRQHRVDFMEWAPGARYCSVVGDFNQWSTTENCAREGHLGHDDFGYWTIILEDKLREGQEPDEYYFQEYNYADDYDKGDNGVDVEELIHRMNEEYWEPGEIKSQKSRLEVVAKLYEQMFGPNGPQTEEELGDIPDAETRYNEWKALQKDDSASSLPCYDIIDNGQEFDIFNVATDRVSFEKFQGKSPPLAYWVEMRKGRKAWLEKYVPAISHKDKYRVYFNTPDGGLERIPAWATYVLPDAEGKQSYAVHWDPPPEEIYKWRFERPKVKGSLRIYECHVGISGSEQKISSFQEFTSNVLPHIKDAGYNAIQLIGIVEHKDYSSVGYKVTNYFSVSSRFGSPDDFKKLVDEAHGLGLVVLLDIVHSYASADELVGLSLFDGSNDCYFHSGKRGHHKYWGTRMFKYDDIDVLHFLLSNLNWWVTEYRVDGFQFHSLPSMLYTHNGFSTFTGATEEYYNQYVDEDALIYLIIANEMLHELHPDIITIAEDATFYPGLCEPTTQGGLGFDYWVNLSIPEMWLWHLENVPEQEWSMNKIMRVLVNNNSNMLSYVENHNQSISGRKSFAEIILYEGKCSNSSVDNDLIFRASSLLNIIKLITFTTSGGAYLNFIGNEFAHPKRIEFPMSSNDYSFCLANRQWELLDKGVHKHIFNFDKDIMSLDGKERLISGGSPIVHHCDDTSMIIYFTRGPFLFVFNFNPDASYQLYSVGVDEAGEYQLILNTDETKYGGRGELTSNQYMKRTSDNRVGGCRNSLELTLPSRSAQVFKLVRILRI

SEQ ID NO: 2211 - protein, 115 aa, Zea mays
  misc_feature (55)..(55): Xaa can be any naturally occurring amino acid
  misc_feature (100)..(100): Xaa can be any naturally occurring amino acid
  misc_feature (106)..(106): Xaa can be any naturally occurring amino acid
HASSNTLDGLNGFDGTDTHYFHSGPRGHHWMWDSRLFNYGNWEVLRFLLSNARWXLEEYKFDGFRFDGVTSMMYTHHGLQVTFTGNFNEYFGFATDVDAXVYLMLXNDLIHGLYP

SEQ ID NO: 2212 - protein, 202 aa, Amanoa strobilacea
TVLFMKNKVRMICDCLAPPVKVIQDKRFAQPLSLCGSTLRSPHGCHVQYMTNMGSIASLVMSVTLNEDDDEMDSDQERGIKLWGLVVCHHTSPRFIPFPLRYACEFLMQVFGVQVSKEVQLAAQTREKHILQTQTLLCDMLLRDAPVAIITRSPNVMDLVKCDGAALYYRKKFWLLGVTPTEAQIKDIAEWLLEYHGGSTGL

SEQ ID NO: 2213 - protein, 206 aa, Triticum aestivum
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGINVEEAFQCIVKNALKNEPEEELYMPDTVDVVGGNRGQGSSGCC

SEQ ID NO: 2214 - protein, 175 aa, Triticum aestivum
  misc_feature (86)..(86): Xaa can be any naturally occurring amino acid
MSLIRRTNVLDPFSLDLWDPFDGFPFGSGGSGSLVPRTSSDTAAFASARIDWKETPEAHVFKADVPGLKKEEVKVEVEDGNILQIXGERNKEQEEKTDTWHRVERSSGKFLRRFRLPENAKAEQVKASMENSVLTVTVPKEEAKKPEVKSIQISGAMRWTAVCRAVVWSFARSSR

SEQ ID NO: 2215 - protein, 417 aa, Anabaena variabilis
MGFMQKQFFRLGFSLLVALSLAVGVVVQPATALTEEQKLVSEVWRIVNRSYLDETFNHQNWANVRQKALEKPLTDHKAAYGAIQNMLKTLGDPFTRFLDPEQYRSLQVSTSGELTGVGLQIALNPQSGKLEVVSPIAGSPADQAGIKPRDRIVKIEGISTTDLTLDEAATRMRGPIGSLVTLVIERDGEGEKEIRIVRDRIALNPVVAELRSSPEGKSFGYLRLTQFNANASMELAHAISSLEKKGAAAYILDLRNNPGGLLQAGIEIARQWLDSGTIVYTVNRQGIQGSFEAFGPALTDDPLIILVNQGTASASEILAGALQDNGRAQLVGETTFGKGLIQSLFELSDGSGLAVTIAKYETPNHRDINKLGIKPDTVVTQQILTRDEIATETDLQYQAALDLLSKNSVVAGIGNKG

SEQ ID NO: 2216 - protein, 149 aa, Rubrobacter xylanophilus
MLSPFRGFLDVRSELDRMFDEVFGGLSRRFGGGDLAEWAPAIDVYSKDGDLVIKAELPGMKPEDVDITLQEGVLTISGERKAEEEREGAGYFVRERRYGSFRRSMRLPEGVDESKIHARFEDGVLEVVVEGAGAVTEPRRIQIEAPKGS

SEQ ID NO: 2217 - protein, 267 aa, Zea mays
  misc_feature (189)..(189): Xaa can be any naturally occurring amino acid
  misc_feature (228)..(229): Xaa can be any naturally occurring amino acid
MAGLARHVDTEELLTTLKDHPMHKAGGRHSENRATSHITPYSSRYAAGTELSKFKIPQDGAPADVVHQLLKDELDLDGRPSLNLASFVGTYMEREGEQLMIENISKNLSDADEYPAMMDMHARCVSIIAHMWGVQKGEKAIGSATTGSSEAIHLGGLAMKRRWQEKRIAEGKDTSKPNIIMGANAQVAXLEKFARYFEVEARILPVSEDSSYRLDPKLVKENIDETLXXVFVILGSHYTGHYEPGEEISEILDEFEKETGVEIPIHV

SEQ ID NO: 2218 - protein, 1146 aa, Populus tremula
MASQSQRQSNQPAHNQVQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVSYTQSSAGWVEIHVCPTLKQISDGHTLVHTEFRYLERVLQTRMLGLQHPPRSFLNCKLTLVKLHREGMVPKIQFQGLSVCQGRLIWLSFPENTTVALYPLTIWFLLLHRHQSRSITHT

SEQ ID NO: 2219 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSTTCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPNALTKFMIALHNAIGGIDTDKLTFSFFDRNEKNVQTLLTANKRVNIKGDIIGAFCFLQIASLELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2220 - protein, 471 aa, Listeria innocua
MHTNTGFPADFLWGGAAAANQFEGAYNVDGKGLSVQDVTPKGGFGQITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSNPDDIIAVMEAERKNYFFSDVHVRGAYPGYMKRYFRENNIELDVTEEDLEILKNTVDFISFSYYMSTTETADESKRKAGAGNILGGVQNPYLEASEWGWQIDPKGLRVVLNEFWDRYQKPLFIVENGLGAIDQLEQDENGNYTVNDDYRINYLSAHLSQVKEAIKDGVELMGYTSWGCIDLVSASTAEMKKRYGFIYVDRNNDGTGTLNRYKKKSFDWYKNVIATNGEDL

SEQ ID NO: 2221 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGNCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2222 - protein, 537 aa, Oryza sativa
MATGVSVENINPKVILGPSSIAECIVIRGEVAIHAQVSWFSPSMFWKSISIYSFSANARREINRYLTFFFQHLQQQLQTQPGSLPFDEIVYCNIGNPQSLGQKPITFFREVLALCNHPNLLEREEIKSLFSTDAIARAKKILSMIPGRATGAYSHSQGIKGLRDEIAAGIASRDGFPANADDIFLTNGASPGVHMMMQLLIRNNRDGIMCPIPQYSLYSASLALHGGALVPYYLDESSGWGLEVSKLKNQLEDARSKGITVRALVVINPGNPTGQILDEQQQYELVKFCKDEELVLLADEVYQENIYVTNKKINSFKKIARSMGYNGDDLQLVSLHSVSKGYYGECGKRGGYMEVTGFSTPVREQLYKIASVNLCSNITGQILASLIMDPPKAGDASYDLYEEEKDNILKSLSRRAKAMESAFNSIDGITCNKTEGAMYLFPRIYLPQKAIEAARAVNKAPDVFYALRLLDTTGIVVTPGSGFGQIIRCYLFTCNSEFLTTQVWSFVKGCRDMAREMHDPAAGGEDTFDDLPLQGIP

SEQ ID NO: 2223 - protein, 438 aa, Oryza sativa
MSLVRRSNVFDPFSLDLWDPFDSVFRSVVPATSDNDTAAFANARIDWKETPESHVFKADLPGVKKEEVKVEVEEGNVLVISGQRSKEKEDKNDKWHRVERSSGQFMRRFRLPENAKVDQVKAGLENGVLTVTVPKAEVKKPEVKAIEISGGENISRGKYKVNWKRVCRPKDLGGLGIMDLQRFASALRLRWLWYEWTAPEKPWESNWVRDIDILRITEADHVQQSVRLWTMIRRMNPLTEDQDSIHWDLTANGQYSAKSAYRLQFLGATRSAFNQTIWKAWAPPKCKFFSWLATQNRLWTVDRLEKRGWQNQKICPLCCIIDESAVHLLAHCRVTKRVWTEIQRWTQTNLQMIKWSDCDSVEQWWNLVVDSLNNPRIPLRTLVILVSWEIWCERNARIFRNSASPLASILAKIKEEGRAWVKAGAYKLQEFGILGDIT

SEQ ID NO: 2224 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSTRCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNIKGDIIGPFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2225 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSLPEEQITAYLSKIQRGGHIQPFGCMSAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIGLHNAIGGIDTDKLPFSFFDRNEKNVQTLLTANKRVNMKGDIIGAFCFLQIASLELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2226 - protein, 195 aa, Araucaria heterophylla
DDDHGEVISEIRRSDLEPYLGLHYPATDIPQASRFLFMKNRIRMICDACAPPVRVVEDKRLPRELSLCGSTLRAPHGCHVQYMCNMGSIASLVMSVVVNEKEEKEGDSDGQQQQQKGRRLWGLVVCHHTSPRFVPFPLRYACEFLMQVFGIQLNKEVELGTQLREKQILRTQTLLCDMLFRGGAPMGIITRKPNV

SEQ ID NO: 2227 - protein, 482 aa, Wolbachia endosymbiont
MSQNKTLTTASGPPVADNQNSRSAGPRGPLLLDDFHLIEKLAHFNRENIPERRVHAKGSGAYGTFTVTQDITQYTSAKLFDSVGKQTPTFLRFSTVGGERGSADTERDPRGFALKFYTEEGNWDIVGNNTPVFFIRDPLKFPDFIHTQKRLPQSNLKSAQMMWDFWSHSPEALHQVTILFSDRGIPDGYRHMHGFGSHTYSLINAKGERHWVKWHYKTKQGIKNLAPADAARLAGTDPDYAQRDLFGAIERGDFPKWRVCIQIMTEAQANAHYENPFDVTKTWSQKEFPLIEVGELELNRNPLNYFAEVEQAAFGPSNMVPGVGLSPDRMLQGRVFAYADAHRYRVGTNHQQLPVNAPRSPVNSYQRDGSMAFGSNGGAAPNYEPNSYADAPKQAPQYAEPALALSGAADRYDHREDTDYYSHAGALFRLMNDEQKALLINNIAGAMAGVSSDVVQRQLQYFFKADPAYGEGIASALGVSLN

SEQ ID NO: 2228 - protein, 192 aa, Araucaria heterophylla
DDHGEVISEVRKSDLEPYLGLHYPATDIPQASRFLFMKNRVRMICDCCAPPVRVIEDKRLPRELNLCGSTLRAPHGCHAQYMSNMGSISSLVMAVIVNEKEEEEGDSDGQQQQKGRRLWGLVVCHHTSPRFVPFPLRYACEFLMQVFGIQLNREIELAAQSREKHILRTQTLLCDMLLRDAPMGIVTQKPNI

SEQ ID NO: 2229 - protein, 545 aa, Wigglesworthia glossinidia
MCSIFGILNIKNNSISLRKKALKCSNLMKHRGPDSNGIYCDEDVILVHERLSIIDVKSGNQPLFNNSKTNVLIMNGEIYNYEEIKKNLIHDYSFNTNSDNEVVLALYKKFGLNFLNKLNGMFAFILYDIEKKIYLIGRDHIGMIPLYMGYDCDNNLYISSEMKALIPVCNYIKEFPIGSYLCNLNKKIIKYYKRNWFEFDSIKNCLLSYKKIKHSLKKSVLNHLKSEVPFGILLSGGLDSSIIASIASKELNYKNLNKKLKSFSIGLENSPDLHSSRICARYLNTDHCEVKFTEQDGLDVIKKVIYYVETYDITTIRASIPMYLISQKIKSSGIKMILSGEGADEIFGGYLYFHNAPSEKDLHDELVRKLKSLHIYDCARANKSMLAFGIEARFPFLDKKFLDVAMRINPKHKMCNKNRIEKYILRKSFINYLPNNILWRQKEQFSDGVGYKWIDSIKNFSKKIISDKKFNNAIHKFPYNTPLSKEEYLYREIFENFFPLPSAAECVPQEKSIACSSEIASKWSKYRNLNFDPSGRSLDIHISKN

SEQ ID NO: 2230 - protein, 246 aa, Unknown
  Malus x domestica
MGRGRVELKRIENKINRQVTFAKRRNGLLKKAYELSVLCDAEVALIIFSNRGKLYEFCSSSSILKTLDRYQKCSYGAVDQVNRPAKELESSYREYMKLKGRYESLQRTQRNLLGEDLGPLNTKELEQLERQLEGSLKQVRSTKTQYMLDQLSDLQNKEQLLIEANRDLTMKLDEISSRNQLRQSWEGGDQGMAYATQHHHAQSQGFFQPLDCNPTLQMGYSAVGSEQMSATTNAQQVNCFIPGWML

SEQ ID NO: 2231 - protein, 193 aa, Araucaria heterophylla
DDHGEVIAEIRRVDLEPYLGLHYPATDIPQASRFLFMKNKVRMICDCRADPVKVIQDKRLAQPLSLSGSALRALHGCHVQYMANMGSIASLVMAMTINENENENDEETSGSGQKGGRRLWGILVCHHTSPRFVPFPLRYACEFLMQVFGIQLNKEVELAAQLREKHMLRTQTVLCDMLLRDAPVGIVTQTPNI

SEQ ID NO: 2232 - protein, 242 aa, Unknown
  Malus x domestica
RVELKRIENKINRQVTFAKRRNGLLKKAYELSVLCDAEVALIVFSNRGKLYEFCSSPSILQTVDRYQKCSYGAVDQVNIPAKELESSYREYMKLKGRCESLQRTQRNLLGEELGPLNTKELEQLERQLEASLKQVRSTKTQYMLDQLSALQNKEQLLIEANRDLTMKLDEIGSRNQLRQSWEGGDQGMAYGTQHHHAQSQGFFQPLDCNPTLQIGYPAEGSEQMGATTHAQQVNCFIPGWML

SEQ ID NO: 2233 - protein, 174 aa, Zea mays
  misc_feature (127)..(127): Xaa can be any naturally occurring amino acid
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKXTAKSSDGSIKKDALGHVGASSSAAQGGAYNQGMGYMQPQYHNGDISN

SEQ ID NO: 2234 - protein, 195 aa, Araucaria heterophylla
DEHGEVLAEIRRSDLEPYLGLHYPATDIPQASRFLFMQNRVRMICDCRAAPVEVIQAEELKQPLCLVGSTLRAPHGCHAQYMANMGSIASLVMAVVINGNEDEGGGGGGSGSGSGRGSMKLWGLVVCHHTSPRAVPFPLRYACEFLMQAFGLQLNMELQLAAQLTEKHILRTQTLLCDMLLRDAPIGIVTHSPSI

SEQ ID NO: 2235 - protein, 115 aa, Zea mays
  misc_feature (100)..(100): Xaa can be any naturally occurring amino acid
  misc_feature (106)..(106): Xaa can be any naturally occurring amino acid
HASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAXVYLMLXNDLIHGLYP

SEQ ID NO: 2236 - protein, 237 aa, Saururus chinensis
MGRGRVQLKRIENKINRQVTFSKRRTGLLKKAHEISVLCDAEVALIVFSTKGKLYDYSTNAGMARILERYERYCYAEREVAVTSPDSEGSWWLEYGKLKARIEAQQRIQRQLMGEDLDALTPKELQQLENQLESALKHVKSRKNQVIYDSMVELRRKEKLLRDENTMMEKKIQEKKKERVQQAQWEQQIQSQNSPSFLPTLNIGYHQGTATETGEKEEAHPGHNTVMLAWLLRSSNN

SEQ ID NO: 2237 - protein, 201 aa, Astrocasia neurocarpa
RSSSSKNKVRMICDCQAPPVKVIQDKKLTRPISLCGSTLRYPHGCHVQYMQNMGTIASLVMSLTINDNDDEMDNDQQSARKLWGLVVCHHTSPRFVPFPLRYACEFLIQVFGVQVNKEIELAAQMREKHILQIQTVLCDMLLRDAPMAIITQSPNVMDLVKCDGAALYYRKKFWLLGVTPTETQIRDMADWLLEYHGGSTA

SEQ ID NO: 2238 - protein, 301 aa, Asarum caudigerum
AGLSSPPRERKRVRENLIFSLAFKFARFQNFRFSFSFAGGFIFFEFSSLFFFGLQEMGRGRVQLKRIENKINRQVTFSKRRTGLLKKAHEISVLCDADVALIVFSAKGKLYEYATNSSMETILERYERYSFAERELVADPESEGGWCLEYGKLKARVDALQKSHKHIMGEDLDSLSIKELQHLEQQLDVALKHIRSRKNQVMLDTISELQRKEKMLLEQNKALQKTMREKENAMVRQAQWEQDNQPQASRPSFMLSRPLPTLHIGSNYHQTRNTETEKQGDRPHSRSNSGIPAWMLSHMND

SEQ ID NO: 2239 - protein, 238 aa, Mycobacterium leprae
MSDSDRLYFRQLLSGRDFAVDDVVATQMRNFAYLIGDRQTGDCVVVDPAYAAGDLVDALEADGMRLSGVLVTHHHPDHVGGVMMGFQLKGLTELLERVTVPVHVNTHEALWISRVTGIDIGHLTTHEHRDKLSVGDIEIELLHTPGHTPGSQCFLLDGLLVAGDTLFLEGCGRTDFPGGNSDEMYRSLQQLAQLPGNPTVFPGHWYSTAPSATLSMVKCSNYVYRAADLNQWRMLMDS

SEQ ID NO: 2240 - protein, 115 aa, Zea mays
  misc_feature (53)..(53): Xaa can be any naturally occurring amino acid
  misc_feature (55)..(55): Xaa can be any naturally occurring amino acid
HASSNTLDGLNGFDGTDTHYFHSGPRGHHWMWDSRLFNYGNWEVLRFLLSNAXWXLEEYKFDGFRFDGVTSMMYTHHGLQVTFTGNFNEYFGFATDVDAVVYLMLVNDLIHGLYP

SEQ ID NO: 2241 - protein, 200 aa, Astrocasia jacobinensis
  misc_feature (125)..(125): Xaa can be any naturally occurring amino acid
RFLFMKNKVRMICDCQAPPVKVIQDKKLTRPISLCGSTLRYPHGCHVQYMQNMGTIASLVMSVTTNDNDDEMDNDQQSGRKLWGLVVCHHTSPRFVPFPLRYACEFLIQVFGVQVNKEIELAAQXREKHILQIQTVLCDMLLRDAPMAIITQSPNVMDLIKCDGAALYYRKKFWLLGVTPTETQIRDIADWLLEYHGGST

SEQ ID NO: 2242 - protein, 115 aa, Zea mays
  misc_feature (45)..(45): Xaa can be any naturally occurring amino acid
  misc_feature (100)..(100): Xaa can be any naturally occurring amino acid
HASSNTLDGLNGFDGTDTHYFHSGPRGHHWMWDSRLFNYGNWEVXRFLLSNARWWLEEYKFDGFRFDGVTSMMYTHHGLQVTFTGNFNEYFGFATDVDAXVYLMLVNDLIHGLYP

SEQ ID NO: 2243 - protein, 160 aa, Medicago sativa
MDFRLMGLMLQCYTALHQMMDLSDENVEKSSSHNAPTRSYVRDAKAMAATPADVKENPNSYVFVIDMPGLKSGDIKVQVEDDNVLVISGERKREEEKEGGAKYLRMERRVGKFMRKFVLPENPNTDAVSPVCQDGVLTVTVQKLPPPRPKKPRTIEVQIA

SEQ ID NO: 2244 - protein, 75 aa, Phaseolus vulgaris
RVLQISGQRTKEKEDKNEKWHRVERSSGSFLRRFRLPENAKVNEVKAAMETGVLTVTVPKEEVKKRDVKPVQITG

SEQ ID NO: 2245 - protein, 202 aa, Croizatia brevipetiolata
RFLFMKNKVRMICDCLAPPVKVIQDKKLAQPLSLCGSTLRSPHGCHAQYMANMGSTASLVMSVTINEDDDEMDSDQERGIKLWGLVVCHHTSPRFVPFPLRYACEFLIQVFGVQVSKEVQLAAQTREKHILQTQTVLCDMLLRDAPVAIITQSPNVMDLVKCDGAALSYGTKFWLLGVTPTEAQIKDIAEWLIEYHGGSTGL

SEQ ID NO: 2246 - protein, 364 aa, Xanthomonas campestris
MSTSTPSPLFSPVRLGALDLSNRVIMAPLTRNRAVAGAVPSPLAVEYYAQRATAGLIIAEGTQISPLGQGYLDTPGIHTPAQVEGWRAVTDAVHRQGGKIALQLWHVGRVSHTSLLPPGEVPVAPSAIRSTGKTFTAQGFSDVSEPRALALEEIPALIEDYRAAARNAIDAGFDGVEVHAANGYLIDQFLRDGSNQRTDAYGGDIENRTRLLAEVVQAIADEIGAERTGVRLSPVTPVYDMHDSDPQALFERAVERLNLIGGLAFVHVIEGATGGPRDNIAFDYTALRAKFDGAWISNNGYDKAMAEQAISRGDTDAVSFGRAYIANPDLVRRLREDAPLAEPNQATLYGGGAEGYTDYPALPA

SEQ ID NO: 2247 - protein, 559 aa, Zea mays
MHRFAADRARRAVAASLRGAASRAAAAPSRHAPAPRHPTSPVGAAAPVAAAAMARAAMSTAVAGVPPPVSLDTISPKVPPVSLDTINPKVLKCQFAVRGEIVTRAQKLQQELQRNPESLPFDEILYCNIGNPHSIGQQPVTYFREVLSLCENPALLDKSETHALYRSDAIERARKILDKIPGRATGAYSHSQGIKGLRDEIAAGIAARDGFHASADNIFLTDGASPAVHMILQLLIRSEKDGILCPIPQYPLYSASIALHGGSLVPYFLDEETGWALEVDELKKQLEEARSKGISVRALVVINPGNPTGQVLTEENQKKIVEFCKNERLVLLADEVYQENIYVEDKQFHSFKKIARSLGYTDDDLPLVSFQSISKGYYGECGKRGGYMEITGFSPQVRDQIYKMASINLCSNITGQILASLVMNPPKAGDESFESFRLERDGILSSLGRRAKALEEAFNSLEGITCNKAEGAMYLFPRLHLPQKAIGAAQAAGTAPDAYYAKRLLEATGIVFVPGSGFGQVPGTWHIRSTILPQEDKIPGIVSRFKEFHDKFMDEFRDY

SEQ ID NO: 2248 - protein, 484 aa, Actinobacillus actinomycetemcomitans
MSAKCPFDHNSATLTTAAGAPVVDNDNTMSAGPRGPLLLQDVWYQEKLAHFARERIPERVVHAKGSAAFGTFTVTHDITQYTKAALFSEVGKQTEVLLRFSTVAGERGAADAERDVRGFSLKFYTEQGNWDLVGNNTPVFFIRDPLKFPDFIHTQKRNPQTNLRDATAAWDFWSRHPESMHQIMILFSDRGIPASLRNMNGYGSHTYSFINADNERFWVKFHFKTQQGHKFLTNAEAAKVVGEDRESSQRDLYDAIANGNFPRWNVRIQIMPEADAEKHNYSFDLTKVWPHKDYPLIDVGVLELNRNPQNYFAEVEQAAFAPNNNVPGIGFSPDRMLQGRLFSYQDAQRYRLGVNHHQIPVNAPKCPYHTTHRDGAMRVDHNGGTHPNYAPNRFDTYVPTHDQGPSLQLEREGAHFNFRDYDEDYYSQPAALYAIMDAAQRDRLAGNFAASLAEVTDDAIVEHQLVHFERVNTELANAIRTKLA

SEQ ID NO: 2249 - protein, 1142 aa, Saccharomyces cerevisiae
MAINGNSIPAIKDNTIGPWKLGETLGLGSTGKVQLARNGSTGQEAAVKVISKAVFNTGNVSGTSIVGSTTPDALPYGIEREIIIMKLLNHPNVLRLYDVWETNTDLYLVLEYAEKGELFNLLVERGPLPEHEAIRFFRQIIIGVSYCHALGIVHRDLKPENLLLDHKYNIKIADFGMAALETEGKLLETSCGSPHYAAPEIVSGIPYQGFASDVWSCGVILFALLTGRLPFDEEDGNIRTLLLKVQKGEFEMPSDDEISREAQDLIRKILTVDPERRIKTRDILKHPLLQKYPSIRDSKSIRGLPREDTYLTPLSESNSSIDATILQNLVILWHGRDPEGIKEKLREPGANAEKTLYALLYRFKCDTQKELIKQQQVKKRQSISSVSVSPSKKVSTTPQRRRNRESLISVTSSRKKPISFNKFTASSASSSNLTTPGSSKRLSKNFSSKKKLSTIVNQSSPTPASRNKRASVINVEKNQKRASIFSTTKKNKRSSRSIKRMSLIPSMKRESVTTKLMSTYAKLAEDDDWEYIEKETKRTSSNFATLIDEIFEYEKYEQIRKEKEELERKVREAKAREELERRRRKQEEKERARKLLEKEDLKRKQEELKKQIEIDISDLEQELSKHKEEKLDGNIRSISAPMENEEKNINHLEVDIDNILRRRNFSLQTRPVSRLDPGIMFSSPTEEVSPVEPKRTENERLTTEKKILETIRRSKFLGSSFNIDKELKLSKMEYPSIIAPQRLSEERVVSDSNDGYESLILPKDGNGVSQLKDSTATTAPVSDGRLRKISEIRVPQFTRKSRHFSESNKRLSVLSMYSTKESFTNLVDILKNGNLDVNNQQSQRIPTPRSADDSEFLFETVNEEAEYTGNSSNDERLYDVGDSTIKDKSALKLNFADRFNGSNEAKQTDNLHLPILPPLNGDNELRKQNSQEGDQAHPKIKSMIPESGSSSHTEKEEENEEKEEKKPEQHKQEEDQEKREKVVDDMEPPLNKSVQKIREKNAGSQAKDHSKDHLKEHKQDKNTAIGNGSFFRKFSKSSDKTMELYAKISAKQLFNGLEKLLRGWTQYGLKNIKSHPNNLTLTGKLSSDNIFSLRSTLFEVNIYPRGKMSVVQFKKVSGSFKAVKKLVNEVENVLNKEGVLQK

SEQ ID NO: 2250 - protein, 543 aa, Chlamydia trachomatis
MVAKNIKYNEEARKKIQKGVKTLAEAVKVTLGPKGRHVVIDKSFGSPQVTKDGVTVAKEVELADKHENMGAQMVKEVASKTADKAGDGTTTATVLAEAIYTEGLRNVTAGANPMDLKRGIDKAVKVVVDQIRKISKPVQHHKEIAQVATISANNDAEIGNLIAEAMEKVGKNGSITVEEAKGFETVLDIVEGMNFNRGYLSSYFATNPETQECVLEDALVLIYDKKISGIKDFLPVLQQVAESGRPLLIIAEDIEGEALATLVVNRIRGGFRVCAVKAPGFGDRRKAMLEDIAILTGGQLISEELGMKLENANLAMLGKAKVIVSKEDTTIVEGMGEKEALEARCESIKKQIEDSSSDYDKEKLQERLAKLSGGVAVIRVGAATEIEMKEKKDRVDDAQHATIAAVEEGILPGGGTALIRCIPTLEAFLPMLTNEDEQIGARIVLKALSAPLKQIAANAGKEGAIIFQQVMSRSANEGYDALRDAYTDMLEAGILDPAKVTRSALESAASVAGLLLTTEALIAEIPEEKPAAAPAMPGAGMDY

SEQ ID NO: 2251 - protein, 1146 aa, Populus tremula
MASQSQRQSNQPAHNQVQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCKLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2252 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDSALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2253 - protein, 445 aa, Unknown
  Silicibacter sp. TM1040
MKKFAMAALGGTLAGFVATTYVAAPLLAQESNNTTVYEQLDLFGDIFERIRAQYVEEVDEKELIEAAIGGMLQSLDPHSSYLSPDDASKMRVQTRGEFGGLGIEVTQEDGFVKVVSPMDGTPADEAGVEAGDFITHVDGESLLGLGLDEAVELMRGPVGSEIIITIVREGEDEPFDVSIIRDTIKLTAVRGRTEGDSVVLRVTTFNEQTTPNLEAKLEEQVEALGGMDNVNGIVLDLRNNPGGLLTQAISVADSFLESGEIVSTRGRNPEDGERFNATPGDLVGGKPIVVLINGGSASASEIVAGALQDHRRAIVVGTKSFGKGSVQTVMPLRSDGAMRLTTARYYTPSGRSIQALGVSPDIVVAQPRRRPEAEEDEPASSAFGPRSEADLRGRLNNDSLSEDEVRQIEADREKAEKAAELREQDYQLAYAIDILKGLSALGPKD

SEQ ID NO: 2254 - protein, 542 aa, Flavobacterium psychrophilum
MAKNIKFDIEARDGLKRGVDALANAVKVTLGPKGRNVIIGKSFGGPTVTKDGVTVAKEIELQDPLENMGAQMVKEVASKTNDLAGDGTTTATVLAQAIVKEGLKNVAAGANPMDLKRGIDKAVEAIVADLTKQAKVVGSDSEKIKQIASISANNDEVIGELIANAFAKVGKEGVITVEEAKGTDTYVDVVEGMQFDRGYLSPYFVTNPEKMDAELENPYILLYDKKVSSLKELLPVLEPVAQSGKPLLIIAEDVDGEALSTLVVNKLRGALKIAAVKAPGFGDRRKAMLEDIAILTGGTVISEERGFTLENTTIEMLGTAKRVTIDKDNTTIVSGAGEADMIKNRVNQIKGQMEASTSDYDKEKLQERLAKLAGGVAVLYVGAASEVEMKEKKDRVDDALHATRAAVEEGIVAGGGVALLRAKNVLKDIKADNADEATGIQIVSRAVEAPLRTIVENAGLEGSVVVAKVAEGSGDFGYNAKTDEYVDMLKAGIIDPKKVTRVALENAASVAGMILTTECALVEIKEENAGGGQMGGGMPGMM

SEQ ID NO: 2255 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2256 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHPAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTGLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2257 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2258 - protein, 366 aa, Sorghum bicolor
RPLEYAWNKAANILFAESPAGVVFSYSNTSSDLSMGDDKMAQDTYTFLVKWFERFPHYNYREFYIAGESGHFIPQLSQVVYRNRNNSPFINFQGLLVSSGLTNDHEDMIGMFELWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSEKAPFY

SEQ ID NO: 2259 - protein, 1197 aa, Xylella fastidiosa
MRGALLTALLVLVSLLTATAAVPEMPRFRVLDATSGLPSNVVRAMLQDAAGYLWLATSDGLARYDGTAFKVWRHDPNDSGSLPGDSVLALYIDVQDRIWVLSENAGLAVLDAQRRRFIQVPVGSVAKTDALHTLTGHGDAIWLSDLHASVIRIDSAGALTRYALADVSPTLKDTPVVALTFDANGRLWVGTPDGLLYFEAGRLHLAPPPLDKASIHSIAAVGSRLWVGSTDGVYLQDAEGRWRAPNWGPMFASGNLLLSVADAGDGEFWLGSERGLWRTRQERPPVQIPLSDMHHGVSTVSSLWRDTSGGLWVPVYGRGLGYLRQDWKRMAVVRPSDGGESAYCNVAPAAYSGGLWQLNRIGELMHLNTSTGELVHTGWQRHELRGMNITTTLEDSRGRLWLANMQNGLSRLDLKNGQWREWAAHEDDAVPLYGPISWIVEMPDSSLWLEALGVLQQRDLESGRVLNQIVPGSHGLDGSRVEQIGLGPDGRLWLAAGSGVYAWESQRRMFVPISDLTGTRAYSFVPVGGNEVWVHRLRGLEQWRHSSHGWKRVALVGPQHGLPAMESLGMQHDAQGRIWLSTRRGLWRIDNTDELQVRNFGLRDGLGTQEFAEACLWMAPDGVLVGGTTDGYLMLFDTAMPDPAPFVPQLRMETVSVIRAGRRIDLPVDQPFELLPNDRQLIVGARLLSFGDPLSNRYSYWLKGFDTGWIDQGSSGTREFSSLPPADYTLLIQGTDPMGNLSRIHLVTFRVLPPWWRSAWGMSVLTGSGLLLLWGVAWNYHRRLRRRACLQLEQHQREVAERASLAKTQFLATLGHEVRTPMTGVLGMSELLLETPLDTRQHGYATSIQAAGKHLLRLVNDALDLAKIEAGKLSLERRDFDFHALLEQVVAMIRPMVERKGLRFVYRLDPEVPQYVHGDTDRLQQILLNLLINATKFTEHGEVVLQVAPGQEQACLGVRIDVADTGPGLSEEQCQRLFRRFEQVNGASTAARYGGSGLGLAICRELATVMEGEIHVDSELGKGTCFRVLLPLPWVLAVQHAVAVMDAEPSPCSNPLHLLLIEDDPTVAEVIVELLRVRGHRVTHALHGLEALVEVTLTRFDACLCDLDLPGLDGAGLIVQLRAQGQFFPIVVVTARTDADAQRQALQVGCDAFLRKPVTGEMLEQVLTQVLSAPRQEADVDTPKKGMEWEGPGSVTR

SEQ ID NO: 2260 - protein, 364 aa, Corynebacterium glutamicum
MEPLVSKLFTPIQIRDITIPNRVWMSPMCTYSAATGSGLPTDFHQAHYAARAAGGVGLVMVEATGVNPVAPISPVDLGLWSHDQIEPFSRVTAAIRAGGAVPAVQLAHAGRKASTDAPWNGGGYVGPETNGWETVGPSPLAFPGLPAPRELTVSEIQEVVQQFAGAAVRADQAGFDVVEIHAAHGYLLHNFLSPISNKRTDSYGGSLENRARIVLEVIDAIRAVWPEEKPVFMRISTTDWVEENPQDDRESWTLSQSRQLALWASEHGVDLIDASSGGLDIVPIPHDRDYQTAKAADLHASTGVTVAAVGRIDDAQTAHNLVDSGDVNAVFLGRPLLKDPSWANQAALALGAEPRYVHQYDYVL

SEQ ID NO: 2261 - protein, 115 aa, Zea mays
  misc_feature (100)..(100): Xaa can be any naturally occurring amino acid
  misc_feature (111)..(111): Xaa can be any naturally occurring amino acid
HASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAXVYLMLVNDLIXGLYP

SEQ ID NO: 2262 - protein, 655 aa, Unknown
  Burkholderia sp. 383
MCGIDGFLNSVAFDEETARGTLARMTASLAHRGPDGQGIWVDPEAGIALGHRRLAIVDLSVHGRQPMASACGRYVMVFNGEIYNHRELRAELERAGRAPAWRGHSDSEVLIAAIVAWGVDATLRRATGMFSIALWNRESRVLTLARDRIGEKPLYYGRIGDALVFASELKALRGYPGFDGAIDRDALCLYLRQSSVPAPHTIYRGIHKLPPGTYIQFEHARDTPRLRAYWTLEQAIEDGRAQPFEGNADEAVSQLDAVLRQAVARQMEADVPLGAFLSGGVDSSTIVALMQAQSSTPVDTFTIGFHEAGYDEAGYAKAVARHLGTRHTELYVTADHALGVVPKLPSIYDEPFSDASQIPTFLVSEMTRRHVKVSLSGDGGDELFGGYTRYFLTPRLWRKLHRVPGAVRARIAAALHALRPDHADQLAAVAQGAWGGVEARESATRIGDRLHKLGHVMTAESRIGLYRLLMSSVHHPERLALSGQEPATPLDTVSAWPAHLSFAEQAMAIDTLTYLPTDILAKVDRAAMAVSLETRMPFLDHHVVEFAWRMPADLRLPEGQSKALLRRLLDRYVPSALIDRPKQGFCAPVDHWLRGSLRDWAEALLRPSRLREEGFFDAAAVERLWRQHVTGRMNWQHQLWTVLMFQAWLEAQRAT

SEQ ID NO: 2263 - protein, 484 aa, Saccharomyces cerevisiae
MADKIERHTFKVFNQDFSVDKRFQLIKEIGHGAYGIVCSARFAEAAEDTTVAIKKLTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGSLLDLEKELEFGLDRKYF

SEQ ID NO: 2264 - protein, 202 aa, Didymocistus chrysadenius
  misc_feature (25)..(25): Xaa can be any naturally occurring amino acid
  misc_feature (28)..(28): Xaa can be any naturally occurring amino acid
RFLFMKNKVRMICDCRASPVKVIQXIEXAQSLSLCGSTLRSPHGCHSQYMENMGSIASLVMSVTINESDDEVENGQPKGSKLWGLVVCHHTGPRFVPFPLRYACEFLIQVFGVQINKEVELAAQTREKHILQTQTVLCDMLLRDAPEAIITQSPNIMDLVKCDGAALYYRKKFWLLGVTPTEAQIKDIADWLLEYHSGSTGL

SEQ ID NO: 2265 - protein, 239 aa, Asparagus officinalis
MGRGRVELKRIENKINRQVTFAKRRNGLLKKAYELSVLCDAEVALIIFSNRGKLYEFCSSSSMLKTLERYQKCSYGAPDTSVQIRESQMLQSSHQEYLRLKARVEALQRSQRNLLGEDLGPLSSKELEQLERQLDSSLKQIRSTRTQYMLDQLADLQRREQMLCEANRSLRKRLEESSQANQQQVWEDANAMGYNRQPNQPHGDQFFHPLECQPTLQIGFQPDQMPGPSVSNYMPGWLA

SEQ ID NO: 2266 - protein, 115 aa, Zea mays
  misc_feature (45)..(45): Xaa can be any naturally occurring amino acid
  misc_feature (74)..(74): Xaa can be any naturally occurring amino acid
  misc_feature (76)..(76): Xaa can be any naturally occurring amino acid
HASSNTLDGLNGFDGTDTHYFHSGPRGHHWMWDSRLFNYGNWEVXRFLLSNARWGLEEYKFDGSRFDGVTSMMXTXHGLQVTFTGNFNEYFGFATDVDAVVYLMLVNDLIHGLYP

SEQ ID NO: 2267 - protein, 201 aa, Hymenocardia acida
FLFMKNKVRMICDCRASPVKVIQDSRLAHPLSLCGSTLRSPHGCHAQYMENMGSIASLVMSVTINESDDEVENSQPKGSKLWGLVVCHHSGPRFVPFPLRYACEFLIQVFAVQISKEVELAAQSREKHILQTQTVLCDMLLRDAPVAIITQSPNVMDLVKCDGAALYYRKKFWLLGVVPTEAQIKDIADWLLEYHSGSTGL

SEQ ID NO: 2268 - protein, 241 aa, Asparagus officinalis
MGRGRVELKRIENKINRQVTFSKRRNGLLKKAYELSVLCDAEVALIIFSSRGKLYEFGSAGTSKTLERYQRCCYTSQDAAIASHETQSWYQEVSKLKAKFESLQRSQRHLLGEDLGPLSVKELQQLERQLESALSQARQRKTQIMLDQMEELRKKERHLGEINKQLKAKLEAEGASFRAIQGSWESEAGVGGNAFSMHPSQSSAMDCEPTLQIGYHHLVQPEAALPRSSGGENNFMLGWVL

SEQ ID NO: 2269 - protein, 115 aa, Zea mays
  misc_feature (57)..(57): Xaa can be any naturally occurring amino acid
  misc_feature (76)..(76): Xaa can be any naturally occurring amino acid
HASSNTLDGLNGFDGTDTHYFHSGPRGHHWMWDSRLFNYGNWEVLRFLLSNARWWLXEYKFDGFRFDGVTSMMYTXHGLQVTFTGNFNEYFGFATDVDAVVYLMLVNDLIHGLYP

SEQ ID NO: 2270 - protein, 202 aa, Jablonskia congesta
RFLFMKNKVRMICDCLASPVKVIQDKKLAKPLSLCGSTLRSPHGCHAQYMANMGSIASLVMSVTINDNEDEMESDQSNGRKLWGLVVCHHASPRFVPFPLRYACEFLIQVFGVQISKEVQLAAQMREKHILQTQTVLCDMLLRDAPVGIITQSPNVMDLVKCDGAALYYRKKFWLLGVTPTETQIKDIVEWLIEYHSESTGL

SEQ ID NO: 2271 - protein, 147 aa, Brassica napus
MDMNPNTTLPPGFRFHPTDEELIVYYLKNQTMSRPCPVSIIPEVDIYKFDPWQLPEKTEFGENEWYFFSPRDRKYPNGVRPNRAAVSGYWKATGTDKAIYSGSSNVGVKKALVFYKGRPPKGIKTDWIMHEYRLNDSRKASTKRTVR

SEQ ID NO: 2272 - protein, 224 aa, Asparagus officinalis
MGRGRVELKRIENKINRQVTFAKRRNGLLKKAYELSVLCDAEVALVVFSTRGKLYEFCSSPSMLKTLDRYQKCSYGAPDTSVQIRENQMLQSSHQEYLKLKARVEALQRSQRNLLGEDLGPLSSKELEQLEKQLDSSLKQIRSTRTQYMLDQLGDLQRKEQMLCEANRSLRKRYAQLEEASQANQQQVWEANANAMGYSRQPSQPQGEEFFHPLECQPSLGGQC

SEQ ID NO: 2273 - protein, 115 aa, Zea mays
  misc_feature (17)..(17): Xaa can be any naturally occurring amino acid
  misc_feature (45)..(45): Xaa can be any naturally occurring amino acid
  misc_feature (55)..(55): Xaa can be any naturally occurring amino acid
  misc_feature (76)..(76): Xaa can be any naturally occurring amino acid
HASSNTLDGLNGFDGTXTHYFHSGPRGHHWMWDSRLFNYGNWEVXRFLLSNARWXLEEYKFDGFRFDGVTSMMYTXHGLQVTFTGNFNEYFGFATDVDAVVYLMLVNDLIHGLYP

SEQ ID NO: 2274 - protein, 345 aa, Bradyrhizobium japonicum
MTGQLRLDDHLQRYSETAPHALAVATAVDAIAAAAIEIADLIGAGDLADASGLTTGRNSDGDVQRDLDVQADAILRRCLGKLSIAALASEEMREPQIGDRAARICVAIDPLDGSSNIDINMTVGTIFSILPAPDDLALAFHQRGSAQFAAGFVTYGPQTSLVLTLGDGVDIFTLDRKAGCFRLARSAIQISEAGEEFAINASNRRHWDPPVRAFIDECLAGVEGPANHDFNMRWVGSLVAEAYRILTRGGVFLYPSDARPGYGDGRLRLTYEAHPMAYIIEQAGGSASTGRERILDLSAQSLHQRVPLIMGSSNEVRRVEELHCDPLLVASISAPLFARRGFFRL

SEQ ID NO: 2275 - protein, 876 aa, Unknown
  Frankia sp. EAN1pec
MGRHGRPRAPAEVYRWDDVTTEHGADRHVGPSPATGAVRVDVLYHTGVGRRIANGARLVGSWDEHGLQAGSWSSTPMEEFTAEDGCAAYRATVTVDASVSRTFDWGVWLTRPDGSQVWGIPAEVPDPGATEQVRRFEVGPGCGPVVRAEFRLAAHRHNGARRVLPVGSRDLGSPVSTVSTGGGSGGPSGPSGSGAAVSSDARERIRFRVWAPHALAVEVAFAGPGGYIADDGHGEDELITRLPMRQVGDGWWEAAAPGFADWVGRRYLYRVTRDDGSVAWRSDMYSAQQCGTGDIDPCGAPHDGPAEDLDGSVSCSVVVDTRDDERFWADEFDPARPVPRRVEDLVIYELHVGALGFGHTGAGTFADALAFVDHLTDLGVNAVELLPMFEFAGTRSWGYGSSHFLAVKQSAGGRAALRRFVRACHQRGVAVLMDVVYNHYTPNAQRSAWQYDSTAPSRNIYYWYEGAEDDHPHPDGGYLDNVSSGWAPRYSDENVRALFVASAVALLDEFHIDGLRVDQTTSIHAYNSLHADGRPVAAANIAGRKFLRELCQTLRLVDPDVILIAEDHSGWAEVTRPAESGGLGFDAHWYVDFYHHLVGDKGEGPEYAKLLHTAGRDPAGPLAMSLFAKAFTAAADRTVVYTESHDEAGNSEHSARNILVAVDHAPLHGDTAWFAFARLRCAAALTLLSPGTPMFLMGDEVGARRAYTHDGFAEAKEDLAGLRAGEGAELFACYRALVTLRLGSPALRSRAVELVGADDTARVLAFRRWDRGEEILVVVSLNNDPLPRFGLSHPSLAGRRWKPVLDTDAPRFGGRAGGSRRSLSPRGDSVRVDLPAAGAVVFRRRRRGAGLTDGPSDVPARPRRLRLPGVRRRGGR

SEQ ID NO: 2276 - protein, 540 aa, Bacillus clausii
MDESKKAPSFGTNVTGQGDALDQRKAANEKDDTLTTRQGHPVKDNQNVRTVGNRGPMTLENYDFLEKISHFDRERIPERVVHARGAGAHGYFQSYGKVGEEPISKYTRAKVFTNTEVKTPVFVRFSSVIHGIHSPETLRDPRGFAVKFYTEDGNWDLVGNNLKIFFIRDPLKFPDMVHAFKPDPVTNRQSMERFFDFVSQSPESTHMITFVFSPWGIPANYRNMQGSGVHAYKWVNEEGKAMLVKYHWEPVQGIKNLTQKEAEQIQGKNFNHATQDLYEAIEKGDYPEWELYVQLMEDGEHPELDFDPLDPTKLWYKDQFPWHKVGKMVLNKNPENYFAEVEQAAFGTGVLVDGLDFSDDKLLQGRTFSYSDTQRYRVGPNYLQLPINAPKKRVATNQRDGQMTYHVDSPPGINPHVNYEPSVLNGLKEAEKVNPDHTPHVSGEVKYEAISRPNNFGQAGETYRRFSDWERDELIANLADALADVDKRIQKQMIENVTEADRDYGKRLEEAIKRVQESVDDKEGHAVKEAEQEGMPSDPY

SEQ ID NO: 2277 - protein, 724 aa, Xanthomonas axonopodis
MSNRWDSGVVRALAEARHGDAFAVLGAHPSDKGRLLRTYLPGADRVGAVLDDGQVVALDAGPEPGLFAGELPAHGGYRLRIGWPGGEQETADPYAFGPQLSDFDLHLISEGHHLQLADALGANVVEVEGVRGTRFAVWAPNASRVAVVGDFNSWDARRHPMRLRHQSGVWELFVPDVGPGAHYKYQLRGPHGHELPAKADPVARRAELAPGTASIVADPTPHQWSDDGWMATRARRQAHDAPMSIYEIHAGSWLREAGVDLDWDGLADRLIPYVADMGFTHVELMPVSEHPFGGSWGYQPLGLFAPTARFGTPDGFARFVDRCHREGIGVIVDWVPAHFPTDAHGLAHFDGTALYEHADPREGFHRDWNTLIYNHGRREVSGFLIASAMEFLQRYHVDGLRVDAVASMLYRDYSRNAGEWIPNIHGGRENYETIAFLRRLNEVVREHTPGAVMIAEESTAFPGVTAEVAHGGLGFHYKWNMGWMHDTLHYAGLDPIYRRYHHGELTFSMVYAYSERFVLPISHDEVVHGKGSLLGRMPGDDWQRFANLRAYLGFMFTHPGRKLLFMGCEFGQPTEWNHDAGLPWHLLDDPRHRGVQTLVRDLNRLYVQYPALHAHDDDPSGFAWVVGDDAGNSVVAFLRKGKRGDAPVLVVINFTPVVQHAYRIGVPQGGQWREVFNSDAGIYGGSNLGNGGSVTAEQQSMHGHAQSLPLLLPPLGAIVLTPYG

SEQ ID NO: 2278 - protein, 349 aa, Xanthomonas campestris
MSAASVKGPIHHGEPCVPSSGLDPRVAPTPHPATPPQRAGKARRFGSLRRWVDSQTDEPLDEARADRIDWLRALPFIALHLACFAVFWVGVSWFAVSMAVALYALRMFALTGFYHRYFSHRAFKTSRVVQFVFAAIAATCVQRGPLWWAAHHRNHHRHTDTGRDPHSPAQHGFWWSHTGWFLTPRNFRTDWEVIPDLRRFTELRFLDRFDIVMPVLLALGLYLLGDWLAAAAPGLHTSGAQLLVWGFVLSTVALFHATFTINSLAHRFGSRRFDTRDDSRNNWLLALLTFGEGWHNNHHFFPGSARQGVRWWEYDMTWYGLTVMSWVGLVWDLKPMPAMLTRRAGRVAR

SEQ ID NO: 2279 - protein, 479 aa, Streptomyces coelicolor
MLESATPVTPVTFPPAFLWGAATSAYQIEGAVREDGRTPSIWDTFSHTPGKTAGGDTGDVAVDHYHRYRDDVALMKDLGLGAYRFSISWPRVQPTGRGPAVQRGLDFYRRLVDELLAAGIKPAVTLYHWDLPQELEDAGGWPERDTAYRFAEYAQIVGEALGDRVEQWITLNEPWCAAFLGYASGVHAPGRTDPAAALRAAHHLNLAHGLGTVALRSVMPARNSVAISLNTSVVRPLSQSPADLAAARKIDDLSGGIFHGPILHGAYPQTLLEATAPLTDWSFVQDGDLGQIRQPIDAICLNYYTPTVVSAADADSRAPRADGHGASDHSPWPAAEDVAFHQPPGERTEMGWTVDPTGLHELIMRYNREAPGMPLYISENGAAYDDKPGADGTVHDPDRVAYLNGHLTAVRQAIADGADVRGYYLWSLLDNFEWAYGYEKRFGAVYVDYASQQRTPKSSALWYGRAARTGTLPPVDAAE

SEQ ID NO: 2280 - protein, 498 aa, Micrococcus luteus
TTPHATGSTRQNGAPAVSDRQSLTVGSEGPIVLHDTHLLETHQHFNRMNIPERRPHAKGSGAFGEFEVTEDVSKYTKALVFQPGTKTETLLRFSTVAGELGSPDTWRDVRGFALRFYTEEGNYDLVGNNTPIFFLRDPMKFTHFIRSQKRLPDSGLRDATMQWDFWTNNPESAHQVTYLMGPRGLPRTWREMNGYGSHTYLWVNAQGEKHWVKYHFISQQGVHNLSNDEATKIAGENADFHRQDLFESIAKGDHPKWDLYIQAIPYEEGKTYRFNPFDLTKTISQKDYPRIKVGTLTLNRNPKNHFAQIESAAFSPSNTVPGIGLSPDRMLLGRAFAYHDAQLYRVGAHVNQLPVNRPKNAVHNYAFEGQMWYDHTGDRSTYVPNSNGDSWSDETGPVDDGWEADGTLTREAQALRADDDDFGQAGTLVREVFSDQERDDFVETVAGALKGVRQDVQARAFEYWKNVDATIGQRIEDEVKRHEGDGIPGVEAGGEARI

SEQ ID NO: 2281 - protein, 761 aa, Unknown
  Silicibacter sp. TM1040
MSLAEKLAQERRARLAAERLLELKQAELTDANRKLGRHALALTKRIGATQAEIATFKNENEKVKSDLNTANEKVEQAERRLWHSIQAFQDGFAFFDSDSKLIGANTAYLNIFEGVEEVSPGVSYVRILQILTDEGLIDTEELSADSWRAMMTERWMSPAPEPTVVRLWNDRYLKLIDQRGHDGDIVSLALDITATVHYEEELRSARERAEAANRAKSAFLANMSHEIRTPMNGVVGMAELLSDTTLTEEQRLYANTIKNSGEALLVIINDVLDYSKIEADKLALHPEAFDLEACMHEVVMLLQANARDKGLTLLVDYDLFMPTNFIGDPGRIRQILTNLIGNAIKFTNEGHVTARVTGVPHPEDNTVMLHISIEDSGIGIPDDKIQHIFGEFNQVEDETNRQFEGTGLGLAITERLIKLMDGEIWVESQLGKGSCFGFRLPLVVADGSQVNAPELPENLNCVMIVDDMDINREILNRQLQRLDLKVVAVTSGAEALDVLNAEIDLVITDRNLPGMDGLKLARSLHHASPQTPVLLLSSDPADGSDPALSDLFAGILQKPIPRGALFRALSKLDAPSVHPARPQDVPPAAPAIEPPSDAPVQVPAPEAGVDFGSGATIASDLRRMRVLAAEDNRTNQLVFRKMVKDMNIDLRFAGNGLEAVELYQSFKPDMIFMDISMPKMDGKEATQAIRELEKENGRRVQIVALTAHAMDGDSEGILAAGLDDYLTKPLRKSVIHDRIMKNMPTAVAPLQGEGDDLQATG

SEQ ID NO: 2282 - protein, 540 aa, Burkholderia vietnamiensis
MTAKDVKFRDGARSQIVKGVNVLADAVKVTLGPKGRNVVIERSFGAPVITKDGVSVAKEIELKDRFENMGAQIVKQVASKTADVAGDGTTTATVLAQAIVQEGMKHVAAGMNPMDLKRGIDKAVGVVLEELRTLSRPISTHKEIAQVGAISANADDAIGKIIADAMEKVGKEGVITVEDGKSLDNELDVVEGMQFDRGYISPYFINDPEKQAAYLDDALILLHDKKISNIRDLLPILEAASKAGKPLLIVAEDVEAEALATLVVNAMRGILKVAAVKAPGFGDRRKAMLEDIAILTGATVISEETGKQLDKATLDDLGSAKRVEVRKDDTIIIDGAGDAARIDARVKSIRVQIDEATSDYDREKLQERVAKLAGGVAVIKVGAVTEVEMKEKKDRVDDALHATRAAVEEGIVPGGGVALLRARAALTDLKGANGDQDAGIRIVLRALEAPLRVIASNAGDEPSVVIAKVLEGSGNFGYNAATGEYGDLVEAGVVDPTKVTRTALQNAASIAGLVLTTDATVADAPKDERAEAAPSPELGY

SEQ ID NO: 2283 - protein, 115 aa, Zea mays
  misc_feature (17)..(17): Xaa can be any naturally occurring amino acid
  misc_feature (55)..(55): Xaa can be any naturally occurring amino acid
  misc_feature (106)..(106): Xaa can be any naturally occurring amino acid
HASSNTLDGLNGFDGTXTHYFHSGPRGHHWMWDSRLFNYGNWEVLRFLLSNARWXLEEYKFDGFRFDGVTSMMYTHHGLQVTFTGNFNEYFGFATDVDAVVYLMLXNDLIHGLYP

SEQ ID NO: 2284 - protein, 201 aa, Martretia quadricornis
IPFQKKKVRMICDCRASPVKVIQDDRLAQPLSLCGSTLGSPHSCHAQYMENMGAIASLVMSVTIHEDGDEVENDQPKGSKLWGLVVCHHTSPRFVPFPLRYACEFLIQVFGVQISKEVEMASQKREKHILQTQTILCDMLLRDAPVAIIAESPNVMDLVKCDGAALYYRNKFWLLGVTPTEEQIKDIADWLLEYHSESTGL

SEQ ID NO: 2285 - protein, 201 aa, Pentabrachion reticulatum
ILFMKNKVRMICDCLAPPVKVIQDKRLAQPLSLCGSTLRSPHGCHSQYMANMGSIASLVMSVTINEDDDEMDSDQERGIKLWGLVVCHHTSPRFVPFPLRYACEFLIQVFGVQVSKEVQLAAQAREKHILQTQTVLCDMLLRDAPVAIITRSPNVMDLVKCDGAALYYRKKFWLLGVTPTEAQIKDIADWLLEYHGGSTGV

SEQ ID NO: 2286 - protein, 1041 aa, Desulfotalea psychrophila
MKRYFFSVISVCFLVVWAIPALASDLQLTPAEQSWLRAHPDIRLGVDPDYAPFESIEGGVYVGLAADYVSLVSKKLGLSLVPVPDLTWKEVMALAEQGELDLFPAVVQTPERNELWLFAKPHMAYSTVIFTRDDYWNVFGLADFAGKKVAVVRGYAILDFIRSAHPHLDIVLVDSVDMGLRQLEAGRVSAFVNDIATGVSAIQKMNLKNLKIAAYTDLKDKGLGFAVRKDWPELVAMIDKVLASITPEEHAAIHNRWIKVESFSPWQHWARWLFIGLAMVAVSLLAFTGWIYLLRKQVASRTTKLQASEAWTVAILDTASNPIITIDEDETVLSFNLGAERSFAYSAEEIIGQKVKILLPDLYEKYEDEFATSFFAKDDAHLIDMDREIDARRKNGTIFPIHLSVGEMIVSGKRMFVIILVDLSVQKQRNLELELARDAAEAAMEAKAIFLANMSHEIRTPMNAILGFLAIVLESSSLPADLRKHIVTAHGSAESLLVIINDVLDVSKFDSGRMELVFSVFHLPRTIGKALQTLYMPAQEKELNIHLNYDEDLPYCFLGDSVRLRQVIINLVANAIKFTEEGSITIEVKGTSGEDDLLLFTVVDTGIGIRPEQVARIFEPFTQADDSSTRNIGGTGLGLAICKEIVDLMGGRIWVESEKGKGSSFNFMVPLPRAECIKDCPKAGRPAETGDDCPKLAELSERAEPVSRKIFRILLAEDMKDNAELAQFRLEQQGHIVTHVWNGLEAVEAFQRDEFDLIFMDVQMPVLDGHSATRQIRKIERGAGGYIPIFALTASVMREDREKCIAAGMDVIIGKPIDFQFLFAKMEEIVSEGVGVVQRGWIDFSPVMAVAAVEQGLLTWANSVVYAGTLIDFSEAHLGDASTLQQLFQQNDIRGMQCLIHTLKGVAENLALSDLVKIISDVDSSLLMDDRERTTLLLLDLKEALKNVVVATGQLALAGEGAVQPVKKEDLKKIGDLLAELLVQLEEDNPAVVEPLVAELSQYLSQNDLLLLQKNIDDFEFVRAKLQVRKLADMLAIKLEV

SEQ ID NO: 2287 - protein, 201 aa, Poranthera microphylla
  misc_feature (199)..(199): Xaa can be any naturally occurring amino acid
DPFMKNKVRMICDCLATPVEVIQDKRLAQPLSLGGSTLRSPHGCHAQYMANMGSIGSLVMAVTVNEDDDEIDNDQVRGRKLWGLVVCHHTSARFVPFPLRYACEFLIQVFSVQVNKEVELAAQMKEKHILQTQTVLCDMLLRDAPVGIITQSPNVMDLVKSDGAALYYRKKFWLIGVTPTEAQIRDIADWLLQYHGGSXGL

SEQ ID NO: 2288 - protein, 115 aa, Zea mays
  misc_feature (45)..(45): Xaa can be any naturally occurring amino acid
  misc_feature (64)..(64): Xaa can be any naturally occurring amino acid
  misc_feature (106)..(106): Xaa can be any naturally occurring amino acid
HASSNTLDGLNGFDGTDTHYFHSGPRGHHWMWDSRLFNYGNWEVXRFLLSNARWWLEEYKFDGXRFDGVTSMMYTHHGLQVTFTGNFNEYFGFATDVDAVVYLMLXNDLIHGLYP

SEQ ID NO: 2289 - protein, 200 aa, Reverchonia arenaria
DPVMKNKVRMICDCQAPPVNVVQDKRLAQPISLSGSTLRSPHGCHAQYMENMGTIASLVLSVTINEDDDETDNDQKIGRKLWGLVVCHHTNPRFVPFPLRYACEFLMQVFGVQISREVELAAQTTEKHILQTQTVLCDMLLRDAPVAIVTQSPNVMDLVKCDGAALYYRKKFWMLGVTPTEAQIKHITEWLLEYHGESTA

SEQ ID NO: 2290 - protein, 202 aa, Savia bahamensis
RFYLSKNKVRMICDCQATPVKVVQDKRLTQPLSLCGSTLRSPHGCHAQYMANMGTTASLVMSVTINEDDDEADNDQQIGRKLWGLVVCHHTSPRFVPFPLRYACEFLMQVFGVQLNKEVELAAQTREKHILQTQTVLCDMLLRDAPVAIVTQSPNVMDLVKCDGAALYHQKKFWLLGVTPTEAQIKDITEWLMEYHGESTGL

SEQ ID NO: 2291 - protein, 110 aa, Quercus suber
SLDIWDPFEGFSAVASVPPSARETTAFATARIDWKETPEAHIFKADLPGLKKEEVKVEVEDGNVLQISGERSKEHEEKNDKWHRVERSCGKFMRRFRLLENAKVDQVKAN

SEQ ID NO: 2292 - protein, 241 aa, Glycine max
MGRGRVELKRIENKINRQVTFAKRRNGLLKKAYELSVLCDAEVALIIFSNRGKLYEFCSSSSMLKTLERYQKCNYGAPEANVSTREALELSSQQEYLKLKARYEALQRSQRNLMGEDLGPLSSKELESLERQLDSSLKQIRSTRTQFMLDQLSDLQRKEHLLSEANRSLRQRLEGYQINPLQLNPGVEEMGYGRHPAQTHGEALFQQMECEPTLQIGYQPDPVSVVTAGPSMSNYMAGWLP

SEQ ID NO: 2293 - protein, 92 aa, Quercus suber
SLDIWDPFEGFSAVASVPPSARETTAFATARIDWKETPEAHIFKADLPGLKKEEVKVEVVDGNVLQISGERSKEHEEKNDKWHRVRGAVASL

SEQ ID NO: 2294 - protein, 488 aa, Bacillus clausii
MRRLTDNQGHPIYDNQNSRTAGQHGPTLLEDYHLVEKLAHFDRERIPERVVHARGAGAHGVFKVKNNMKRYTKANFLSEDGKETPVFVRFSTVIHGGTSPETLRDPRGFSVKFYTEEGNYDFVGNNLPVFFIRDAIKFPDVIHSLKPDPRTNIQSPDRYWDFMSLTPESTNMLTHLFTDEGIPASYREMRGSSVHAFKWVNEHGNMVYVKLNWVPKMGIRNLSMEEAANIQAHDFNHATRDLYEAIERGDYPEWDLYVQILDPADLDNFDFHPLDATKDWLEEDIPSQLVGTMTLNRNPENVFAETEQVGFNPGNLVPGFEPSEDKMLQGRIFSYSDTQRYRVGANYLDLPINCPFAQKANNTRDGAMPIGQQTNRINYEPNRYQDTPKEAEGYEDYRAPINGTIGRIAIEKKNNFGQAGKIYRNYPKNVQDALIKNIANDLKQVAPETALRAICNFYRADEDYGQRLADAIGMDISEYVKHGSENNS

SEQ ID NO: 2295 - protein, 375 aa, Arabidopsis thaliana
MVMMKKMKGSQSFRQRLLLSTLSSTPISIDEIRADETIPGLRPHEVNLLRLLEIVTDDAVVDINETGTRLKYKPGTIVGGKNLVHSCSLSRSIGYYLEPLLLLGLFGKKPLSIRLKGITNDPRDASVDTFRSTTLNIIKRFGVPAEDLELKIEARGVAPNGGGEVLLTVPNIKTLSAVHWVEEGMVKKIRGTTFSTRVTSDFEHSMRFAARGIFNNLLPDVHIFQDHRAGAQAGKSPGYGISLAAETTTGCFISADTTVSCERPDETGELDVEKKERSPAEDTGVEVASWLLQEIEKGGVVDSTHQGLLFLLCALSEQDVSKVRVGTLSPYAVETLRNIKEFLGVKFAIKPDPLTGTVILKCTGSGLINLSRKLS

SEQ ID NO: 2296 - protein, 595 aa, Kluyveromyces lactis
MRVGNSNSIKKNVSECLSPNPVYYRNPITFKKANEFNNGKRERPLALLGDSIHADSKNSRQQLDDTVDNRLVIHWFRGDLRVRDNTGLAYALNQSKSGSVEALYVINEHDWIAHMESGWKLKFQLDALRSLSRELAKLGVRLHVKYFIPESPCLSNSREYAQWFSHIIEEIAASKNYDGNSKDDTKDDTDADEPALKKRKKDNDENQKGGSPNILVTANLQYEVDELYRDLKICRLQTQSSNSANFTLKLFHDMCIIEPGILKTGKGSQYTIFTPWYKKWVSFLEANQKDKHTICIEASIPQSSNREKVNPEEIKYQLPDKFMSEMPEQTLNIPKADEETALKKLTEFISKRASKYNNDKDLLDLTGTSLLSCYVTSGVISARTILNQSYQANNSRLMNKDIKKNNSLETFIKEVAWRDFYKHAISYWPFLSMDLPFKFETLNIKWENDVFLFEKWCYGETGIPIVDAIMLKMLKTGYINNRSRMITASFLAKNLLIDWRWGERWFRKHLIDYDTASNVGGWGFCASTGIDCQPYFRVFNMKLQSEKYDPEGKFIRHWLENDENDSDNVHEPKPNAIVDLRDSRERVLERFREVM

SEQ ID NO: 2297 - protein, 502 aa, Myxococcus xanthus
MNGASGNGASDGVGASRRESVLQRRLSLADMLDLPSFVEVVRSFSELYRVGIKVMDTAGDKLADVKVGHGDFCSYVFGFPEGRSRCTATVARVKDGPVALVQGARPARGDGAEAAGIIALPCFTGLRYLVMPVCWEGDTLGRVILGPFTPEELADFPPSLTDISGVDLSRAHELVARVRRVPERTAAQVLVHFGQVLAALVASGQRAFLATQLHIEAMLETHRDLEANNARLAQANIRLKELDRLKSTFLGTVSHELRTPLASIIGYSEMLAEGLAGALNPEQLLYVRTIVEKGESLLNLISSILDLSQIEAGRLRLVMGPVDLGSVIQTAVSSVAPQAQRKGVELEVRLPPLPQPRLAADADKLRQVVVNLLANAVKFTSSGGRVSVVMSEATAQHELAAPGYRVCVEDTGMGIREDQFENIFQSFYQVDGSSTREHGGAGLGLAIVKSLVEGHGGRVSVESEFGRGSRFTVVLPLQPPLSEHGGFSALAPTPSPSGHDRF

SEQ ID NO: 2298 - protein, 577 aa, Lycopersicon esculentum
MIKQPFLLTKFTPFSSKSKHTLFTFHCNFSIKMASLTARTTPTVQNVPGLTPEEMERVCEQTFQRYESGGLGKRKGKGVAIVWFRNDLRVLDNEALLRAWVSSEAILPVYCVDPRLFGTTHYFGMPKTGALRAQFIIECLNDLKRNLVKRGLDLLIQHGKPEDIVPSLAKAYKAHTVYAHKETCSEEVKVEKMVTRNLQKLVSPSSGGIGNDPGSGNTTKLELVWGSTMYHIDDLPFDCESLPDVYTQFRKSVEYKSKVRNCTKLPTSFGPPPEVGDWGHVPQVSELGLQQEKVSKGMNFVGGESAALGRVHDYFWKKDLLKVYKETRNGMLGADYSTKFSPWLASGSLSPRFIDEEVKRYEKERLSNDSTYWVLFELIWRDYFGFLSIKLANLLFQAGGPQKVNINWSQDQTMFDAWRRGQTGYPLIDANMKELAATGYMSNRGRQIVCSFLVRDMGIDWRMGAEWFETCLLDYDPCSNYGNWIYGAGVGNDPREDRYFSIPKQAQNYDPEGEFVAYWLPELRALPREKRHSPGMMYLNPIVALKHGYTKKTGDSKTAFSSRRGRPEDNRRKRHGY

SEQ ID NO: 2299 - protein, 241 aa, Nicotiana sylvestris
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLTDLQRKEHALNEANRTLKQRLMEGSQLNLQWQQNAQDMGYGRQTTQTQGDGFFHPLECEPTLQIGYQNDPITVGGAGPSVNNYMAGWLP

SEQ ID NO: 2300 - protein, 470 aa, Dechloromonas aromatica
MKKEKALVWFRRDLRDHDHAALSAALAEAQQVYCAFVFDSEILDPLPTRHDRRVHFIRESLVELDAALRARGGGLIIRHGQAVDEIPALARRLGVSAVFTNRDYEPSAKRRDAQVARQLRNDDIAFHGVKDQAIFDGDEVLTQAGKAFSVFTPYKNAWLKRLTTADYAAWPCDGRLAGQELAGIPTLEEIGFTPTDLAELGIQPGMSGAKGLWDDFSRDRIERYGSLRDFPAVKGVSYLSVHLRFGTISIRQLVRQALAHQADTWLSELIWRDFYFMILDHFPHVAGHAFKPEYDAIQWASRPEAFAAWCEGCTGYPLVDAAMRQLNFSGWMHNRLRMVVASFLTKDLGIDWRLGEKYFAEQLNDFDLSANNGGWQWASSSGCDAQPYFRIFNPVTQSEKFDAEGKFIRRYVPELAKVHDKYIHAPWKMGRIEQEALGVVIGRDYPSPIVDHATARDETLARYAVVKKQA

SEQ ID NO: 2301 - protein, 249 aa, Unknown
  Synechococcus sp. WH 8102
MQSSLHALPVLQDNVLWIWVRGDEAAVVDPAVAEPVIDWLQQRQLQLSAVLQTHHHADHIGGTPGLLERWPDAAVVAAGADRSRIPFQTISVSDGDQVTVLGRSLQVLDVAAHTSAHIAFVIPEQEDPDLGPVVFCGDTLFSGGCGRLFEGTPADMHRALRRLSELPESTKVCCAHEYTEGNLLWAIQQQPQDAAIRQRYDAVVDLRRRGELSLPSSIGEERRSNLFMRAASAEELGRLRRHKDHWRAA

SEQ ID NO: 2302 - protein, 115 aa, Zea mays
  misc_feature (83)..(83): Xaa can be any naturally occurring amino acid
  misc_feature (100)..(100): Xaa can be any naturally occurring amino acid
HASSNTLDGLNGFDGTDTHYFHSGPRGHHWMWDSRLFNYGNWEVLRFLLSNARWWLEEYKFDGFRFDGVTSMMYTHHGLQVTXTGNFNEYFGFATDVDAXVYLMLVNDLIHGLYP

SEQ ID NO: 2303 - protein, 115 aa, Zea mays
  misc_feature (17)..(17): Xaa can be any naturally occurring amino acid
  misc_feature (100)..(100): Xaa can be any naturally occurring amino acid
  misc_feature (106)..(106): Xaa can be any naturally occurring amino acid
HASSNTLDGLNGFDGTXTHYFHSGPRGHHWMWDSRLFNYGNWEGLRFLLSNARWWLEEYKFDGFRFDGVTSMMYTHHGLQVTFTGNFNEYFGFATDVDAXVYLMLXNDLIHGLYP

SEQ ID NO: 2304 - protein, 254 aa, Triticum aestivum
  misc_feature (172)..(172): Xaa can be any naturally occurring amino acid
NKFVQKSLPVPVRNSRDIVDPRVRLIFSKGSSQVIAQYYQLIRLGCEGYRNIMDNCQENAMVLKEGLERTGRFNIVSKDQGVPLVAFSLKDSSRYYEFEISEFLRRFGWIVPAYTMPPDAQHVTVLRVVIREDFSRTFAERLVIDIEKALHELDALPSCSSGPAPAAPPTGXPVSKKDLPRQRELVSVWKEGRPPPGRKTQGVLLDGGALHLLTWLAGDLMNPITCLLNTFWGGISLILKLAYYLPLWAMKDFF

SEQ ID NO: 2305 - protein, 199 aa, Spondianthus preussii
KISFLKNKVRMICDCLAPPVKVIQDKRLTQPLTLCGSTLRSPHGCHAQYMANMGSIASLVMSVTINEDDDETESDQSKGRTLWGLVVCHHTSPRFVPFPLRYACEFLIQVFGVQINKEVELAAQTREKHIFQTQTVLCDMLLRDAPVAIITQSPNVMDLVKCDGAALHYKSKFWLLGVTPPEAQIRDIAEWLLEYHSGS

SEQ ID NO: 2306 - protein, 115 aa, Zea mays
HASSNTLDGLNGFDGTDTHYFHSGPRGHHWMWDSRLFNYGNWEVLRFLLSNARWWLGEYKFDGFRFDGVTSMMYTHHGLQVTFTGNFNEYFGFATDVDAVVYLMLVNDLIHGLYP

SEQ ID NO: 2307 - protein, 115 aa, Zea mays
  misc_feature (76)..(76): Xaa can be any naturally occurring amino acid
HASSNTLDGLNGFDGTDTHYFHSGPRGHHWMWDSRLFNYGNWEVLRFLLSNARWWLEEYKFDGFRFDGVTSMMYTXHGLQVTFTGNFNEYFGFATDVDAVVYLMLVNDLIHGLYP

SEQ ID NO: 2308 - protein, 110 aa, Quercus suber
SLDIWDPFEGFSAVASVPPSARETTAFATARIDWKETPEAHIFNADLPGLKKEEVKVEVEDGNVLQISGERSKEHEEKNDKWHRVERSCGKFMRRFRLPENAKVDQVKAN

SEQ ID NO: 2309 - protein, 110 aa, Quercus suber
SLDIWDPFEGFSAVASVPPSARETTAFATARIDWKETPEAHIFKADLPGLKKEEVKVEVEDGNVLQISGERSKEHEEKIDKWHRVERSCGKFMRRFRLPENAKVDLVKAN

SEQ ID NO: 2310 - protein, 917 aa, Pseudomonas chlororaphis
MLKKLGIKGRVLLLTLLPTSLMALVLGGYFTWMQQSDLQTQLLQRGEMIAEQLAPLVAPALAHQNTALLERIATQSLEQQDVRAVSFLAPDRTPLAHAGPSMLNQAPTGNGSQMLQRTGSDATRYLLPVFGRHRNLAGDLIPDESDRLLGWVELELSHNSMLLRGYRSLFASLLLITAGLICTGLLALRMGRTINNPLSQIKQAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIHDTGIGLSNQDVRALFQAFSQADNSLSRQPGGTGLGLVISKRLIEQMGGEIGVDSTPGEGSEFWISLRLPKTRDDAEDLPAPPLLGRRVAVLENHELARQALQHQLEDCGLEVTPFNTLEALTNGVTGVHQTEQAIDLAVLGITTNDMPPERLNQHIWDLEHLGCKVLVLCPTTEQTLFHLSVPNPHSQLQAKPACTRKLRRALADLVNPKAVRSEPSEPIASRPPRVLCVDDNPANLLLVQTLLEDMGAKVLAVDSGYAAVKAVQNESFDLVMMDVQMPGMDGRQSTEAIRQWESERNCTPLPVIALTGHAMANEKRALLQSGMDDYLTKPISERQLAQVVLKWTGLALRNQGPERTGEPSGNGHELQVLDHDEGLRLAAGKADLAADMLAMLLASLEADREAIRAARAANDHNALIERVHRLHGATRYCGVPQLRAACQRSETLLKQEDIKAFAALDELERAINRLATEARINA

SEQ ID NO: 2311 - protein, 452 aa, Zea mays
  misc_feature (136)..(136): Xaa can be any naturally occurring amino acid
  misc_feature (155)..(155): Xaa can be any naturally occurring amino acid
  misc_feature (167)..(167): Xaa can be any naturally occurring amino acid
MGEGEAEVKGGVLQGRYELGRVLGHGNFGRVHAARDLRTGRAVAVKVLDKDKMLRTGMMEQIKREIAVMKRVSHPNIVELHEVMATRSKIYLALELVRGGELFARIVRAGRVKEDVARRYFRQLIHAVDFCHARGXVYHRDLKLENLLLDDAGNXLKVVDFGLSALXADHARSDGLLHTLCGTPGYVAPEVFRNKGYDGAKADIWSCGVILYVLLAGSLPFPDDNVAAMFRKMSRGDYRCPPWLSTEARRLIPKLLDPDPDTRITIAQLVETPWFNKPSVSRSVRAAAGGATEPPAEPASSAKDGGDKDEPPETMNAFHLISLSAGFDLSPLFDVEGGPARGPREGGMRFATREPASGVVSRLEEVAARGGGRMRVTKSGARGVRLEGAERGGRKGRLAVAADIFCVAPSVLVVDVKKDGGDSLEYRSFCSEELRPALKDIVWAADPQPAVV

SEQ ID NO: 2312 - protein, 110 aa, Quercus suber
SLDIWDPFEGFSAVASVPPSARETTAFATARIDWKETPEAHIFKADLPGLKKEEVKVEVEDVNVLQISGERSKEHEEKNDKWHRVERSCGKFMRRFRLPENAKVDQVKAN

SEQ ID NO: 2313 - protein, 145 aa, Bacillus subtilis
MSLVPYDPFRQLSNMRREFDRFFSELPISFDNEHGIGGIRVDVHETENEVVATCDLPGLEKKEDVDIDIQNNRLSISGSIKRTNEIKEENMLKKERYTGRFQRMITLPSPVSHDGVKATYKNGILEITMPKVAKDVKKKIDVSFQ

SEQ ID NO: 2314 - protein, 469 aa, Bacillus cereus
MKFSHDFLFGAASASYQVEGAWNEDGKGVTNWDEFSKIPGKTYNGTNGDVAVDHYHRYKEDVRLMAEMGLESYRFSISWARILPTGDGEVNEKGIEFYNNLIDECLKYGIVPFVTLYHWDLPLALEKDGGWTNKRTAEAFVKYAEICFKAFGDRVKHWITFNETVMFCGLGYLKGAHPPGIQNDVPKYFQATHYVFYAHAKTVAVYKQLKQYGEIGITHVFLPAYSVDGQKENILAAKHANEYETYWYYDPVLKGEYPSYVVQQLKKKGWTPNWTVEELEIIKQNAEKNDFIGLNYYQPIRVERYDMDINGGEHSRENSTLAPGNPSFDGFYRTVKMDDKTYTKWGWEISPEGFLDGLHMLKERYGDIKMYVTENGLGDEDPIIDGEIVDVPRIKFIEEHLKVIKRAIEEGINLKGYYAWSVIDLLSWLNGYKKQYGFIFVDHNDNLKRKKKLSFHWYKHVIETRGEEL

SEQ ID NO: 2315 - protein, 80 aa, Glycine max
  misc_feature (73)..(73): Xaa can be any naturally occurring amino acid
MLEFNFMQHILYRQKEQFSDGVGYGWIDGLKAHAEKHVTDRMMLNAANIFPFNTPTTKEAYYYRMIFERFFPXVNLINHA

SEQ ID NO: 2316 - protein, 607 aa, Bacillus anthracis
MCGITGWVDWKEDLSNQHVILKKMANRIQHRGPDAEGFWFSPRAAFAHRRLIVIDPEGGAQPKTFRAGDYTYALTYNGEIYNFRELREQLQKCGHTFETHSDTEVLLHAYLEWKEDCVQHLNGIFAFALWDDQKQRLFLARDHLGVKPLFYTERNDSIIFGSEIKALLAHPSVPAEIDADGINEIFGLGLFRTPGCGVFKHIEEVRAGHSITFTRDKKVVTKYWNLESKVHTDSIEDTSSHILSILQDTVKRQLIADVPLVCMLSGGLDSSGITALAGKEFAAENKTLHTYSVDFVNSAKDFELTFARTGLDAPWVKRVSEHVGTSHHDIIVNAEELANHLFVPLRAKDLPSAGEMETSLYLLFCEMKKDATVALSGESADEVFGGYPWFHQEELLYVDKFPWLTNWKNTSPLLLHEISNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALKPALPDDVRNRRKSAYPTSQDPQYLQTIRHLSLDMCSNKNNPIFSLINHSTLLAIADGSNKEINNFEARSAMEYMLQVNEWLKTYHIHIA

SEQ ID NO: 2317 - protein, 251 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGGGWEGGEQNVTYAHHQAQSQGLYQPLECNPTLQMGYDNPVCSEQITATTQAQAQQGNGYIPGWML

SEQ ID NO: 2318 - protein, 503 aa, Ajellomyces capsulatus
MGADDTFNSYRYKDTPTYTDSNGCPVMDPESSQRVGENGPLLLQDFHLIDLLAHFDRERIPERVVHAKGAGAYGEFEVLDDISDITTINMLKGVGKKTKLVTRFSTVGGEKGSADSARDPRGFSTKFYTEEGNWDWVFNNTPVFFLRDPSKFPLFIHTQKRNPQTNLKDATMFWDYLSTHQEAIHQVMHLFSDRGTPYSYRHMNGYSGHTFKWLTPDGGFNYVQIHLKTDQGSKTLTNEEATKLAAENPDWHTEDLFRAIERGEYPSWTCYVQVLSPQQAEKFRWNIFDLTKVWPHSEVPLRRFGRLVLNKNPQNYFAEMEQAAFSPSHLVPGVEPSADPVLQSRLFSYPDTHRHRLGVNYQQIPVNCPLRAFNPYQRDGAMAVNGNYGANPNYPSTFRRMNYMPVKASQEHEKWTGAVLAKQLPVTDEDFVQANGLWQVLGRQPGQQANFVKNVAGHLCNAEQKVRKAAYGMFIRVNKDLGSSIESSTEALVASQAQSQPRL

SEQ ID NO: 2319 - protein, 388 aa, Xanthomonas axonopodis
MAGLGVWGMLAVLLVFTQLTIFAVTLYLHRSQAHRGVDFHPVIAHFFRFWTWLTTSMITREWVAIHRKHHAKVETEEDPHSPQTKGIAQVFWRGVELYREARTQRADIEQYGKGAPSDWIERHLYTPHANAGPIALLVINAVLFGLPGIALWAIQMAWIPFWAAGVVNGLGHWWGYRNFESADTSTNLTPWALWIGGEELHNNHHAFPSSARFSMRRWELDIGWVAIRGLQALGLAKVLRVAPSLDIRPNIAVPDADTLKALLSHRFQAMTDYQRNVFKPALREEAAATGAKLRELLPRRLRKGLVDDGRWLKPDARAQLQAWVAQRPRMRTLVEYRARLTALLEARSHDASERLRQLQQWCHEAEASGNAALQAYAARLKGYALSGA

SEQ ID NO: 2320 - protein, 167 aa, Glycine max
  misc_feature (151)..(151): Xaa can be any naturally occurring amino acid
  misc_feature (155)..(155): Xaa can be any naturally occurring amino acid
MSGGGCSIVWFRRDLRVEDNPALAAGVRAGAVVCVFIWAPEEEGQYYPGRVSRWWLKQSLAHLDSYLRNLGSPLITKRSTNSISSLLEVVKSTGATQLFFNHLYDPLSLVRDHKAKEVLTAQGITVRSFNSDLLYEPWDVNDAHGQPFTTXSAFXERCLSMPYDPQA

SEQ ID NO: 2321 - protein, 129 aa, Gluconobacter oxydans
MSTFLHTMVRIRDIDRSLAFYKLLGMKELRRKEVREGRYTLVFIGFDDNEHGQAEIELTYNWDQETDYEVGTGFGHFAIGVPDVAALVETVRSGGGKVTREAGPLKFGTIIIAFVEDPDGYKIELIEKK

SEQ ID NO: 2322 - protein, 292 aa, Zea mays
MRNSAAAQPSSPAATYVSGAAYVAPASSAAMYGSGASYVAPAASAPGGGGYIYPAPASSGGSAGYSKIPTYPAVPSAYPNPSRLPPRVSTHAPVEDPTALPSPLAKAGELVTRLREQGQVLIAARRPWGEVFRAPAFSKPPSLGEAIARMRRNTAYFRANYALAVLAVVAASLLWHPGTLFVLLFLCAAWFFLYFARPAQGGQPLRVLGMEFDDGSVLAALCGVTVIAMLFTSVGWNVVGSVMIGGALVSAHAALRTTDDLFLTEQEAAGDGLLAAGMSAAGPMLPTYVRIG

SEQ ID NO: 2323 - protein, 277 aa, Lotus corniculatus
MCEALKSQYQLCEEIGRGRFGTIFRCFHPISTDTFAVKLIDKSLLADSTDRHCLENEPKYMSLLSPHPNILQIFDVFEDDDVLSMVIELCQPLTLLDRIVAANGTSIPEVEAAGLMKQLLEAVAHCHRLGVAHRDVKPDNVLFGGGGDLKLADFGSAEWFGDGRRMSGVVGTPYYVAPEVLMGREYGEKVDVWSCGVILYIMLSGTPPFYGDSAAEIFEAVIRGNLRFPSRIFRNVSPAAKDLLRKMICRDPSNRISAEQALRHPWFLSAGDTVNVT

SEQ ID NO: 2324 - protein, 480 aa, Listeria innocua
MKELLTFPKDFWWGSAWSAEQAEGRGDTGKAKTVWEHWFETEPNRFYEGVGSEITTDHFNRYKEDVQWMKKTGHNSFRISISWARMFPNDGVGEVNQKAIAFYRDLLTEMNENGIKPFANLYHFDMPVALQDAWGWESREVVDAYVHFADTCFKEFGDLVYHWFTFNEPLGPILGGYLEDFHYPNQIDFKRGAQAGFNTILAHALAIKAFKKLNLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYETSKLVGTKREETTNG

SEQ ID NO: 2325 - protein, 542 aa, Sinorhizobium meliloti
MAAKEVKFTSDARDRMLRGVDIMANAVRVTLGPKGRNVVIDKSFGAPRITKDGVSVAKEIELEDKFENMGAQMLREVASRTSDIAGDGTTTATVLAQAIVREGAKAVASGMNPMDLKRGIDLAVEAIVKELRNNARKVSKNAEIAQVATISANGDAEIGRYLAEAMEKVGNEGVITVEEAKTAEIELEVVEGMEFDRGYLSPYFITNQEKMRVELEDAYILLHEKKLSNLQAMIPILESVIQSGKPLLIIAEDVEGEALATLVVNKLRGGLKIAAVKAPGFGDRRKSMLEDIAILTGGTVISEELGIKLENTTMDTLGRAKRIMVDKETTTIVDGAGSKEDIGGRVAQIKAQIEDTTSDYDREKLQERLAKLAGGVAVIRVGGSTEVEVKEKKDRVDDALHATRAAVEEGILPGGGVALLRVVSALNGLATANDDQRVGIEIVRRAIEAPVRQIAENAGAEGSIIVGKLREKQDFAFGWNAQTGEFGDLFQMGVIDPAKVVRAALQDAASIAGLLVTTEAMIAEKPKKDGQPQMPPGGGMDF

SEQ ID NO: 2326 - protein, 551 aa, Hordeum vulgare
MATVRQSDGVAANGLAVAAAANGKSNGHGVAAAVNGKSNGHGVDADANGKSNGHGVAADANGKSNGHAEATANGHGEATANGKTNGHRESNGHAEAADANGESNEHAEDSAANGESNGHAAAAAEEEEAVEWNFAGAKDGVLAATGANMSIRAIRYKISASVQEKGPRPVLPLAHGDPSVFPAFRTAVEAEDAVAAAVRTGQFNCYPAGVGLPAARSAVAEHLSQGVPYMLSADDVFLTAGGTQAIEVIIPVLAQTAGANILLPRPGYPNYEARAAFNRLEVRHFDLIPDKGWEIDIDSLESIADKNTTAMVIINPNNPCGSVYSYDHLSKVAEVAKRLGILVIADEVYGKLVLGSAPFIPMGVFGHITPVLSIGSLSKSWIVPGWRLGWVAVYDPRKILQETKISTSITNYLNVSTDPATFIQAALPQILENTKEDFFKAIIGLLKESSEICYKQIKENKYITCPHKPEGSMFVMVKLNLHLLEEIDDDIDFCCKLAKEESVILCPGSVLGMANWVRITFACVPSSLQDGLGRIKSFCQRNKKRNSSDDC

SEQ ID NO: 2327 - protein, 551 aa, Hordeum vulgare
MATVRQSDGVAANGLAVAAAANGKSNGHGVAAAVNGKSNGHGVDADANGKSNGHGVAADANGKSNGHAEATANGHGEATANGKTNGHRESNGHAEAADANGESNEHAEDSAANGESNGHAAAAAEEEEAVEWNFAGAKDGVLAATGANMSIRAIRYKISASVQEKGPRPVLPLAHGDPSVFPAFRTAVEAEDAVAAALRTGQFNCYPAGVGLPAARSAVAEHLSQGVPYMLSADDVFLTAGGTQAIEVIIPVLAQTAGANILLPRPGYPNYEARAAFNRLEVRHFDLIPDKGWEIDIDSLESIADKNTTAMVIINPNNPCGSVYSYDHLSKVAEVAKRLGILVIADEVYGKLVLGSAPFIPMGVFGHITPVLSIGSLSKSWIVPGWRLGWVAVYDPRKILQETKISTSITNYLNVSTDPATFIQAALPQILENTKEDFFKAIIGLLKESSEICYKQIKENKYITCPHKPEGSMFVMVKLNLHLLEEIDDDIDFCCKLAKEESVILCPGSVLGMANWVRITFACVPSSLQDGLGRIKSFCQRNKKRNSSDDC

SEQ ID NO: 2328 - protein, 115 aa, Zea mays
  misc_feature (45)..(45): Xaa can be any naturally occurring amino acid
  misc_feature (83)..(83): Xaa can be any naturally occurring amino acid
HASSNTLDGLNGFDGTDTHYFHSGPRGHHWMWDSRLFNYGNWEVXRFLLSNARWWLEEYKFDGFRFDGVTSMMYTHHGLQVTXTGNFNEYFGFATDVDAVVYLMLVNDLIHGLYP

SEQ ID NO: 2329 - protein, 115 aa, Zea mays
  misc_feature (55)..(55): Xaa can be any naturally occurring amino acid
  misc_feature (76)..(76): Xaa can be any naturally occurring amino acid
  misc_feature (100)..(100): Xaa can be any naturally occurring amino acid
HASSNTLDGLNGFDGTDTHYFHSGPRGHHWMWDSRLFNYGNWEVLRFLLSNARWXLEEYKFDGFRFDGVTSMMYTXHGLQVTFTGNFNEYFGFATDVDAXVYLMLVNDLIHGLYP

SEQ ID NO: 2330 - protein, 80 aa, Zea mays
  misc_feature (32)..(32): Xaa can be any naturally occurring amino acid
  misc_feature (45)..(45): Xaa can be any naturally occurring amino acid
  misc_feature (55)..(55): Xaa can be any naturally occurring amino acid
  misc_feature (64)..(64): Xaa can be any naturally occurring amino acid
  misc_feature (76)..(76): Xaa can be any naturally occurring amino acid
HASSNTLDGLNGFDGTDTHYFHSGPRGHHWMXDSRLFNYGNWEVXRFLLSNARWXLEEYKFDGXRFDGVTSMMYTXHGLQ

SEQ ID NO: 2331 - protein, 129 aa, Brassica napus
KKACSDAVNPPTGTEANTQYYQQEASKLRRQIRDIQNSNRHIVGESLGSLNFKELKNLEGRLEKGINRVRSKKNELLVAELEYMQKREIELQHDNMYNQYYHLECERNKIDITTYNSFPTLSNFHTNYF

SEQ ID NO: 2332 - protein, 590 aa, Pseudomonas syringae
MCGLAGELRFDHQPADLAAVERITHQLAPRGPDAWGFHSQGPVALGHRRLKIMDLSDGSAQPMIDSHLGLSMAFNGAIYNFPELRAELESLGYQFHSGGDTEVLLKGYHAWGADMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHEDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQESEIIEQLPAAFRAMSEPMVSHDCIAFYLLSREVSKHCKVVQSGQGADELFAGYHWYPQVDGASDPVAAYRDAFVDRSYAEYAETVQPKWRTANDAAGDFVRDHFAQPGASAAVDKALRLDSTVMLVDDPVKRVDNMTMAWGLEARTPFLDYRLVELSARIPGKFKLPDDGKQVLKEAARLVIPSEVIDRKKGYFPVPGLKHLQGDTLNWVRELLTDSSQDRGLFNPAMVDKLLTNPEGQLTPLRGSKLWQLAALNLWLSEQGL

SEQ ID NO: 2333 - protein, 274 aa, Candida glabrata
MHVKPIKMRWHTGGVNYSYLVSNQDQTTSWLIDPAEPHEVWPELSESERESVVALVNTHHHYDHAGGNTSLLKQFKETVGKPLQVIGGSEECDNVTLIPTHSQKLKIGNLDVTCIRTPCHTQDSVCYYIRDPETDERCIFTGDTLFTAGCGRFFEGTGEEMDAALNKYILEGVGKNNWSSTLVYPGHEYTKSNVKFVRSKIYPTTNVNSRFDELERFCNEHEVTTGKFTLADELLFNPFMKLDDPIVRAAVGDSENQWTSAAVMDKLRKMKNAM

SEQ ID NO: 2334 - protein, 105 aa, Quercus suber
SLDIWDPFEGFSAVASVPPSARETTAFATARIDWKETPEAHIFKADLPGLKKEEVKVEVEDGNVLQISGERSKEHEEKNDKWHRVERSCGKFMRRFRLPENAKVD

SEQ ID NO: 2335 - protein, 491 aa, Neisseria gonorrhoeae
MSKPVFKKIALYTLGAISGVAVSLAVQGFAAEKDGRDNEVLPVQSIRTMAEVYGQIKANYYHDKPDADLFEGAMKGMVAGLDPHSEYMDKKGYAEIKESTSGEFGGLGMEIGQEDGFVKVVSPIEDTPAERAEVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDGMVLKAVPEDYVYGMGGDPLAGIPAELKTIPMTVLVNSGSASASEIVAGALQDHKRAVIVGTQSFGKGSVQTLIPLSNGSAVKLTTALYYTPNDRSIQAQGIVPDVEVKDKERTFESREADLVGHIGNPLGGEDVNSETLAVPLEKDADKPAAKEKGKKKKDEDLSSRRIPNPAKDDQLRKALDLVKSPEQWQKSLGLAAKKPVSNKDKKDKK

SEQ ID NO: 2336 - protein, 110 aa, Quercus suber
SLDIWDPFEGFSAVASVPPSARETTAFATARIDWKETPEAHIFKADLPGLKKEEVKVEVEDGNVSQISGERSKEHEEKNDKWHRVERSCGKFMRRFRLPENAKVDQVKAN

SEQ ID NO: 2337 - protein, 244 aa, Crocus sativus
MGRGRVELKRIENTINRQVTFSKRRGGLLKKANEISVLCDADVAIIIFSTKGKLSEYSTDARMESILERYDRYSCAERDIVAPDPDSQESWRDEYGRLKAKLEALQTSQRHLMGAQLDMLSAKELQQLEQQLENALKNIRSRKNQLLFDSISELLKKEKTLTTQNKDMEMKLIEKKKVKSMARQGQQYTESSSPPSLLIQDPFPSLTIGINPASGSSEEDNEARLLPPVNRNRLPPWMVRSANE

SEQ ID NO: 2338 - protein, 88 aa, Quercus suber
SLDIWDPFEGFSAVASVPPSARETTAFATARIDWKETPEAHIFKADLPGLKKEEVKVEVEDGNVLQISGERSKEHEEKNDKWHRVERS

SEQ ID NO: 2339 - protein, 222 aa, Triticum aestivum
  misc_feature (186)..(186): Xaa can be any naturally occurring amino acid
MGQQSLIYAFVARGTVVLAEYTEFTGNFTTIASQCLVKLPASNNKFTYNCDGHTFNYLVEDGFTYCVVAVESVGQQMPIAFLVRVKDDFSKRYAGGKAATAAPSSLNREFGSKLKEHMQYCVDHPEEINKLAKVQAQVSEVKNVMMENIEKVLDRGEKIELLVDKTENLRSQAQDFRQQGTQVRRXMWLQNMKIKLIVLGIIVALILIIILSVCHGFNCGKK

SEQ ID NO: 2340 - protein, 88 aa, Vigna radiata
MSQELESVEIDSLARFAVEEHNKKQNALLEFGRVVSAQQQVVSGTLYTITLEAKDGGQKKVYEAKVWEKPWLNFKELQEFKLVGEAPA

SEQ ID NO: 2341 - protein, 110 aa, Quercus suber
SLDIWDPFEGFSAVASVPPSARETTAFATARIDWKETPEAHIFKADLPGLKKEEVKVEVEDGNVLQISGERSKEHEEKNDKWHRVERSCGKFMRRFRLPESAKVDQVKAN

SEQ ID NO: 2342 - protein, 461 aa, Hordeum vulgare
MVHQSNGHGEAAAAAANGKSNGHAAAANGKSNGHAAAAAVEWNFARGKDGILATTGAKNSIRAIRYKISASVEESGPRPVLPLAHGDPSVFPAFRTAVEAEDAVAAALRTGQFNCYAAGVGLPAARSAVAEHLSQGVPYKLSADDVFLTAGGTQAIEVIIPVLAQTAGANILLPRPGYPNYEARAAFNKLEVRHFDLIPDKGWEIDIDSLESIADKNTTAMVIINPNNPCGSVYSYDHLAKVAEVARKLGILVIADEVYGKLVLGSAPFIPMGVFGHIAPVLSIGSLSKSWIVPGWRLGWVAVYDPTKILEKTKISTSITNYLNVSTDPATFVQEALPKILENTKADFFKRIIGLLKESSEICYREIKENKYITCPHKPEGSMFVMVKLNLHLLEEIHDDINFCCKLAKEESVILCPGSVLGMENWVRITFACVPSSLQDGLERVKSFCQRNKKKNSINGC

SEQ ID NO: 2343 - protein, 354 aa, Gloeobacter violaceus
MHLFAPLTLRDITLRNRIAVSPMCQYSSIDGLANDWHFVHLGSRAVGGAGLVIFEAAAVEARGRISPQDLGIWSDAHIEPLRRINDFIHRQESVAGIQIAHAGRKASTARPWEGGGPLTEGEGGWADSVAPSALPFDAGYPVPEALDEAGIAATVQAFAAAARRSLAAGFRVLEIHAAHGYLLHSFLSPLSNRRTDRWGGLFENRIRLLLAVVEAVRGVWPERLPLFVRISATDWTEGGWDLEQSVLLAQVLARSGVDLIDCSSGGVIPGVRIPAGPGYQTRFAERIRAEADMLTGAVGQITSAEQADHIVRTGQADLVLIGRQLLRDPYWPLKAAVELRAPGPWPEQYQRAKP

SEQ ID NO: 2344 - protein, 158 aa, Zea mays
MSLIRRSNVFDPFSLDLWDPFEGFPFGSGSSSSLFPSFPRTSSETAAFAGARIDWKETPEAHVFKADVPGLKKEEVKVEVEDGNVLQISGERNKEQEEKTDTWHRVERSSGRFLRRFRLPENAKTEQITAAMENGVLTVTVPKEDAKKPEVKSIQISG

SEQ ID NO: 2345 - protein, 445 aa, Oryza sativa
MYKAKRTAAQKVRRCLGKYELGRAIGQGTFAKVRFAKNMETGDHVAIKILDKAKVQKHRLVEQIRREICTMKLIQHPNVVHLHEVMGSKTRIFIVLEYVMGGELHDIIATSGRLKEDEARKYFQQLINAVDYCHSRGVYHRDLKLENLLLDTAGNIKVSDFGLSAISEQVKADGLLHTTCGTPNYVAPEVIEDKGYDGALADLWSCGVILFVLLAGYLPFEDENIVSLYNKISGAQFTCPSWFSAEAKRLIARILDPNPATRITTSQVLQDQWFKKGYESPVFDDKYYPYFHDVYDAFGDSEEKHVKEAMEEQPTLMNAFELISLNKGLNLDNFFESDKKYKRETRFTSQCPPKEIINRIEEAANLLGFNIQKRNYRMRMENIKEGRKGHLNIATEVFQVAPSLHVVELKKAKGDTLEFQKFYQTLSTQLKDVVWELEDAAEDMS

SEQ ID NO: 2346 - protein, 559 aa, Bacteroides thetaiotaomicron
MCGIAGILNIKTQTKELRDKALKMAQKIRHRGPDWSGIYVGGSAILAHERLSIVDPQSGGQPLYSPDRKQALAVNGEIYNHRDIRARYAGQYDFQTGSDCEVILALYKDKGIHFLEEISGIFAFVLYDEEKDEFLIARDPIGVIPLYIGKDKDGKIYFGSELKALEGFCNEYEPFLPGHYFYSKEGKMKRWYTREWTDYESVKDNDAKVSDVKEALEDAVHRQLMSDVPYGVLLSGGLDSSVISAIAKKYAAKRIETDGASDAWWPQLHSFAIGLKGAPDLIKAREVAEYIGTVHHEINYTVQEGLDAIRDVIYFIETYDVTTVRASTPMYLLARVIKSMGIKMVLSGEGADEVFGGYLYFHKAPTPKDFHEETVRKLSKLHMYDCLRANKSLSAWGVEGRVPFLDKEFLDVAMALNPKAKMCPGKEIEKRIVREAFADMLPESVAWRQKEQFSDGVGYSWIDTLREITAAAVSDEQMEHAAERFPINTPLNKEEYYYRSIFEEHFPSESAARSVPSVPSVACSTAEALAWDVAFRNLNEPSGRAVRGVHEEAYAEEVK

SEQ ID NO: 2347 - protein, 426 aa, Rickettsia typhi
MATKLIKHGSKAREQMLEGIDILADAVKVTLGPKGRNVLIEQSFGSPKITKDGVTVAKSIELKDKIRNAGAQLLKSAATKAAEVAGDGTTTATVLARALAREGNKLVAAGYNPMDLKRGMDLAVNAVVEEIKKSSKKINSQEEIAQVGTISSNGDKEIGEKIAKAMEEVGKEGVITVEEAKNFSFDVEVVKGMMFDRGYLSPYFVTNSEKMVAELENPFILLFEKKLSNLQPMLPILEAVVQSQRPLLIIAEDVEGEALATLVVNRLLGGLKVAAVKAPGFGDRRKAMMEDIAILTKGELITEDLGMKLENVNIKNLGTAKRVTISKENTVIVDGNGDKKNIEDRVLQIKSQIAETTSDYDKEKLQERLAKLSGGVAVLKVGGATEVEVKERKDRVEDALAATKPNSSTLAAVHLVDPSSVPSLAY

SEQ ID NO: 2348 - protein, 394 aa, Burkholderia vietnamiensis
MRAATPKANGADVTAPNMKRKESTMSSLLSAYDLRGLALPNRVVMGPMTRSRAPSRGLPTELMAEYYAQRASAGLIVTEATNVSTASAAFESTPGLIDDAQVAGWKKITDAVHANGGRIFAQLWHGGRVGSLALLDGAAPLSPSGVNDDLEQLQVWAQLHNGYYTKIHATPSRAMTTDEVVAAVAEFRHAAMQAMAAGFDGVEIHAANGYLPHQFLSSTLNRRDDRYGGSVANRARFLEEIVDAVGGVMPLSRVGVRVSPYAKYNNVRDADPDATYAYVGRMLDDAGVAYLHAADTNGWSGEPDLPRIVAQARRSFGGTLIVNGGIAPDAANALLDAGDADLVAFARAYIANPDLVERLATRAPLAQPKSSGWYGGDRAGYVDYARHDAAEAGV

SEQ ID NO: 2349 - protein, 471 aa, Legionella pneumophila
MTIALVWFRQDLRLTDNPAFIEACSHHEIVIPLYIYDDKCSVLGQAQAWWLHYSLIALGKSLNQQGLSLVLRKGSPQEIILELVAQYGVESVYWNRCYEPQVIARDKKIKLALVEREIKVQSFNGNLLHEPWTIKNKNGDFFKVFTPYWKQCRQILNIPSPFILTKRPRGIEIASDDIGKWKLLPAINWAARFSEYWIPGEEGAQKKLDEFIVHHLSGYKRDRDFPAKNATSRLSPHLHFGEISPWVILRALELAKLEHTCDLASVEHFLSELGWREFSVYLLYHFPKLDCENFRKEFDAFPWQNDEQLLTCWQKGMTGYPIIDAGMRELWATGYMHNRVRMIVASFLTKDLLIDWRSGAQWFLDTLVDADLANNSASWQWVAGCGADAAPYFRIFNPILQSQKFDPDGVYIRQWIPELAQLNSQSIHQPWTDADASSIFLGKKYPKPIIDHQEARTKALSYYQQIKKGMD

SEQ ID NO: 2350 - protein, 72 aa, Zea mays
  misc_feature (45)..(46): Xaa can be any naturally occurring amino acid
  misc_feature (55)..(55): Xaa can be any naturally occurring amino acid
  misc_feature (60)..(60): Xaa can be any naturally occurring amino acid
  misc_feature (64)..(64): Xaa can be any naturally occurring amino acid
HASSNTLDGLNGFDGTDTHYFHSGPRGHHWMWDSRLFNYGNWEVXXFLLSNARWXLEEYXFDGXRFDGVTSM

SEQ ID NO: 2351 - protein, 235 aa, Chloranthus spicatus
  misc_feature (108)..(108): Xaa can be any naturally occurring amino acid
MGRGRVQLKRIENKINRQVTFSKRRSGLLKKAHEISVLCDAEVALIVFSAKGKLSEYSTDSRMDRILERYERISYAERELRSTDHRPDGNWNLEYSKLKAKLEGLQRXQRHYMGEDLEKLSLKELQPLENQLDNALKHIRTRKTQVMMDSIAELQAREKLLQEQNSMLEKKIQEKNALAHQAHWEQQNQTQSPPPFLLTHQHPTINNSTYQARGEEDRVRTNSLMPPWMLRHVNG

SEQ ID NO: 2352 - protein, 80 aa, Zea mays
  misc_feature (55)..(55): Xaa can be any naturally occurring amino acid
HASSNTLDGLNGFDGTDTHYFHSGPRGHHWMWDSRLFNYGNWEVLRFLLSNARWXLEEYKFDGFRFDGVTSMMYTHHGLQ

SEQ ID NO: 2353 - protein, 613 aa, Thermoanaerobacter tengcongensis
MCGIAGWVNFNMDLSLQNEVIEKMTDTLKKRGPDGSGVWLSKHCVLGHRRLIVIDPQGGIQPMIKKYGEKNFVIIHNGELYNMDELKNELISLGYTFNTRSDTEIILTSYIEWGPLCVKKFNGIFAFAIWDEVQNRLFIARDHLGIKPLFYTIKNGSLIFGSEIKAILAHPHVKPEIDSQGLAEIFVMGPSRTPGCGVFKDIKELKAGHYLIFTKNGVNISKYWSLQSLPHEDSLEKTAEKIRYLLKDSSVRQLVSDVPLCSLLSGGLDSTAVSFFANEELKQKGHKLITYSVDYVGNDKYFTPNEFQPNSDADWVKFVANKLDTDHNYVFIDNEELAHALKPALYARDLPGMADIDSSLYLFLKEVKKGATVALSGEGADEVFGGYPWFRNKESIRSHTFPWTRMVNERMKLLLPEVVNYIRPLEYLNDRYNEALNEVPKLNGEDPYNARMREMFYLNITRFMPMLLDRMDRMSMAVGLEARVPFLDYRLVEYVWNIPWEMKNLNNREKGILRYALKGYIPDEVIERKKSPYPKTHNPVFKNIVKKWLKQIINDSTSPLLQLVDKKAIAELIETDAKAYDPAWFSQLMGSPQLFAYLVQINMWLKDYKISIV

SEQ ID NO: 2354 - protein, 275 aa, Escherichia coli
MANPTVIKLQDGNVMPQLGLGVWQASNEEVITAIQKALEVGYRSIDTAAAYKNEEGVGKALKNASVNREELFITTKLWNDDHKHPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIVENFDVWDFRLDKDELGEIAKLDQGKRLGPDPDQFGG

SEQ ID NO: 2355 - protein, 110 aa, Quercus suber
SLDIWVPFEGFSAVASVPPSARETTAFATARIDWKETPEAHIFKADLPGLKKEEVKVEVEDGNVLQISGERSKEHEEKNDKWHRVERSCGKFMRRFRLPENAKVDQVKAN

SEQ ID NO: 2356 - protein, 504 aa, Lycopersicon esculentum
MSSRGGGIAESPYLRNYRVGKTLGHGSFGKVKIAEHLLTGHKVAIKILNRRKMKTPDMEEKLRREIKICRLFVHPHVIRLYEVIETPTDIYVVMEYVKSGELFDYIVEKGRLQEDEARKFFQQIIAGVEYCHRNMVVHRDLKPENLLLDARRNVKIADFGLGNIMRDGHFLKTSCGSPNYAAPEVVSGKLYAGPEVDVWSCGVILYALLCGTLPFDDENIPNLFKKIKSGVYTLPSHLSPLARDLIPRMLIVDPMKRISVADIRQHQWFKIHLPRYLAVPPPDARQHLKKLDEEILQQVTRMGLDRDQLLDSLQKRIQDDATVAYYLLYDNRSMASSGYLGAEFQESVDGYSSGLFPNLDLQLSSGNGVSEESLRRPFRKEKTWLVGLQSPANPKEIMNQVLGTLLELNVRWKKIGHYNMKCLWCHDLHLHSMASNHMNDDDHFISNATAISTHLQPLPTVKFEMQLYKTEDEKYLLDLQRISGPQFLFLDFCAGFIRQLEGPQ

SEQ ID NO: 2357 - protein, 592 aa, Bacillus cereus
MAETLAKRGPDDNKVWIKGNVAFGHKRLIVVDPEGGKQPMTCLKDEANYAICYNGELYNTEDIRKELLRRGYTFKGHSDTEVLLASYMEWKEECVDHLNGIYAFAVWDEQKEQVFIARDRLGVKPLFYKYDSGRLLFGSELKAILAHPDVKVEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSIDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQRRYEESIQEVPILEGESPIEAKRRQLFYLNMVWFMTTLLDRKDRMSMGASLEVRVPFADHRLVEYAWNIPWEMKMYKNREKGLLRKALEGLLPNEILYRKKSPYPKTHNPHYTKAVTVWLQDLLTDKGSILHELFDKEQLSGLIESGGSAFQSPWFGQLMTGPQLLAHLAQIHVWFKEYGVNIKE

SEQ ID NO: 2358 - protein, 327 aa, Unknown
  Synechocystis sp. PCC 6803
MQSFNRINSMKYFPLSNGEQIPALGLGTWKSSPQVVGQAVEQALDLGYRHLDCAAIYGNEAEIGATLANAFTKGVVKREELWITSKLWSNAHHPDAVLPALEKTLQDLGLDYLDLYLIHWPVVIQPDVGFPESGDQLLPFTPASLEGTWQALEKAVDLGLCHHIGVSNFSLKKLEMVLSMARIPPAVNQVELHPYLQQSDLLTFANSQNILLTAYSPLGSGDRPAAFQQAAEPKLLTDPVINGIAAEQGCSAAQVLLAWAIQRGTVTIPKSVNPERLEQNLRAADITLTDSEMAKIALLDRHYRYVSGDFWTMPGSPYTLQNLWDEI

SEQ ID NO: 2359 - protein, 110 aa, Quercus suber
SLDIWDPFEGFSAVASVPPSARETTAFATARIDWKETPEAHIFKADLPGLKKEEVKVEVEDGNVLQISRERSKEHEEKNDKWHRVERSCGKFMRRFRLPENAKVDQVKAN

SEQ ID NO: 2360 - protein, 152 aa, Glycine max
MLENARVLKEGIERTGRFNIISKDIGVPLVAFSLKDSSQHTVFEIADHLRKFGWIVPAYTMPPDAQHIAVLRVVIREDFSRGLAERLAADIEKVVKLLDTLPSPLTTKVAHITAITSETSETSEKVKSAIETQKEIALYWKRLVDGKRLGAC

SEQ ID NO: 2361 - protein, 488 aa, Bacillus cereus
MNPNNRLTTNQGAPVGDNQNSRTAGRRGPVLLEDYHLVEKLAHFDRERIPERVVHARGAGAHGVFVTKNSMKQYTKAAFLQNEGTETPVFVRFSTVIHGQGSPETARDPRGFAVKFYTEEGNYDIVGNHLPVFFIRDAIKFPDMVHSLKPAPDTNIQTPDRYWDFMTLSPESTHMMTWVFSDYGTPASYREMEGFGVHSFKWINAEGKIVYIKYHWKPQQGVRNLSAKEVQEVQGKDFNHATRDLFDAIEKGNYPKWDLHVQVMQLEETDSLDFDPLDPTKVWPEDRFPLMEVGTMTLNRNPKNFFAEVEQVAFSPSATVNGIEPSEDKLLQGRLFSYPDTQRYRLGANYLQIPVNCPYAAVHNQQRDGAMQINQNPSTINYEPSRHAENPVEDPAYRDSTMKVEGYVSREKIDKPNDFKQAGERYRSFSKEEQDNLIANLTNDLKDVSERTKLLAVCNFFRADQEYGMRLAQSLNVDITQYVGNAPK

SEQ ID NO: 2362 - protein, 364 aa, Enterobacter cloacae
SAEKLFTPLKVGAVTAPNRVFMAPLTRLRSIEPGDIPTPLMGEYYRQRASAGLIISEATQISAQAKGYAGAPGLHSPEQIAAWKKITAGVHAEDGRIAVQLWHTGRISHSSIQPGGQAPVSASALNANTRTSLRDENGNAIRVDTTTPRALELDEIPGIVNDFRQAVANAREAGFDLVELHSAHGYLLHQFLSPSSNQRTDQYGGSVENRARLVLEVVDAVCNEWSADRIGIRVSPIGTFQNVDNGPNEEADALYLIEELAKRGIAYLHMSETDLAGGKPYSEAFRQKVRERFHGVIIGAGAYTAEKAEDLIGKGLIDAVAFGRDYIANPDLVARLQKKAELNPQRPESFYGGGAEGYTDYPSL

SEQ ID NO: 2363 - protein, 292 aa, Photorhabdus luminescens
MDNQPIIRLADGNHMPQLGLGSWASDDQQIAETIHAALDIGYRAIDTAAIYNNEKGVGNALQETDIPREDIFVTTKLWNDRHLDARAALTESLEKLQLDYVDLYLIHWPAPPQDQYVGAWQQLIELQKEGLIRSIGVSNFQPEHIQRLINETGVHPVINQIELHPLLQQRQLHAWNATHNIVTESWSPLAQGGENVFDNQLVQHLTQKYGKTPAQVVIRWHIDNGMIVIPKSTTLSRIKENFDVFDFKLEKEDLTAMTTLDIGKRLGPTPEIFVDFSEFIQLLEQNSANNQC

SEQ ID NO: 2364 - protein, 110 aa, Quercus suber
SLDIWDPFEGFSAVASVPPSARETTAFATARIDWRETPEAHIFKADLPGLKKEEVKVEVEDGNVLQISGERSKEHEEKNDKWHRVERSCGKFMRRFRLPENAKVDQVKAN

SEQ ID NO: 2365 - protein, 1142 aa, Ashbya gossypii
MGDKNNNVTSLRGDRIGPWKLGETLGAGSTGKVLLAQNTETGQIAAVKVISKSVFNAQGSTFVGSNDPDVLPYGIEREIIIMKLLNHPNVLRLYDVWETAQDLYMVLEYVEKGELFNLLVQRGPLPENEAVRFFRQIIIGISYCHALGIVHRDLKPENLLLDHKFNIKLADFGMAALESKDKLLETSCGSPHYAAPEIVSGLPYHGFESDVWSCGVILYALLTGRLPFDEEDGNIRNLLLKVQSGKYEIPGEDEISPEARDLIVQILTVEPEQRIKTREILKHPLLQKYPSIKDSKSIRNLPREDTYLNPLDHNDGTIDQAILQNLVVLWHGRDKNEITMKLKEPGANLEKTFYALLHRFKFENEQQQLKQQQIAKRISSTSSSPQQNIVKSSSRRSINNILSTPKKKRSSAINVSSAHKRPVSIQKLNDCGTLNPTSPSKKRSLSNRKLSAVLAGSNSSSPSRKRMSVGQDAPPVPTAVLRDYNKRASRASKRLSFLPSKRGSITTKIIATYAKLSEDNDWEYIDREAKRTSSDFATLIDNIFEHEKYEQIRREKEELERKVREAKEREERERRARAEAERRKREEEERRRRREVEELIRQRELQKSLEEQVARLKAEVAATKQEKRISLAQEQHVRSISEPMERKGTRPSKRDSFLALQNNINSLLKRRTLSLETRPISRLDPGIRLSEENTILEDDLECNEDRLRVEKNILETIRRSKFLGSQYDIDKELQRVRREKLEKVNMRKSQDRKLEPGLHSRQEQRFVSDGTTVTSSHEDSESIILPKNVTAIGVLKDEESEPRKLSEVKIPQFTRRSKHFSASSKRLSVLSMYSTKVSYTNLADYLNNDVQLKSLQPSAPTSIKIPQEPEFMFESAGQENRYQAAAPTDTYLERPKVGVEGDHEPGEPVELIELDDSEDRSKQYSEEDIAKVKLPILPPLDHLNKPNGLGIYQAPAPPKEPLGQPVMKSMIPDDIKIKCVPNQLSPRRRATERAPEKKLTKTVPERVIAAETFPPPNTKKKPSFFKKFSREKMHSDCDVQLDTTVGDSKMFRALNKLLNGWTSYGLKEVRSMPASYTITGKLSSDNILSLRSTAFEIVILSVADTGSSVKFTKKSGSKKTFTRLVNEIEKILEKESVLVLAS

SEQ ID NO: 2366 - protein, 155 aa, Brassica napus
NNKIRLTSPRSHNHKVKDELTQSDFVSLPSSSQVGSTPINCIALFYQIFLQYPRAVRYHCLILSSSSTASSDSFNPMPSAELQESPTSVATASFATGDRIQRLKIVLDLDDTLVCAYETSSLPAALRNQAIEAGLNWFELECLSSDKESDGKSKI

SEQ ID NO: 2367 - protein, 228 aa, Zea mays
MAGASLLSPSCTLLRLIPSASHICCSSHFKRFDRVRRFAPAAMATSSGPKEAPANNPGLQTEVDPATKGYFLQQTMLRVKDPKVSLDFYSRVMGMSLLKRLDFEEMKFSLYFLGYEDVTLAPDDHIKRTEWTFRQKATLELTHNWGTENDPEFKGYHNGNSDPRGFGHIGVTVDDVHKACERFERLGVEFVKKPDDGKIKGIAFIKDPDGYWIEIFDQTIGTVTSSAS

SEQ ID NO: 2368 - protein, 187 aa, Sciadopitys verticillata
DEHGEVVSEIRRSDLEPYLGLHYPATDIPQASRFLFMQNRVRMICDCCATPVKAVQAEELKQPLCLVGSTLRAPHGCHAQYMANMGSIASLVMAVIINGNDEEGASGRSSMKLWGLVVCHHTSPRAVPFPLRYACEFLMQAFGLQLNMELQLAAQLTEKHILRTQTLLCDMLLRDAPIGIVTQSPSI

SEQ ID NO: 2369 - protein, 405 aa, Kineococcus radiotolerans
MKLEQSDKLADVLYDVRGPALRRAQQLEEAGHRILKLNIGNPAPFGFEAPEELLQDMVANLPVAQGYSDSKGVPSARRAVVQSSQLKGVPGVDVNDVYMGNGVSELIVMTMQALLNDGDEVLVPAPDYPLWTAATSLAGGRAVHYLCDESAGWEPDLDHLRAQVTPRTKAMVVINPNNPTGAVYGKAVLEGMLQVAREHGLLVLSDEIYDKILYDDAVHVSTASLAPDLLCITFNGLSKAYRVAGFRSGWMYLSGPKGHAAGFVEGLDLLANMRLCANVPAQHVVQAALSGHQSINDLVLPGGRLAEQSHRTWELLNQIPGVSCVKPRGALYCFPRLDPEVHRVEDDYQLIVDLLESQHVLVVQGTGFNWPKPDHFRIVTLPRVEDLESAVGRIGTFLTGRLAGR

SEQ ID NO: 2370 - protein, 566 aa, Debaryomyces hansenii
MANRRIPKSEDSLSNLPSTASSNQSGSNDFVKKLFQMLQEDTYKDVVKWTSSGDSFVVINTTEFTKEILPRHFKHSNFASFVRQLNKYDFHKVKIPNEEKQSYEYGEDAWEFKHPDFRINDRESLENIKRKSSKKSTQNYNPNVANSGSSVDSFGYQNLKDEMDNLRLENKSLKQDISVLHTKYKTLVENIVSLKSFDEKYYRSMSVLINCLVQAGIKMPPLDFPNPNALYPQKPNVAAHQHSHSHSNSSSLPQLSPPLLSPNGGTGQQGGIGVPLGSGLPAQRFDHNTISQAHTLQHQTPLQTIHSQPNNQQSTKQTPPTNDNLNSKPQSPHLMGESTSGSPLVGNLGLDAASTTAPVNSRTSSISTNRVPQPANGASTDQPQVTTTNLTNPKFHVLLVEDDNVCIQLCRKFLVKYGCQVTIATDGLNAISTVEHTKYDLVLMDIVMPNLDGATATSVIRSFDTKTPIIAMTGNIEDNDLVTYLQNGMSDILAKPFTKDDLYSILSKHLLTSTDSASVTTDEPSETMSSLQGPAQQTLVLPQEVQQQDSNGEPMPEPHSKKPRLI

SEQ ID NO: 2371 - protein, 773 aa, Crocosphaera watsonii
MTTTISADQVNQIVYNLHHDPFEILGCHLLEKGEKTKKWVVRAYLPKAEAAWVIRPTEGKEDPMNSVHHPNFFECIIETPELNNYQLKVKEGEHEKVIYDPYAFSSPFLTDEDIYLFSEGNHHRIYEKLGAHVGKINKVAGVYFAVWAPNARNVSIIGDFNNWDGREHQMRKRNNTIWELFVPEIGAGTVYKYEIKNSEGHIYEKSDPYGFYREVRPDTASIVVDIDNIYQWNDEQWLENRRNSDPLKEPVSVYEVHLGSWLHASSEEKMPLLNGEADPVIVSELNSGSRFLSYYELAEKLIPYVKEMGYTHIEVLPIAEHPFDGSWGYQVTGFYSPTSRFGPPEDFMYFVDQCHENGIGVILDWVPGHFPKDSHGLAYFDGTHLYEHADPRIGEHKEWGTLVFNYGRHEVKNFLVANVLFWFDKYHIDGIRVDAVASMLYRNYLRKDGEWIPNEYGGDEHIEAVNFIKEVNILLFEYFPGILSIAEESTEWEKVSRPIYDGGLGFNLKWDMGWMHDMLDYFSIDPFYRQYHQNNVTFSMLYYYNENFMLALSHDEVVHGKSNMLGKMPGDEWQKYANVRALFTYMYTHPGKKTMFMSMEFGQWSEWNVWGDLEWHLLQYEPHQQLKQFFTDINALYKQEPALYTHDFDYHGFYWIDCNDNPHSVVSFARQSDDPKDTLIVICNFTPQPHSHYRIGVPESGYYLELFNSDAKKYGGSNMGNLGGKWADEWAFHNKPYSVDLCLPPLSVLILKLDPDKVPEGTIVEEVAIDEEE

SEQ ID NO: 2372 - protein, 612 aa, Arabidopsis thaliana
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMEKSRGFDERELFSTAESSSSSSVFFVSQSCSLASEGKNLEGIQDSSDQITTSLGKNGCK

SEQ ID NO: 2373 - protein, 217 aa, Unknown
  Populus tremula x Populus tremuloides
MEEGRFQNGGGLGVKVMTDEQMEMLRKQISVYATICEQLVEMHKAVSAQQDFAGMGLGNPYCDPLLSSAVHKIGSRQRWTPKPAQLQILEQIFEQCNATPGRQKIKDITRELAQHGQISETNVYNWFQNRRARSKRKQSAVVPNNGESEMETDIESLKEKKTRAEDSQPDENTTPMADHMYFNSPDIGFDQLMGKIESPGPGSCIPYWQMEQYDLFG

SEQ ID NO: 2374 - protein, 119 aa, Bacteroides thetaiotaomicron
MVKANATAPAINVFETEKEYKVELAAPGMTKEDFNVRIDEDNNLVISMEKKTENKEEKKEGRYLRREFSYSKFQQTMILPDNVDKEKISAAVENGVLSVQLPKISEEEVKKAEKQIEVK

SEQ ID NO: 2375 - protein, 115 aa, Zea mays
  misc_feature (32)..(32): Xaa can be any naturally occurring amino acid
  misc_feature (55)..(55): Xaa can be any naturally occurring amino acid
  misc_feature (64)..(64): Xaa can be any naturally occurring amino acid
  misc_feature (100)..(100): Xaa can be any naturally occurring amino acid
  misc_feature (106)..(106): Xaa can be any naturally occurring amino acid
HASSNTLDGLNGFDGTDTHYFHSGPRGHHWMXDSRLFNYGNWEVLRFLLSNARWXLEEYKFDGXRFDGVTSMMYTHHGLQVTFTGNFNEYFGFATDVDAXVYLMLXNDLIHGLYP

SEQ ID NO: 2376 - protein, 289 aa, Mycoplasma gallisepticum
MYLTTKKIKVMKYNLLANNYKMPSIGFGTYKLEDGKQTVEAVKTALEVGYRHLDCAEIYENQLSVSQGIKLSGVNRKEIFITSKIWNDDKGYESTKKAFHKILKDLDLEYLDLLLIHWPIGKGFKDNWQEVNAQTWKAMEEFYLEGKIKAIGLSNFLVHHIEALKKSAKILPMVNQLEFHPGYLQPEIVEYCQKNNIVVQAWSPFSQSKVLENKTLVQLAKKYEVTVAQLILNWIIQKDIVPLPKSKTPERIRSNFDVFNFGINQADLKVIDQLNDCGGLGLHPDQVDF

SEQ ID NO: 2377 - protein, 243 aa, Glycine max
MGRGRVELKRIENKINRQVTFAKRRNGLLKKAYELSVLCDAEVALIIFSNRGKQYEFCSGSSMLKTLERYQKCNYGAPEDNVATKEALVLELSSQQEYLRLKARYEALQRSQRNLMGEDLGPLSSKELESLERQLDSSLKQIRSIRTQFMLDQLSDLQRKEHFLGESNRDLRQRLEEFQINPLQLNPSAEDMGYGRHPGQPQGHALFQPLECEPTLQIGYHPDPVSVVTEGPSMNNYMAGWLP

SEQ ID NO: 2378 - protein, 310 aa, Candida glabrata
MAALHKNTSTLKLNTGAHIPVIGLGTWQSSENEGYNATLEALKAGYRHIDTAAIYKNEEEIGRAIRDSNIPRNELFVTTKLWGTQHRNPTEALDQSLKRLGLDYVDLYLMHWPVALKTDLIKDGNLLQIPEREDGSRDVDLEDWNFVKTWELMQELPKEKARAIGVSNFSINNLKELLNSKGNKVVPAANQIEIHPLLPQDELINFCKEKGIVLEAYSPLGSTDAPILKEEEITEIAKKNGVNAGQLVISWHAQRGYVVLPKSVKPERIHGNQETFKLSDEDFATLSNYAKKHGERRVVSPNWGPFKPFV

SEQ ID NO: 2379 - protein, 364 aa, Enterobacter cloacae
SAEKLFTPLKVGAVTAPNRVFMAPLTRLRSIEPGDIPTPLMGEYYRQRASAGLIISEATQISAQAKGYAGAPGLHSPEQIAAWKKITAGVHAEDGRIAVQLWHTGRISHSSIQPGGQAPVSASALNANTRTSLRDENGNAIRVDTTTPRALELDEIPGIVNDFRQAVANAREAGFDLVELHSAHGFLLHQFLSPSSNQRTDQYGGSVENRARLVLEVVDAVCNEWSADRIGIRVSPIGTFQNVDNGPNEEADALYLIEELAKRGIAYLHMSETDLAGGKPYSEAFRQKVRERFHGVIIGAGAYTAEKAEDLIGKGLIDAVAFGRDYIANPDLVARLQKKAELNPQRPESFYGGGAEGYTDYPSL

SEQ ID NO: 2380 - protein, 326 aa, Candida glabrata
MSSVVTLNNGLKMPLVGLGCWKIPNDVCAQQVYDAIKIGYRLFDGAEDYGNEKEVGQGIRKAIDEGVVKREDVFVVSKLWNSFHHPDHVKMALKRTLSDMGLDYLDLFYIHFPIAFKYVPFEEKYPPGFYTGKEDEKNGHITEAHVPIIDTYRALEQCVEEGLIKSIGISNFSGSLVQDLLRQCKIKPVALQVEHHPYLTQEHLVEYCKDNGIQVVAYSSFGPQSYIELNHPLAKNTPNLFHHDTIKQIANNHNVATSQVLLRWATQRGIAIIPKSSKKERLQDNLMIDEKLTLTHKELEAISKLNKNLRLNDPWDWLDGKFPIFA

SEQ ID NO: 2381 - protein, 732 aa, Xanthomonas oryzae
MMSGVMTAVSNRWDPGVIRALAEARHGDAFAVLGAHRTDTGRVLRTYLPGAERVSAVLDDGQTIALEAGPEPGLFAGDLPAQGGYRLRIGWPGGEQDTADPYAFGPQLSDFDLHLISEGHHLQLADALGANVVEVDGVRGTRFAVWAPNASRVAVVGDFNSWDARRHPMRLRHQSGVWELFVPDVGPGAHYKYQLRGPHGHELPAKADPVARRAELAPGTASIVADPTPYQWSDDGWMATRARRQAHDAPMSVYEMHAGSWLREEGVDLDWDGLADHLIPYVADMGFTHVELMPVTEHPFGGSWGYQPLGLFAPTARFGTPDGFARFVDRCHREGIGVIVDWVPAHFPTDAHGLAHFDGTALYEHADPREGFHRDWNTLIYNHGRREVSGFLIASAMEFLQRYHVDGLRVDAVASMLYRDYSRNAGEWVPNIHGGRENYETIAFLRRLNALVREHTPGAVMIAEESTAFPGVTADVAHGGLGFHYKWNMGWMHDTLHYASLDPIYRRYHHGELTFSMVYAYSERFVLPISHDEVVHGKGSLLGRMPGDDWQRFANLRAYLGFMFTHPGRKLLFMGCEFGQPTEWNHDSGLPWHLLDDPRHRGVQTLVRDVNRLYVQYPALHAHDDDPSGFAWVVGDDAGNSVVAFLRKGKRGDAPVLVVINFTPVVQHGYRIGVPQGGQWREVFNSDAGIYGGANLGNGGIVTAEQQSMHGHAHALPLLLPPLGAIVLTPPG

SEQ ID NO: 2382 - protein, 431 aa, Mycobacterium smegmatis
MWLRRDLRLGDLPALQAARGTDDSSVLLCFVVDPRLARSSGERRLAFLFDSLRELDDKLDGRLLVVRGRPDEEIPRLARAVDAEAVHISADFTPFGRRRDEAVAEALGEVPLEATGSPYLVSPGRITKDDGEPYKVFTPFFRRWRDHGWRRPAESSVPSSAVVDPADIANSGRIAVPTAPVKLSFPAGEDAARQRWAEFVDADLADYDEIRDDPAADATSRMSAYLKYGNIHPRTLAVDLGKGKGAQAYLRELAFRDFYADVLWHWPHSLWHNWNRRFDAIELDTDDAAYERFEVWKAGRTGFPLVDAGMRQLNETGWMHNRVRMITASFLVKDLHLPWWWGAEYFLEQLVDGDMASNNHGWQWAAGTGTDAAPYFRVFNPQTQAKKFDPKGEYVRRWVGDVEADDYPGPIVDHSAERAEALRRYGEIGEA

SEQ ID NO: 2383 - protein, 635 aa, Solanum tuberosum
MESCDCIEALLPTGDLLVKYQYLSDFFIAVAYFSIPLELIYFVHKSACFPYRWVLMQFGAFIVLCGATHFISLWTFFMHSKTVAVVMTISKMLTAAVSCITALMLVHIIPDLLSVKTRELFLKTRAEELDKEMGLIIRQEETGRHVRMLTHEIRSTLDRHTILKTTLVELGRTLDLAECALWMPCQGGLTLQLSHNLNNLIPLGSTVPINLPIINEIFSSPEAIQIPHTNPLARMRNTVGRYIPPEVVAVRVPLLHLSSFTNDWAELSTRSYAVMVLVLPMNGLRKWREHELELVQVVADQVAVALSHAAILEDSMRAHDQLMEQNNALDDARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQILLNVAGNAVKFTKEGHISIEASVAKPEYARDCHPPEMFPMPSDGQFYLRVQVRDTGCGISPQDIPLVFTKFAEARPTSNRSTGGEGLGLAICRRFIQLMKGNIWIESEGSGKGTTVTFVVKLGICNHPNALPLLPMPPRGRLNKGSDDLFRYRQFRGDDGGISVNAQRYQRSL

SEQ ID NO: 2384 - protein, 379 aa, Prochlorococcus marinus
MSLLLDAQEKWDDFLENKITNYEKLRSFDYGPTNKSSVSKLSPYISHRVLLEYELLEEVKKKYRSQKINKFVEEIYWRIYWQGWMENRPKVWCNFISENNYEYDIETYEKAINGNSELGFFNSWVNELKTYNYLHNHTRMWFASTWIFNLGLPWQLGASFFFKHLYDGDAASNLLSWRWVAGLQTKGKQYRFSSANLRKFSNNRFNVEKISNRQIFLEEKNQIPLDDEIYKSNMEQKSETLILFENDLHVSTLENTLRNYKSVFIILLSNDQRKIKLSEAVLSFKQQIVLEFIKQFDNVTQIDPLKLKETLVNIDHLDMIYPGVGENNDFMNSFKKLNNKVIFNLVRDQDLFAWKFAKKGFFKFKENIPKINQYVFQNY

SEQ ID NO: 2385 - protein, 513 aa, Cryptococcus neoformans
MPRLSNVYCPKSLLQRQTIQIRSFSQTMSPFKPALTLDTINPAVQAVHYAVRGELAIKADKYVQVLADITHKPLPFEKIVTANIGNPQQQGLDQVPLTYWRQIISLLEYPDLMQKHEQLAKQIYPGDVIERARALHNEIGSTGAYTHSKGVLGIRKRVAKFIEERDGYPADPQNIFLTAGASAGVASILGVALRRGDGCMIPIPQYPLYTATLAYLESEPLPYYLSEADDWSMNHDSLLKSVEEGKKKGIPIKALVIINPGNPTGACLSQEAMEAVVHLCYEEGIVLLADEVYQMNVFDPEQRPFISFKKVLMDMPKEIRESVELVSFHSISKGVSGECGRRGGYFECVNIDKDVMDQVYKMASVTLCPPVSGQIGVDLMVSPPKPGDESYPLWKEETDLIQNNLKSRSYLMAEHFNKMEGVSCNNAEGAMYLFPRINIPPKAVEAAKKLGKEPDVMYALDLLDATGICAVAGSGFGQEPGTFHLRVTALCPDTAEFIGRFQKFNKEFMEKYA

SEQ ID NO: 2386 - protein, 350 aa, Vibrio vulnificus
MVTPWYGIKEGFGFEHLIWLLVTFSFTNLSITAGYHRLWSHKTYEAHPLLRVVFAIGGAFSLQNSALHWSSDHRMHHKFVDHHDKDPYSASRGFWFSHIGWMLRDYNQSTYNDYTNCRDLQKDPVIMWQHKYYVPLAIATNLGIPLLLGWYYQDIIGMLLVVGALRLTLSHHSTFFINSLAHIWGKQTFTDKNSARDNGFLAVLTFGEGYHNFHHIFENDYRNGIYWWQYDPTKWLIKSCSWLGLTRNLRLTPQMKIDKARAATRLKNALHQLAQRGEQESLKQQLQLEFDGLVATMKDYYDAKKQLLECKKQTAFKKYEVALVKIRYQQAKEDLLSRYKRWHALTAHYA

SEQ ID NO: 2387 - protein, 445 aa, Triticum aestivum
  misc_feature (201)..(201): Xaa can be any naturally occurring amino acid
MANRGKILMERYELGRLLGKGTFGKVHYARSLESNRSVAIKMLDKEKVLKVGLSEQIRREVTTMRLVAHKNIVQLHEVMATRNKIYFVMEYVKGGELFDKVAKSGKLTEGAAHKYFQQLISAVDYCHSQGVYHRDLKLENLLLDENENLKVSDFGLSALSESKRQDGLLHTTCGTPAYVAPEVISKTGYDGAKSDIWSCGXVILLGLGGGYLPFHGSNLMDMYRKIEQGDFRCPNWFSHKLQKLLFKILDPNPSTRASIQKIKESTWFRKGPRGTLAVKERTPSENVTTNAPPTAGVRPRKNTHEDVQPLTVTNLNAFEIISFSTGFDLSGLFIQEDCRKETRFTSDKPASAIISKLEYVAKALNLRVRKKDNGVVKMQARKEGRNGAVQLDMEIFEITPSHPLIEMKQTSGDPLEYRELLEDIRPALKDIVWAWHGDDPHQQLE

SEQ ID NO: 2388 - protein, 544 aa, Bacillus thuringiensis
MAKDIKFSEEARRSMLRGVDTLANAVKVTLGPKGRNVVLEKKFGSPLITNDGVTIAKEIELEDAFENMGAKLVAEVASKTNDVAGDGTTTATVLAQAMIREGLKNVTAGANPMGLRKGIEKAVVAAVEELKTISKPIEGKSSIAQVAAISAADEEVGQLIAEAMERVGNDGVITLEESKGFTTELDVVEGMQFDRGYASPYMITDSDKMEAVLDNPYILITDKKISNIQEILPVLEQVVQQGKPLLIIAEDVEGEALATLVVNKLRGTFNVVAVKAPGFGDRRKAMLEDIAILTGGEVITEELGRDLKSATVESLGRAGKVVVTKENTTVVEGVGSTEQIEARIGQIRAQLEETTSEFDREKLQERLAKLAGGVAVIKVGAATETELKERKLRIEDALNSTRAAVEEGIVAGGGTSLMNVYTKVASIVAEGDEATGINIVLRALEEPVRQIAINAGLEGSVVVERLKGEKVGVGFNAATGEWVNMLETGIVDPAKVTRSALQNAASVAAMFLTTEAVVADKPEPNAPAMPDMGGMGMGGMGGMM

SEQ ID NO: 2389 - protein, 154 aa, Zea mays
MSLVRRSSVFDPFSVDLFDPFDSMFRSIVPSSPSSAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 2390 - protein, 259 aa, Rubrivivax gelatinosus
MNLIAVPAFTDNYIWMLHDGVSAIVVDPGEAAPVTRALDERSLKLAAIVVTHHHGDHVGGVDALRARLPDGRGPVYGPAREDIPQPFLPLRDGDAIELFGTRFEVIDVPGHTAGHIAYFGQPAGEAPILFCGDTLFSGGCGRLFEGTPAQMHASLSRLAALPGDTRVCCAHEYTLGNLKFACAVEPGNADLIDYVAQCESLRQRDLPTLPSTVARERQVNPFLRVTSTQVRTSARAHGAAGDDAVSVLAALRQWKNEFR

SEQ ID NO: 2391 - protein, 110 aa, Quercus suber
SLDIWDPFEGFSAVASVPPSARETTAFATARIDWKETPEAHIFKADLPGLKKEEVKVEVEDGNVLQISGERSKEHEEKNDKWHRVERSCGKFMRRFRLPENAKVDQVKAN

SEQ ID NO: 2392 - protein, 392 aa, Oryza sativa
MEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 2393 - protein, 193 aa, Sciadopitys verticillata
DDHGEVISEIRRSDLEPYLGLHYPATDIPQASRFLFMKNRIRMICDCCAPPVIVVEDKRLPRELSLCGSTLRAPHGCHAQYMSNMGSIASLVMAIVVNEKEEEDEDTDGEKQQQNGRRLWGLVVCHHTSARFVPFPLRYACEFLMQVFAIQLNKEVELAAQLREKHILRTQTLLCDMLLRDAPMGIVTQKPNI

SEQ ID NO: 2394 - protein, 440 aa, Sorghum bicolor
MSTTKVKRRVGKYELGRTIGEGTFAKVRFARDTVTGEAVAIKILDKDKVLKHKMVEQIKREISTMKLIKHPNVVRIYEVMGSKTKIYIVLEFATGGELFQRIVNHGRMREDEARRYFQQLINAVDYCHSRGVYHRDLKPENLLLDSYGNLKVSDFGLSALSQQMKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEKYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSKTLKDVVWKSDDTQMLHAA

SEQ ID NO: 2395 - protein, 454 aa, Arabidopsis thaliana
MVIKGMRVGKYELGRTLGEGNSAKVKFAIDTLTGESFAIKIIEKSCITRLNVSFQIKREIRTLKVLKHPNIVRLHEVIILLVLASKTKIYMVLECVTGGDLFDRIVRFLLAPVTVLLVSKRLVSKGKLSETQGRKMFQQLIDGVSYCHNKGVFHRDLKLENVLLDAKGHIKITDFGLSALSQHYREDGLLHTTCGSPNYVAPEVLANEGYDGAASDIWSCGVILYVILTGCLPFDDANLAVICRKIFKGDPPIPRWISLGAKTMIKRMLDPNPVTRVTIAGIKAHDWFKHDYTPSNYDDDDDVYLIQEDVFMMKEYEEEKSPDSPTIINAFQLIGMSSFLDLSGFFETEKLSERQIRFTSNSLAKDLLENIETIFTEMGFCLQKKHAKLKAIKEESTQKRQCGLSVTAEVFEISPSLNVVELRKSHGDSSLYKQLYERLLNELGSSSQVQELLA

SEQ ID NO: 2396 - protein, 734 aa, Hordeum vulgare
MAEVNMTGGAAEKLESSEPTQGIAETITDGVTKGVKELVVGEKPQVVPKPGDGQKIYEIDPTLKDFRSHLDYRYSEYKRIRAAIDQHEGGLEVFSRGYEKLGFTRSAKGITYREWAPGAHSAALVGDFNNWNPNADTMTRDDYGVWEIFLPNNADGSPAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYKFDGFRFDGVTSMMYTHHGLQMTFTGNYGEYFGFATDVDAVVYLMLVNDLIHGLYPDAVSIGEDVSGMPTFCIPVPDGGVGFDYRLHMAVADKWIELLKQSDESWKMGDIVHTLTNRRWLEKCVTYAESHDQALVGDKTIAFWLMDKDMYDFMALDRPSTPRIDRGIALHKMIRLVTMGLGGEGYLNFMGNEFGHPEWIDFPRGPQTLPTGKVLPGNNNSYDKCRRRFDLGDADFLRYRGMQEFDQAMQHLEEKYGFMTSEHQYVSRKHEEDKVIIFERGDLVFVFNFHWSNSKKDYRVGCSKPGKYKVALDSDDALFGGFSRLDHDVDYFTTEHPHDNRPRSFSVYTPSRTAVVYALTE

SEQ ID NO: 2397 - protein, 145 aa, Thermosynechococcus elongatus
MALVRWEPFREIDAIQRQMNRLFDELIPLTERRSDLSFLPAAELEETPEALLLKVELPGMDPKDIDVQVTAEAVSISGERKSETKTETEGMKRTEFRYGKFQRVIPLPVRIQNTSVKAEYKDGILHLTLPKAEEEKNRVVKVSLA

SEQ ID NO: 2398 - protein, 344 aa, Triticum aestivum
  misc_feature (275)..(275): Xaa can be any naturally occurring amino acid
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPXGKLRVMYEVFPMSFLMEEAGGQSFTGKGRSLDLIPTDIHERSPIFLGSSDDVEEIKALYAEEAKKEGSA

SEQ ID NO: 2399 - protein, 440 aa, Sorghum bicolor
MSATKVKRRVGKYELGRTIGEGTFAKVRFAKNTETGEPVAIKILDKEKVLRHKMVEQIKREISTMKLIKHPNVVRIYEVMGSKTKIYIVLEYVTGGELFDTIANHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEYTFPPWTSFPAKRLLTRFLDPNPMTRITIPEILEDEWFKKGYKRPEFDEKYDTPLDDVDAVFNDSEEHHVTEKKEEEPVVLNAFELISRSAGLNLGNLFDSEQEFKRETRFTSKCPPKEIVRKIEEAAKPLGFGVQKKNYKLRLEKVKAGRKGNLNVATEILQVAPSLHMVEVRKAKGDTLEFQKFYKNLSKTLKDVVWKSEDLQMQPAS

SEQ ID NO: 2400 - protein, 829 aa, Hordeum vulgare
MAAPAFAVSAAGIARPSARRSSGAEPRSLLFGRNKGTRFPRAVGVGGSGWRVVMRAGGPSGEVMIPDGGSGGSGTPPSIEGSVQFESDDLEVPFIDDEPSLHDGGEDTIRSSETYQVTEEIDAEGVSRMDKESSTVKKIRIVPQPGNGQQIYDIDPMLRDFKYHLEYRYSLYRRIRSDIDEYDGGMDVFSRGYEKFGFVRSAEGITYREWAPGADSAALVGDFNNWDPTADHMSKNDLGIWEIFLPNNADGSPPIPHGSRVKVRMDTPSGTKDSIPAWIKYSVQTPGDIPYNGIYYDPPEEEKYVFKHPQPKRPKSLRIYETHVGMSSPEPKINTYANFRDEVLPRIKRLGYNAVQIMAIQEHSYYGSFGYHVTNFFAPSSRFGSPEDLKSLIDRAHELGLLVLMDVVHSHASSNTLDGLNGFDGTDTHYFHGGSRGHHWMWDSRVFNYGNKEVIRFLLSNARWWLEEYKFDGFRFDGATSMMYTHHGLQVTFTGSYHEYFGFATDVDAVVYLMLVNDLIHALYPEAVTIGEDVSGMPTFALPVQVGGVGFDYRLHMAVADKWIELLKGSDEGWEMGNIVHTLTNRRWLEKCVTYAESHDQALVGDKTIAFWLMDKDMYDFMALNGPSTPNIDRGIALHKMIRLITMALGGEGYLNFMGNEFGHPEWIDFPRGPQVLPTGKFIPGNNNSYDKCRRRFDLGDAEFLRYHGMQQFDQAMQHLEEKYGFMTSDHQYVSRKHEEDKVIVFEKGDLVFVFNFHWSNSYFDYRVGCLKPGKYKVVLDSDAGLFGGFGRIHHTGEHFTNGCQHDNRPHSFSVYTPSRTCVVYAPMN

SEQ ID NO: 2401 - protein, 261 aa, Unknown
  Populus tremula x Populus tremuloides
KLVFYDCQSIAGRMDWDNNQENHQDSHQNQRECRNGINGTNVNVNGNGGTNMLYVKVMTDEQLETLRKQIAVYAAICEQLVEMHKTLSAQQDLAGGRLGNLYCDPLMASGGHKITARQRWTPTPVQLQILERIFDQGNGTPSKQKIKEITSELSQHGQISETNVYNWFQNRRARSKRKQLVASSNNAESEVETEVDSLNEKKKPEIFHAQQNPPRAEDLCFQSPEISSELHFLGDDHLTGKVGVPGNYNLYDQAEDYGMAG

SEQ ID NO: 2402 - protein, 444 aa, Oryza sativa
MAPTTAAAAASSNGGGESDGSSKEWRLTAPTRGGAMAAAGDKMSIRAVRYKISASVDDRGPRPVLPLAHGDPSVFPEFRTAAEAEDAVADALRSGDFNCYPAGVGLPAARRAVADHLSRDLPYKLSSDDIFLTAGGTQAIEVVISILAQPGTNILLPRPGYPNYEARAAFNNLEVRHFDLIPEKGWEIDLNSLESIADKNTTAIVIINPNNPCGNVYTYEHLSKVAEVARKLGILVITDEVYGNLVFGSSPFVPMGCFGHIVPILTIGSLSKRWIVPGWRLGWVAICDPKKTLQETKIATLITNFLNVSTDPATFIQGALPNILKNTKEEFFKRIIDLLTETSDICYRGIKDIKCITCPHKPEGSMFVMVKLNLYLLEGIHDDVDFCCQLAKEESVILCPGSVLGMKNWVRITFAIDSSSLLDGLERIKSFCQRHKKKNPLNYI

SEQ ID NO: 2403 - protein, 1035 aa, Thermosynechococcus elongatus
MRIFMFRFPLLSFIQLFLPTTAVIAALLTPLYVGQRQALFKDFRVGQEGKLEEIQLTIANDIDDAVTDPKGLGSFHLWHELIDSPSQGELAEEVQELVDQWHRLKEHYDQLYVLDTRGRIRFQWTSTPQSDPPSTVKAINSYWPILRELTPDQVFVSPVEVTATKSSGLPFPVLYIGVPLYHQSAPKGVLVVRYQLNHLFNNLLSRCNIQMGWCLVADDQGYWLLGEDIREQWGFDFPERRQFTVRHQYPLLWQQMQHQLRGGLFGPDGLFVFQSFSLLQENWISAERSAHSSRRQSNVRWWLIGFLPSSALEQYLDHLNRDFLVSFTALCILAAVAVLLITRDRQRKRSLQKLLETSNARFRSVSEMAPVGIFTLDAQGQPTFLNQRLLQLLQVHNLEEAQQQWIERLHPEDRDRVLKAWAACQQKRVPFHERFRIVHNDSSSHWINARIIPLQESSATDSFVGTWEDISQMMQQQELLEVARQAAEEASRAKSEFLATMSHEIRTPMNAIIGLTGLLLDTPLNPQQQEFVNTIRLSGDALLGVINDILDFSKIESGKLELESYPFNLRTCVEEVLDLLASRAAEREVELAAHIDSGVPCAVIGDMGRLRQVLVNLIGNAIKFTQKGNVTLYVKAKPMPMSQYEFMPSYYSYLFAIQDTGIGISAAGMNRLFKPFSQVDASTTRQYGGTGLGLVICQRLVERMGGQIWVESKKTGESLVVGGTPLAVYESIPIAESGSVFYFTARFLLNPNPAPEPTDDTCYLENRRVLIVDDNATNRQILALQIKKWKMQPLVAESGPSALALLQQQGWVDLAILDLQMPEMDGVTLARQIRAAYGELPLILLTSLGNTLTESEKALFSSLISKPVKQSTLYNALNSLFCEKQKTVSPKPAAAPSFEHLKAELPPLRILVAEDNKVNQMVALRILEKLGYRGDIAANGLEVLDAVQRQPYDVILMDMQMPEMDGITATREVTQLFQGLKKPRPRIIAMTANAMESDRQLCLDAGMDDYVSKPIRLEELVRALRQCQPLQTPTT

SEQ ID NO: 2404 - protein, 280 aa, Yersinia pestis
MQVSQYFGVFALVSYFIIFFQAVANERYLMNLISIPAFQDNYIWLLANRQKHCVIVDPGESAPVLATLAQGQYVPQAILLTHHHNDHVGGVADLRHHFPDIPVYGPQETAKKGATVIVNDGDSLTIAGQNYTIIAVPGHTLGHIAYYSSPYLFCGDTLFSAGCGRLLEGTPEQMYASIQRLAQLPDETLICCAHEYTLSNLKFAHAILPADQDIATYQQQIEQLRSKNLPSLPVKLQFERKINVFLRCNDIDLQRKIGTTSPPDSLVSVFCELRSRKDSF

SEQ ID NO: 2405 - protein, 489 aa, Debaryomyces hansenii
MFKRFVSFKAAGKLKLADLNKLTINAKYAVRGKIPIRADELKEQLNDTNNELPFKEIIYANIGNPQQLDQAPLTWYRQVLSVLQNPKLLNSQIDYPKDVIDRAKILLENVGSVGAYSHSQGTPHVRKSVADFITRRDGFPSNSSDIFLTSGASAAVSYLLQVLSSSDRSGFLIPIPQYPLYTATIALNDAVPIGYYLNEENNWSTNPTQIRELIKENNEKGIQIKALVVINPGNPTGSILSYDNIVEIINIAAEHGIAIIADEVYQENVFEGEFVSVKKVLSKLNRLDPQAYNNVQLASLHSTSKGVSGECGQRGGYMELVGFSKEVRDIIFKLASINLCSVVSGQTLMELMINPPTPESPSYELYKSETSKIHKSLQSRADLLYKSFIEMEGITCNKPMGAMYLFPKLNFTPNSYSKLFEASENIGATIDEVYCIELLENTGICCIPGSGFGQVPDTYHLRTTFLPPGSKWIDRWVEFHNDFIAKYKN

SEQ ID NO: 2406 - protein, 591 aa, Zea mays
MCGILAVLGVAEVSLAKRSRIIELSRRLRHRGPDWSGLHCHEDCYLAHQRLAIIDPTSGDQPLYNEDKTVVVTVNGEIYNHEELKAKLKTHEFQTGSDCEVIAHLYEEYGEEFVDMLDGMFSFVLLDTRDKSFIAARDAIGICPLYMGWGLDGSVWFSSEMKALSDDCERFITFPPGHLYSSKTGGLRRWYNPPWFSETVPSTPYNALFLREMFEKAVIKRLMTDVPFGVLLSGGLDSSLVASVASRHLNETKVDRQWGNKLHTFCIGLKGSPDLKAAREVADYLSTVHHEFHFTVQEGIDALEEVIYHIETYDVTTIRASTPMFLMSRKIKSLGVKMVISGEGSDEIFGGYLYFHKAPNKKEFHEETCRKIKALHLYDCLRANKATSAWGVEARVPFLDKSFISVAMDIDPEWKMIKRDLGRIEKWVIRNAFDDEERPYLPKHILYRQKEQFSDGVGYSWIDGLKDHASQHVSDSMMMNAGFVYPENTPTTKEGYYYRMIFEKFFPKPAARSTVPGGPSVACSTAKAVEWDASWSKNLDPSGRAALGVHDAAYEDTAGKTPASADPVSDKGLRPAIGESLGTPVASATAV

SEQ ID NO: 2407 - protein, 522 aa, Magnaporthe grisea
MGNSSSKEGGGGSSRSGSGADRGSDGLQSYPSFSRSDTKESSRSFRSLRSKIPGSGRTDSPRNSAIVTTNGDYGDKSDAASVKSGVSRQGRTDSNLSATSPTDTIQSPIDEPQLPPSPVHASHKQGAKHDVSAAQASGEVDHVSDQPPGQGGVPNPTAQSQTPGQSILVKREDAVNPVRTAGSPREDGVAMSEIKDIDLDDFIKRLLDAAYAGKVTKSVCLKNAEIAAICHRARECFLSQPALLELDAPVKIVGDVHGQYTDLIRMFEMCGFPPNSNFLFLGDYVDRGKQSLETILLLLCYKLKYPENFFLLRGNHECANVTRVYGFYDECKRRCNVKVWKTFIDTFNTLPIAAIVAGKIFCVHGGLSPALVHMDDIRNIARPTDVPDYGLLNDLLWSDPADMEQDWEANERGVSYCFGKKVITEFLAQHDFDLVCRAHMVVEDGYEFFNDRVLVTVFSAPNYCGEFDNWGAVMSVSSELLCSFELLKPLDSNALKSHIKKGRNKRQHMLNSPPASVYPQSV

SEQ ID NO: 2408 - protein, 80 aa, Zea mays
  misc_feature (32)..(32): Xaa can be any naturally occurring amino acid
  misc_feature (45)..(45): Xaa can be any naturally occurring amino acid
  misc_feature (55)..(55): Xaa can be any naturally occurring amino acid
  misc_feature (64)..(64): Xaa can be any naturally occurring amino acid
  misc_feature (74)..(74): Xaa can be any naturally occurring amino acid
  misc_feature (76)..(76): Xaa can be any naturally occurring amino acid
HASSNTLDGLNGFDGTDTHYFHSGPRGHHWMXDSRLFNYGNWEVXRFLLSNARWXLEEYKFDGXRFDGVTSMMXTXHGLQ

SEQ ID NO: 2409 - protein, 185 aa, Oryza sativa
GGLEARVPFLDKAFLDVAMNTDAADKMFSKGSLQEVDADGRPRMEKYILRKAFDVIPDDIEAGGDGTGSMLSASAPKKPYLPEDILWRQKEQFSDGVGYSWIDGIKDHAEQSISDEKFQERAKRYPTDTPDTKEAYMIREIFESWFPSDAAASTSVRWIPRADWGCASDPSGRAVKIHESAYADE

SEQ ID NO: 2410 - protein, 249 aa, Solanum tuberosum
EPRVNSYREFADDVLPRIKANNYNTVQLMAIMEHSYYGSFGYHVTNFFAVSSRYGNPEDLKYLIDKAHSLGLQVLVDVVHSHASNNVTDGLNGFDIGQGSQESYFHAGERGYHKLWDSRLFNYANWEVLRFLLSNLRWWLEEYNFDGFRFDGITSMLYVHHGINMGFTGNYNEYFSEATDVDAVVYLMLANNLIHKIFPDATVIAEDVSGMPGLGRPVSEGGIGFDYRLAMAIPDKWIDYLKNKNDEDW

SEQ ID NO: 2411 - protein, 470 aa, Methylobacterium extorquens
NSLTAGSRGPVLMQDYHLIEKMAHFNRERIPERVVHAKGYGAYGTFRLTRSLSEFTRAKVLTEVGKDVPMVARFSTVGGESGSADTARDPRGFALKFYTEEGNWDLVGNNTPIFFVRDAIKFSDFIRTQKRDPRTHLKPHWRRWDFWSLSPEAIHQVMFLYSDRGTPKSARFMNGYGSHTFSLWNDRGERHWVKFHFHTKQGIQNFSADEADEVAGKDPDYSSADLSTAIEQGDFPKWKVSVQLMPELDADTYRINPFDLTKVWPHGDYPLIEIGEMELNRNPENYFAEIEQSAFEPSNVVPGIGFSPHKMLQNRVLSYADAHRYRLGVNYQQIPVNQAKNADVQTYHRDGAMRTDGNHGAQVDYEPNSFGGPKQDPSFSEPPLRIQGDAGRYGWPGDDEDLYGQPKLFWTKVLDEGGRKRLVENIVTSMGDSPRHIQERMIAHWFKVHEDFGRGVAQGLGIDTAQAAAE

SEQ ID NO: 2412 - protein, 492 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIVSGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWISYWSQADRSLGQKLASRLNVRPSI

SEQ ID NO: 2413 - protein, 115 aa, Zea mays
  misc_feature (32)..(32): Xaa can be any naturally occurring amino acid
  misc_feature (45)..(45): Xaa can be any naturally occurring amino acid
  misc_feature (55)..(55): Xaa can be any naturally occurring amino acid
  misc_feature (64)..(64): Xaa can be any naturally occurring amino acid
  misc_feature (74)..(74): Xaa can be any naturally occurring amino acid
  misc_feature (76)..(76): Xaa can be any naturally occurring amino acid
  misc_feature (79)..(79): Xaa can be any naturally occurring amino acid
HASSNTLDGLNGFDGTDTHYFHSGPRGHHWMXDSRLFNYGNWEVXRFLLSNARWXLEEYKFDGXRFDGVTSMMXTXHGXQVTFTGNFNEYFGFATDVDAVVYLMLVNDLIHGLYP

SEQ ID NO: 2414 - protein, 135 aa, Zea mays
MRKHRIVSLVAALLVLLALAAVSSTRSAQKESVADNAGMLAGGIKDVPANENDLQLQELARFAVNEHNQKANALLGFEKLVKAKTQVVAGTMYYLTIEVKDGEVNKLYEAKVWEKPWENFKQLQEFKPVEEGASA

SEQ ID NO: 2415 - protein, 115 aa, Zea mays
  misc_feature (53)..(53): Xaa can be any naturally occurring amino acid
  misc_feature (60)..(60): Xaa can be any naturally occurring amino acid
  misc_feature (76)..(76): Xaa can be any naturally occurring amino acid
  misc_feature (81)..(81): Xaa can be any naturally occurring amino acid
  misc_feature (96)..(96): Xaa can be any naturally occurring amino acid
  misc_feature (100)..(101): Xaa can be any naturally occurring amino acid
  misc_feature (106)..(107): Xaa can be any naturally occurring amino acid
HASSNTLDGLNGFDGTDTHYFHSGPRGHHWMWDSRLFNYGNWEVLRFLLSNAXWGLEEYXFDGFRFDGVTSMMYTXHGLQXTFTGNFNEYFGFATXVDAXXYLMLXXDLIHGLYP

SEQ ID NO: 2416 - protein, 410 aa, Yarrowia lipolytica
YITWLIVDGEETDNRDNFLRHSKTHSNMSTVNLFKPIKIGATQLQNRVVMAPLTRTRAQKNIPSDLAVEYYKQRGSSPGTLLISEATYIHPSSGGGGFGAETVPGIWNDSAIVAGWKKVIDGVHSEGSKMYIQLWDIGRVADYEILSKNGYDLTGPSAIAQAGDEEGAKHVRALTIPEIKQKVQRYVDAAKAALEAGADGVEVHSANGYLPDQFIHWNSNHRTDEYGGSIENRARFTLEIIDAVSAAIGADRVGVRFSPWTTFQDMEVSEEKTLPQFKYLFEQLEKRGVEDASKRLSYIHVIEPRANGIFDMTPEPWQSNEPFRKIWTGNLIRAGGFNRQLAIDTAQEDDKTLIAFGRRFIANPDLVYRLEKDLPLTKWDRDTFYVPGPKGYTDYPFYKDQLEQDQELKQ

SEQ ID NO: 2417 - protein, 292 aa, Helicobacter hepaticus
MAKNNKTQVILNEFFTLNNGNKIPKLGLGTWRIDDNVVEAAVREAFKVGYRHIDTAQAYGNERGVGEAVRKSKIKREELFITSKIRAEYKDYKSASASIDTSLKTMKLDFIDLMLIHSPQPWNSFRKGDYFKENVEVYNALEDAQKAGKVRSIGVSNFLQKDLENILKNCKTKPAANQILCHIGNTPFTLLDYCKKQNILAEAYSPIAHGELLKDPRVIELAKKYNVSPAQICIRYTLELGLVSLPKSKTPKYIAENAQVDFTFSKADLQTLKKLTFKDYGEHSYFPVFGGK

SEQ ID NO: 2418 - protein, 97 aa, Zea mays
MAEVHNERPVMVGDVRDAPVGRENDLEAIELARFAVAEHNSKTNAMLEFERLVKVRHQVVAGTLHHFTVEVKEAGGGEKKLYEAKVWEKAWENFKQL

SEQ ID NO: 2419 - protein, 226 aa, Zea mays
AAAAAHPPSAFLLLLVLLGCASLAIGGAAMAGHVLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKQGGHEPGWREVPVEDPVVKDAAHHAVKSIQERSNSLFPYELLEILRAHAQVVEDFAKFDILMKLKRGSKEEKIKAEVHKSLEGAFVLNQ

SEQ ID NO: 2420 - protein, 573 aa, Candida albicans
MCGIFAAYRQPEVEDFKSKALQYSKLIRHRGPDWSGNVVQNSTILCHERLAIVGLDSGAQPIVSPDGNFTLAVNGEIYNHIQLREQFPDYKFKSLSDCEPIIPLFTKYDIDAPKHLDGMFAWVLYDKKNDRIVAARDPIGITTLYMGKSSKSPKTRYFASELKCLIEECDEIFAFPPGHVYDSNTDEITRYFKPSWWDASKVPEQHVDFKKVRETLELAVRKRLMAEVPYGVLLSGGLDSSLIASIASRETKKAAQASFNPEGIDANKELSGVDDKGSLHSTGVFNQLHSFAIGLPGAPDLLAAEKVAHFIGTIHHSHTFTLEEGLDALDDVIYHLETYDVTTIRASTPMYLLSRKIKAQGVKMVLSGEGSDEIFGGYLYFANAPSAKEFHEECVKRVKNLHYADCLRANKSTMAWGLEARVPFLDKQFLEVCMNINPEDKLIQPGKIEKYILRKAFDTSDEPDVKPYLPEEILWRQKEQFSDGVGYSWIDGLKDTAEKMVSDEEFAHPKPEWGDDIPTTKEAYWYRCKFDKMFNGSKAAASTVMRWIPKAEWGCHADPSGRYAATHDHKVAQ

SEQ ID NO: 2421 - protein, 98 aa, Medicago sativa
METLGGVRDVPGNQNSLAIDGLARFAVEEHNKKQNALLEFSRVISAKEQVVAGTIHHITLEVKDGVNKKVYEAKVWEKSWMNFKEVQEFKLVEDAPAQ

SEQ ID NO: 2422 - protein, 478 aa, Lactobacillus plantarum
MTIKGRAFPEGFLWGGAVAAHQLEGGYKEGGKGLSTADIMTLGTNERPREITDGVVAGKYYPNHQAIDFYHRYPEDIELFAEMGFKCFRTSIAWTRIFPNGDESEPNEAGLQFYDDLFDECLKNGIQPVVTLAHFEMPYHLVKQYGGWRNRKLIQFYLNFAKVCFERYRDKVTYWMTFNEINNQTNFESDGAMLTDSGIIHQPGENRERWMYQAAHYELVASAAAVQLGHQINPDFQIGCMIAMCPIYPLTAAPADVLFAQRAMQTRFYFADVHCNGTYPQWLRNRFESEHFNLDITAEDLKILQAGTVDYIGFSYYMSFTVKDTGKLAYNEEHDLVKNPYVKASDWGWQVDPVGLRYAMNWFTDRYHLPLFIVENGLGAIDKKTADNQIHDDYRIDYLTDHLRQIKLAVLEDGVDLIGYTPWGCIDLVAASTGQMSKRYGFIYVDENDDGSGSLKRYKKDSFTWFQHVIATNGAEIE

SEQ ID NO: 2423 - protein, 441 aa, Bartonella quintana
MIRKVILLVAGVLLGASSMIMVQSVAANNEGDTYQQLSLFGDIFERVRMQYVTVPDDKKLIENAINGMLTSLDPHSSYMNAEEAKDMWDSTKGEFGGLGIEVTMEKNLVKVVSPMDDTPASKAGILAGDLISKIDGVQTNGQTLNEAVKRMRGAPGTPITLTIIRSGVDKPLEIKVVRDIIKVKAVKYRVEDDIGYLRLIRFSEQTFGDLQTAIKDIQSKIPQDKLKGYVLDLRLNPGGLLNQAVNVSSAFLNKGEIVSTRGRKKNDVVRFDAKPGDIINGKPLIVLINGGSASASEIVAGALQDHRRATILGTQSFGKGSVQTVIPLGENGALRLTTALYYTPAGTSIQGTGITPDIIVEQPLPEQYKDYDVKLGESELKGHIKGKQESNKGSGSAAFVPKDPKDDTQLSEAYKLLRGEMAHAAFPPDPNKNVLKKDVLK

SEQ ID NO: 2424 - protein, 545 aa, Porphyromonas gingivalis
MAKEIKFDMESRDLLKKGVDALANAVKVTLGPKGRNVILSKTYGAPHITKDGVSVAKEIELECPFENMGAQLVKEVASKTNDDAGDGTTTATILAQSIIGVGLKNVTAGANPMDLKRGIDKAVKAVVTHIAGMAKEVGDDFQKIEHVAKISANGDENIGSLIAEAMRKVKKEGVITVEEAKGTDTTVEVVEGMQFDRGYISPYFVTNTDKMEVQMENPFILIYDKKISVLKEMLPILEQTVQTGKPLLIIAEDIDSEALATLVVNRLRGSLKICAVKAPGFGDRRKAMLEDIAILTGGTVISEETGLKLENATMDMLGTAEKVTVDKDNTTIVNGAGNKEGIASRITQIKAQIENTTSDYDREKLQERLAKLAGGVAVLYVGAASEVEMKEKKDRVEDALSATRAAIEEGTVPGGGTAYIRAIAALEGLKGENEDETTGIEIVKRAIEEPLRQIVANAGKEGAVVVQKVKEGKDDFGYNARTDVFENLYSTGVIDPAKVTRVALENAASIAGMFLTTECVIADKKEDNPAAPAMPGGMGGMGGMM

SEQ ID NO: 2425 - protein, 240 aa, Arabidopsis thaliana
MTDPHTARTIVGIVGNVISFGLFCAPIPTMVKIWKMKSVSEFKPDPYVATVLNCMMWTFYGLPFVQPDSLLVITINGTGLFMELVYVTIFFVFATSPVRRKITIAMVIEVIFMAVVIFCTMYFLHTTKQRSMLIGILCIVFNVIMYAAPLTVMVRVIKTKSVKYMPFFLSLANFMNGVVWVIYACLKFDPYILIPNGLGSLSGIIQLIIYITYYKTTNWNDDDEDKEKRYSNAGIELGQA

SEQ ID NO: 2426 - protein, 230 aa, Oryza sativa
MAASTASWSRYGTVPPAAAAAAPPLKREEVVVGGDGEAAAAAPSPSPATAAEAGVAFFSRARAVAGAAAGRPRAWREVLDATAFSRPESCGEARARARRNLAYFRANYALAALVLVFLGLVYRPVSMLAFLALFAAWLGLYFGRGDGEPPLACMGREVDDRVVLAALSVATVLAVALSRAGLNLLVSLVLAAAAIGAHAAFRMNVYLDERDAYDGSSFMGSSYGGYALPR

SEQ ID NO: 2427 - protein, 300 aa, Zea mays
  misc_feature (88)..(88): Xaa can be any naturally occurring amino acid
SGAFTHCCCSVLASGSHRSADDCLLCPSFPSQWQAEDLQCLPSSARPTPPAAQHRGRGETQDHQLAWVQQSKKKKFRGVRQRHWGSWXVSEIRHPLLKRRVWLGTFETAEEAARAYDEAAVLMSGRNAKTNFPVLPCGRTRGGGGGGGSSGNNTNASASASASTSTSSLSQSQVLSAKLRRCCKAPSPSLTCLRLDPERSHIGVWHKGAGARADSSWVMTVQLSDKDAAPAPSATSSATATTTTAASHPPPATVVVVDDEERIALQMIEELLGGGGGPVSQQPLGNGMLQIAAAGGGLVI

SEQ ID NO: 2428 - protein, 330 aa, Unknown
  Shewanella sp. MR-4
MQTLAQHLTSKAVNESLSQLILTLADTSKAISHAVRHGALAGVLGATEQENVQGETQKKLDIITNDMLKDALKVDGTVRGLASEEEDHVVEVSANGKYLVCFDPLDGSSNIDINSLVGTIFSVLPAPAGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGIDYSEEPTLD

SEQ ID NO: 2429 - protein, 370 aa, Unknown
  Acinetobacter sp. ADP1
MAKLFENIQFDTLRLSNKIIIAPMCQYSATDQGEITYWHEQQWANYALSGAGLCIIEASAVQAAGRISYADVGLWNDNQRDQIKMLLNKIKHLSPVPFGIQLAHAGRKASTDKPWLGKGQIPPDHVHGWQTVAPSSIAFGEHDLAPHALTRDEIQQIQADFAASAVRAVEAGFKLIEIHAAHGYLLHQFLSPLSNLRDDEYGGSFENRIRMTLEVLQAVKAVVPEGFPVGVRISATDWMPTQSWDIESSVGLSQALEQLGAAYIHVSSGGLHVMQDIKVGANYQVPFAAQIKQNVSIPVIAVGLITEPDQAEAILQNDEADAIALARAMQYDPRWPWHAAAALGAEIEISPQYLRCQPHGLKQLFKAFSH

SEQ ID NO: 2430 - protein, 664 aa, Chromobacterium violaceum
MEARSQALQQANVQLTEARDAAEAANRAKSEFLAVMSHEIRTPLNGVIGMTDLLQRTRLDDRQRHYVSVVHRSGEDLLAIISDILDFSKIEAGKFELDRQPFCLNLLVEEIVERLAPVAYGKGLELMCALPLMPVEVVGDGKRLGQVLTNLVGNAIKFTESGHVLAKVDRAGESDAGVTCRISVKDTGIGIAPDQQKRLFKPFSQADSSTTRRFGGTGLGLVISQRLVGMMGGRIELESEPGSGSEFHFTLTLPRASDSQLCPPAEDVARMRVLVLDDNVTNLEILEQQLASWHCRVAAFHRPREALDWLTAGNEVDLIISDMMMPEMDGLMFLGEARERLGEAAPPAIILSSAADDFQKLTGASRLARQVLTKPIRRSDLYNALLQLGSAAAKVEPAPDGHDQPRLSGRVLLVEDNLVNQELATAMLRNLGCEVELARNGEEALRLCEAGGFDLALMDCEMPVMDGWQATGAIRARERPGGARLTIVALTANAGLGERERCLQAGMDDYLSKPFTQNELGAVLSRWLSPGEEAEASAEPAGIAARDDGEWVDAGALDAIRAIQQDLLPRMLAAWMSEGPMLLAGIREAIDAVDGPALFRAAHALKNCAGSVGAQPLASLCMELERLGKGEDLAGAANLLPELDQAFGCSMAALKAVDEGSGLA

SEQ ID NO: 2431 - protein, 445 aa, Anabaena variabilis
MNSSAKHHSLLQVAMIGGAIATTATISVFGPAWTRSVRAALQDSPKAVIDQVWQLVNNEYVDGKFNQQDWLAVRKSLLSKDYSSKEEAYVAIREALQRLNDPYTRFMDPKQFEVLTSQTSGEVSGIGIRMELNEITKRLTVLEAIENSPALKAGIKAGDEILAIDGKPTQQMKVDDASKLIRGKEGTAITLRLGRTGNSAFDLKLTRAKIEVPTVSYNLKQEGSRRVGYIRLREFSAHAAEQMARAIRNLNGQKVDSYVLDLRGNPGGLLQASIEIARMWLDDGGIVRTVNRQGFNEDTKANRTALTKLPLAVLVDGNSASASEILTGALKDNKRAVVIGGQTFGKALVQSVHELPDGSGLAVTIAHYYTPNGTDINHKGITPDIKLELTDAQERQLANNPKLIATQNDPQYARAIAVLSGNTFARPPLNQTNQPMSLGANELKF

SEQ ID NO: 2432 - protein, 476 aa, Bacillus cereus
MQNKIIMMFQKDFRLYDNPALFEAAQSGEVVPVYVQDETFSIGSAAKWWLHHAIIDVQKQLKALGATFIIRKGKTQEEILSLIEQLDITAVYWNICYEPDRLQSNQKMKMMLEDKGIICKEFNSHLLLEPWIIKKKDNTEYKVFTPFYNAFQKQAIPKPTSKVQSIKWGSSLPASLSVSELHLLPTIPWTSHMESIWNPTEEGAYKTFKKFFSSKLTFYSEGRDFPNQNVHSMLAPYLSFGQISVKLMFHYLINKSTERQSSLFEKQVNSFIRQLIWREFSYYLLYHYPFTVYKPLNKNFEHFPWDKEEELLRVWQKGETGYPFIDAGMRELWQTGFMHNRARMAVASFLVKHLLIPWQEGAKWFMDTLLDADIANNTMGWQWVAGSGADASPYFRIFNPITQGEKFDKDGEYIRKWVPELRDIPNKYIHKPWEAPEPILQKANIQLGDTYPLPVVDHKAARERALCAYKSMKEFI

SEQ ID NO: 2433 - protein, 741 aa, Pyrus pyrifolia
MLACNCIEPQWPADELLMKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPIHLPVVNQVFSSNCAVKISPNSPVARLRQLAGKHIPGEVVAVRVPLLHLSNFQINDWPELSTKRYALMVLMLPSDSARQWHVHELELVEVVADQVAVALSHAAILEESMRARDLLMEQNIALDLASREAETAIRARNDFLAVMNHEMRTPMHAIIALSSLLQETDLTPEQRLMVETILKSSNLLATLINDVLDLSRLEDGSLQLDIATFNLHSIFREVHDLIKPVASVRKLSVALNIAADLPVCAIGDEKRLMQIILNVVGNAVKFSKEGSISITAYVAKSESLRDFRAPDFFPVQSDNHFYLRVQVKDSGSGINPQDIPNLFTKFTQTQTLASQNSGGSGLGLAICKRFVNLMEGHIWIESEGLGKGCTATFIVKLGFPERSNESKQPFAPKLQANHVQTNFPGLKVLVMDDNGVSRSVTKGLLVHLGCDVTTVSSIDEFLHVISQEHKVVFMDVCMPGIDGYELAVRIHERFTKRHERPVLVALTGSIDKMTKENCMRVGMDGVILKPVSVDKMRSVLSELLEHRVLFEAM

SEQ ID NO: 2434 - protein, 220 aa, Zea mays
MGQQSLIYAFVARGTVVLAEYTEFTGNFTTIASQCLMKLPASNNKFTYNCDGHTFNYLVEDGFTYCVVAVESMGQQIPIAFMDRVKEDFTKRYGGGKAATAAANSLNREFRLKIKEHMQHCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 2435 - protein, 638 aa, Pyrus pyrifolia
MESCDCIEAQWPPDELLVKYQYISDVFIALAYFSIPLELVYFVQKSAFFPYRWVLVQFGAFIVLCGATHFINVWTFSMHTKTVAIVMTVAKVSCAVVSCATALMLVHIIPDLLSVKKRELSLKSRAEELDKEMGLMLTQEETGRHVRMLTHEIRSTLDRHTILKTTLVELGRTLGLQECALWMPSRTGMNLELSHTLNYHLQAGSSVSIDLPEVNEVFNSSRAIRIPYTCQLARIRPLVGRYVPPEVVALRVPLLNLSNFQINDWPDVSAKSYAIMVLILPTDGTRTWREHELELVDVVADQVAVALSHAAILEESMRARKQLTEQNDALDLAWREAEMAIHARNDFLAVMNHEMRTPMHAFIALSSLLLETELTPEERLMIETALKSSNLLETLVNDVLDLSRLEDDSLELDIEKFNLHGVFREVMNLVQPVASVKKLSMTLILSPDLPVYAVGDENRLLQTILNVAGNAVKFTKQGYISITASVAKSESSRDWQPPEFYPASTDGYFYLRVQVKDSGCGVLPEDIRHLFTKFSQPRNGSNRINNGAGLGLAICKRFVNTMGGHIWIESEGIDRGSIVAFIVQLGICDNHSDTTTHQVQMPPKGQANYGSGDVIGHKSAFRDCFGVTSSNARYQRSL

SEQ ID NO: 2436 - protein, 284 aa, Glycine max
  misc_feature (106)..(106): Xaa can be any naturally occurring amino acid
  misc_feature (151)..(151): Xaa can be any naturally occurring amino acid
TRPATGWGLEIPELKKQLEAAKSKGINVRALVVINPGNPTGQVLGEANQRDIVEFCKQEGLVLLADEVYQENVYVPEKKFHSFKKVSRSMGYGENDITLVSFQSGXRGGYMEVTGFSAEVREQIYKVASVNLCSNISGQILASLVMSPPKXLQVGDESYDSFNAEKENILESLARRAKTLEDAFNKLEGVTCNKAEGAMYLFPQIRLSQKAIKAAGDANTAPDNFYCKRLLNATGVVVVPGSGFGQVPGTWHFRCTILPPEEKIPAIVTRLTEFHEKFMDEFRD

SEQ ID NO: 2437 - protein, 660 aa, Thermosynechococcus elongatus
MCGLTGFWQPCGCPTDEVSATIQRMADTLVHRGPDDVGVWVDTEVGIALGHRRLAILDLSPAGHQPMVSATGRYVIAFNGEIYNHLELREELSKVGAGGTAPVWRGHSDTETLLAAFAALGIEKTLKRVVGMFAIALWDRETRTLTLARDRMGEKPLYYGWVRDALVFGSELKALRAYPGFDNAIERRSLALFMRYDYIPAPWSIYENIWKLPPGCFVQFRAASHGGEPLAVGSRGNIKPYWSVRDVAERGLANPFTGREADAVEELERLLRQSIAGQMMADVPLGAFLSGGIDSSTVVALMQAQSSRAVKTFTIGFHEQDYNEAKHAKAVACHLRTNHTELYVTPQEAMAVIPKLPSLYDEPFADSSQIPTFLLAQLARQQVTVSLSGDGGDELFGGYTRYFLTHSLWQRLAWIPLPMRKLAEQGVLAISPQTWNRVFALLAPVLPERLRFRLPGDKLHKAAALFVTRRPEDIYLRFVSHWHDPTSLVIGTEEPRTALTEPATVLEGADFEARMMYLDSITYLPDDILVKVDRAAMGVSLETRVPLLDHRIVEFAWQLPHYFKIRRGQSKWLLRQVLYRYVPKELIERPKMGFGIPLDQWLRGPLREWAEDLLSEERLKREAFLNPELVRQKWQEHLLGRRNWAYHLWNVLMWEAWLAA

SEQ ID NO: 2438 - protein, 455 aa, Triticum aestivum
MGGMLLPAASSPPLSRVATSSAHGEDSPYFAGWRAYDDDPYDAVTNPGGVIQMGLAENQVSFDLLEGFLREHPEAAGWGGARPGSGVASFRDNALFQDYHGLKTFRKAMASFMEKIRGGKVRFDPDRIVLTAGATAANELLTFILANPGDALLIPTPYYPGFDRDLRWRTGVNIVPVHCHSSNGFQVTVAALEAAYEEAAAAGMSVRGVLLTNPSNPLGTTVERSALEDVLDFVVRKNIHLISDEIYSGSVFAAPDLVSVAELVESRGDDVAGRVHIVYSLSKDLGLPGFRVGVVYSYNDAVVTAARRMSSFTLVSSQTQKTLAAMLSDAAFAQEYIRTNRERLRVRHDHMVAGLARSGVPCLPSNAGLFVWMDMRRLLRDGGEATVADELRLWDLMLREVKLNISPGSSCHCSEPGWFRVCFANMSLDTLDVALARMSRFMDRWNKATTLQEQH

SEQ ID NO: 2439 - protein, 187 aa, Triticum aestivum
MSTSSGAKEAPANNPGLQAEADPATKGYIMQQTMFRVKDPKVSLDFYSRVMGMSLLKRLDFPEMKFSLYFLGYEDLSAAPADPVQRTGWTFGQKATIELTHNWGTESDPEFKGYHNGNSDPRGFGHIGVTVDDVYKACERFESLGVEFVKKPDDGKMKGIAFIKDPDGYWIEIFDLKRIGEVTAAAS

SEQ ID NO: 2440 - protein, 380 aa, Unknown
  Populus alba x Populus tremula
MCGGAIISGFIAPTTTARSSRRLTSGFEWLEPKKPFNNKHLKPVVADPEDDFEADLQEFKDESDVDEDYDVFADAKPFAFSASASEPAKKRGLPRGSTAVKSAGFSGLAKNSAKRKRKNQFRGIRQRPWGKWAAEIRDPRKGVRVWLGTFNTAEEAARAYDSEARRIRGKKAKVNFPDEAPCASARHPIKENSQKRLTKANLSQDFSYLSNPETDYNNMGFVEEKPQVSQFGIMNSIPVNGDSGVTPLTPSDNASMYFNSDKGSNSFDCDFGWGEQGAEILSVLAATPEVDESVFVEANPKKLKSYTEYAVPVEERNGKSLSEELLAFDNQLMNLQMPDLVGNWEASLDSFLNGDTTQDGTNAVDLWSFEDFPSMVGGVY

SEQ ID NO: 2441 - protein, 397 aa, Carica papaya
ALDTLMVGKLTTESLFILLAILTGLSNGSLENQLCFDLIEKWVKKNPNASICTALEGVENFKHIANFQDYHGLKEFRQEVAKLMGKARGGRVTFDPERIVMSGGATGASETIMFCLADPGDAFLVPTPYYPAFNRDLRWRTGVQIIPVQCSSSNNFTVTREAVEAAYQKAQEANINVKGLIITNPSNPLGTTLDSQTLQSLVIFVNDKTIHLVCDEIYAATVFSSPEFVSIAEIIQEIDVNRDLIHILYSLSKDMGLPGFRVGIVYSYNDVVLSCGRRMSSFGLVSSQTQYFLATLLSDDEFVDYFLRESSKRLARRHHKLTRGLEQVGIKCLKSNAGLFVWMDLRRLLEDPTSFDAEMKLWRTIVNDVKLNVSPGSSFHVAEPGWFRVCFANMDEF

SEQ ID NO: 2442 - protein, 179 aa, Zea mays
MVSFEMNDLKKIGLGLTGFGIFFSFLGIIFFFDKGLIAMGNILFLSGLGLTIGLKSTMQFFTKPKNYKGTISFAAGFFLVLIGWPFLGMLLEAYGFVVLFSGFWPTLAVFLQRIPIIGWIFQQPFVTSVCKGSNSFRLLYGKERRLGRIEVTCDSCDAMWLFSSVIPLPGLVWELSFEL

SEQ ID NO: 2443 - protein, 112 aa, Triticum aestivum
EGPNYDDVHCPECCLHFPEGAMYSFPQIRLPQRALDVAKKRLAKPPDVYYFLKLLEATGISTVPGSGFGQKEGLFHLRTTILPAEEDMPAIMSSFKKFNDSFMEQYQDHSRL

SEQ ID NO: 2444 - protein, 379 aa, Zea mays
  misc_feature (330)..(330): Xaa can be any naturally occurring amino acid
MRRWFCCTRFNASYREHENERPITPEEKEGNGFSVKSDPIKAPPSIEVPELSFEELKEKTDNFGSKALIGEGSYGRVYYAILDSGKHVAVKKLDASTDPELDNEFLTQVSIASKLKHDNFVEMLGYCVEGNQRLVVYEFATMGSLHDILHGRKGVPGAQPGPALDWMQRVKIAIDAAKGLEYLHEKVQPSIVHRDIRSSNILLFEDYRAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKVWLQSFHTLCACASXLAAVAALCVQYESEFRPSMSIVVKALSPLLQHKPQPPAATTDATAPSDA

SEQ ID NO: 2445 - protein, 683 aa, Coxiella burnetii
MGRQNWKIKNLEVCMEVSTTRIHKPILKKLGSLFLNLAETSQDIFWIRSVDFYTHVYVSPAFENIFGISRQTLYANPNKWMNAVIIEDRDRLRHLIMEWQVKNKKGAAYTVDYRIIDAYGEMHWINETSYPVYEDDQCLGYAGVVKDVSSEKLRVKEFDNAVHYFRHFVERVSGVFWVKGSRGDKQIYISPTYEKIWGVSCESLYQNPKSWIDYVLPEDISNGKVNVNFYETAADQRTPDSKYEFHFRIRRPDGEIRWIKDTYFPIMENGKLVGFAGIAEDVTNDALREKELWEAKEFAEQANRTKSDFLAMMSHELRTPLNAILGMSQILKTHNLSDEQQGQIDVISQAGQNLLALLNDLLDFAKLEAGKLSFTEETMDLHELVMKIKGDMLLLAHKKGIQLKFDYPENIPSKVMGDAKRIRQVLVNLLSNALKFTEKGYVQLTANCLKKDHKKMTLCFTVKDTGIGMEKTKLSSIFNRFQQINSVYQRKYDGVGLGLSIVKELLEKMGGTISVTSEPGVGSEFTCIIPFRLQADSNPTLPARDLLEKQAVNNSTYDRESRFNMNVLVVEDNLINQRISKIMLEQVGCQVDIAGCGKDAIEKMKKHYDMVFMDIGLPDMDGFETTQCIRHNETPGQRVPIVAMTAHVFAQDRKRCFDVGMDEVMAKPIMQDDLIKVLKRWAA

SEQ ID NO: 2446 - protein, 495 aa, Rhodopirellula baltica
MGAIVIPWRRSRSSPQSDSAMLPRNLTLLLSVLVISFACYAIYLRTRSAMMVGEAIEMIDRYYVEPVDRRELLTSAMAGMTSTLDQHSEYIPPVSYQAFQDTIQQEFAGIGIYVDQPVEGEPVRVITPLVGSPALRAGLMPGDAILEVDGEYVGDMDIRSVSERLRGPIATTVQLLVERGEEKLEVKVQRDTIQLESVIGDYRNGGNEWVYRLKQHPDIVYVRMTSFGDKTVSELRSVLSRLMPKPDVSGFVLDLRGNGGGLLTAAVDVCDMFLSSGRIVSTKTRGGVVEDEVSATAGTLVPPDMPVAILIDEHSASASEIVAAALQDHGRATIVGTRSYGKGTVQNILPLEYGRSALRLTVAKYYRPSDQNIHRGVDDTEEDVWGVSPDPGMDVKIAEDDIRQLARFWEEASYPSLKNRDLKDAHLKLADPDEEVDSDAAPDASSNEASNSTEEDAVVTERSPAESAWELDTPLRTAVEAIRSAKSSKQISAAA

SEQ ID NO: 2447 - protein, 621 aa, Dechloromonas aromatica
MQHADALYLFNEGRNNQAYRLLGAHADISGTTFRVWAPNASRVSVVGDFNGWHGDVHQLHPLGESGVWEIAVAEAHTGNLYRFEITNRHTGDKLIKSDPYGRGFELRPGSAAYVVPPSMHVWGDADWLQQRAGWDWQQAPVNIYEVHPGSWMRHPDGKPYLWGELAERLIPYALAQGYTHLELLPITEHPLDESWGYQTTGYFAPTSRYGSADELRAFVDACHQAGLGVLLDWVPGHFPQDDWALARFDGTALYEHEDPRLGLHADWGTHIFNYGRHEVRSFLMSSAHWWLSEFHFDGLRVDAVASMLYLDYSRKHGEWLPNKFGGRENLEAIDFLKQLNAMVHGDFPGALTIAEESTAWPMVSRPTYVGGLGFSMKWNMGWMNDSLRYFHRDPIYRRWHHSELTFGQIYAYSENYVLPFSHDEVVHGKGSLLGKMPGDTWQRYANLRLLLAWQVLTPGKKLMFMGCEFGQQGEWSEGRELDWGSLANPENAAAQRLSADLNRLYRDLPALHTQDFSALGFEWIDCNDSEHSVLSWLRWGKDGSFVVVVFNFTPVPQPAYRLGVPEAGTYVELLNTDSAFYGGSNLGNGGALTATKGEWMGRPANLEVTIPPLGAVVLRRE

SEQ ID NO: 2448 - protein, 234 aa, Aristolochia arborea
VPQAARFLFMKNKVRMICDCYAKPVKVYQDERLSFDLTLCGSTLRASHSCHLQYMKNMDSVASLVMAVVVNEGEEDGDPDTNQEQQAQPKRKRLWGLVVCHNTTPRFVPFPLRYACEFLMQVFAIHVNKELELENQIREKNILRTQTLLCDMLLRDSPLSIVSRSPNIMDLVRCDGAALLYQNEVYTLGAAPTESQIREISRWLSEFHMDSTGLSTDSLQDAGYPKALSLGDIV

SEQ ID NO: 2449 - protein, 233 aa, Aristolochia arborea
VPQAARFLFMKNKVRMICDCYAKPAKVYQDERLSFDLTLCGSTLRASHSCHLQYMKNMGSVASLVMAVVVKEGEEDDNPDLNQEQAQPKRKRLWGLVVCHNTTPRFVPFPLRYACEFLMQVFAIHVNNEVELENQIREKNILRTQTLLCDMLLRDTSLSIVTRSPNIMDLVKCDGAALLFRNKVYTLGITPTESQIREINQWFSEYHMDSTGLSTDSLHDAGYPKALSLGDIV

SEQ ID NO: 2450 - protein, 727 aa, Xanthomonas campestris
MTAVTNRWDPGVTRALAEARHGDAFAVLGAHPSTNGRLLRTYHPGAEHVTAVLADGREVPLEAGPEPGLFAGELPAEGRYRLRIGWPGGTQDTADPYAFGPLLSDFDLHLISEGHHLQLADALGANAVEVDGVRGTRFAVWAPNASRVAVVGDFNSWDARRHPMRLRHQAGVWELFVPDVGPGAHYKYQLRGPHGHELPAKADPVARRAELAPGTASIVADPTPHQWSDDGWMATRARRQAHDAPMSIYEIHAGSWLREEGLDLDWDGLADRLIPYVADMGFTHVELMPVTEHPFGGSWGYQPLGLFAPTARFGSPDGFARFVDRCHREGIGVIVDWVPAHFPTDAHGLAHFDGTALYEHADPREGFHRDWNTLIYNHGRREVSGFLIASALEFLQRYHVDGLRVDAVASMLYRDYSRNAGEWVPNIHGGRENYETIAFLRRLNEVVREHAPGAVTIAEESTAWPGVTADVSHGGLGFHYKWNMGWMHDTLHYIGLDPIYRRYHHGELTFSMVYAYSERFVLPISHDEVVHGKGSLLGRMPGDDWQRFANLRAYLGFMFTHPGRKLLFMGCEFGQPTEWNHDAGLPWHLLDDARHRGVQTLVRDLNHLYAQYPALHAHDDDPSGFAWLVGDDAANSVVAFLRKGKRGDAPVLVVINYTPVVQQGYRLGVPQGGLWREVFNSDAGIYGGANLGNGGAVTAEPQSMHGHAQSLPLLLPPLGVIVLAPQG

SEQ ID NO: 2451 - protein, 1132 aa, Glycine max
  misc_feature (722)..(722): Xaa can be any naturally occurring amino acid
MSTSRPSQSSSNSRRSRHSARMAQATVDAKIHATFEESGSSFDYSSSVRVSGTADGVNQPRSDKVTTAYLRGKMIQPFGCLLAIDEKNHMQTCKVIAYSENEPEMLTMVSHAVPSVGDHPALGIGTDIKTLFTAPSVSGLQKALGCADVSLLNPILVHCKTSGKPFYAIVHRVTGSLIVDFEPVKPYEVPMTAAGALQSYKLAAKAITRLQSLPSGNMERLCDTMVQEVFELTGYDRVMAYKFHEDDHGEVIREITKPCLEPYLGLHYPATDIPQASRFLFRKNKVRMIVDCHAKHVRVLQDEKLQFDLILCGSTLRAPHSCHAQYMANMDSIASLVLAVVVNDNEEDGDTDAVQPQKTERLWGLVVCHNTTPRFVPFPLRYAREFLPQVFADHVHKEIELEYQIIEKNILHHPGHLLCMLMRDAPLGIASESPNIMDLVKCDGAALIYRNKVWRLGVTPSEPQIREIALWLSEYHMDSTSFSTDSLFDAGFPSALSLGDVVCGMASVRVTAKDMVFWFRSHTAAEIRWGGAKHEAGEKDDSRRMHPRSSFKAFLEVVKARSLPWKEYEMDAIHSLQIILRNAFKEDTESLDLNAKAINTRLRDLKIEGINDLKIERMQELEAVTSEIVRLDYTATVPILAVDVDGLVNGWNIKIAELTGLPIGEATGKHLLTLVEDSSTDRVKKMLNLALLGEEEKNVQFEIKTLGSKMDSGPISLVVNRXCASRDLRDNVVGVCFVAHDITAQKNVMDKFIRIEGDYKAIVQNRNPLIPPIFGTDEFGWCCEWNPAMMKLTGWKREEVMDKMLLGEIFGTQMAACRLKNQEAFVNLGVVLNKAMTGSETEKVPFGFFARNGKYVECLLSVSKKLDVEGLVTGVFCFLQLASPELQQALHIQRLSEQTASKRLNALSYMKRQIRNPLCGIVFSRKMLEGTDLGTEQKQLLRTSAQCQQQLSKILDDSDLDTIIDGYLDLEMAEFTLHEVLVTSLSQVMEKSNGKSIRIVNDVAGHIMMETLYGDSLRLQQVLADFLLISINFTPNGGQVVVAGSLTKEQLGKSVHLVKLELSITHGGSGVPEVLLNQMFGNNGLESEEGISLLIRAKLLKLMNGDVRYLREAGKSAFILSAELAAAHNLKA

SEQ ID NO: 2452 - protein, 234 aa, Aristolochia burelae
IPQASRFLFMKNKVRMICDCYAKPVRVYQDEKLSFDLTLCGSTLRAPHSCHLQYMKNMSSIASLVMAVVVNEGEEDDNPDINQQRQQVPRRKRLWGLVVCHNTTPRFVPFPLRYACEFLMQVFAIHVNNELELENQIREKNILRTQTLLCDMLLRDSPLSIVTRSPNIMDLVKCDGAALMYQNKVYTLGLAPTESQIREINQWLSEYHMDSTGLSTDSLHDAGYPKALSLGDIV

SEQ ID NO: 2453 - protein, 401 aa, Xanthomonas campestris
MLSDSIIDVLTSGIAGLGVWGMLAVLLVFTQLTIFAVTLYLHRSQAHRGVDFHPVIAHFFRFWTWLTTSMITREWVAIHRKHHAKVETEEDPHSPQTKGIGQVFWRGVELYREARAQRADIEQYGKGAPNDWIERHLYTPHANAGPIALLVVNSVLFGLPGIALWAIQMAWIPFWAAGVVNGLGHWWGYRNFESADTSTNLTPWALWIGGEELHNNHHAFPSSARFSMRRWELDIGWIAIRCLQALGLAKVLRVAPSLDIRPNIAVPDADTLKALLSHRFQAMTDYQRNVLKPALREEAAATGAKLRQLLPRRLRKGLVDDGRWLKPDAREQLQHWVAQRPRMRTLVEYRARLTAVLEARSHDASERLKQLQQWCHEAEASGNAALQAYAARLKGYALSGT

SEQ ID NO: 2454 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFVDMLDGIFSFVLLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLVAAVTARYLAGTNAAKQWGTKLHSFCVGLEGAPDLKAAKEVADYIGTVHHEFHYTVQDGIDAIEDVIYHIETYDVTTIRASIPMFLMSRKIKSLGVKWVISGEGSDEIFGGYLYFHKAPNKEEFHQETCRKIKALHKYDCLRANKSTFAWGLEARVPFLDKDFIRVAMNIDPEYKMIKKEEGRIEKWALRRAFDDEEHPYLPKHILYRQKEQFSDGVGYGWIDGLKAHAEKHVTDRMMLNAANIFPFNTPTTKEAYHYRMIFERFFPQNSARLSVPGGPSVACSTAKAVEWDAAWSNNLDPSGRAALGVHASAYGNQVKAVEPEKIIPKMEVSPLGVAI

SEQ ID NO: 2455 - protein, 321 aa, Candida boidinii
MSSPLLTLNNGLKMPQIGFGCWKVDNATCAETIYEAIKVGYRLFDGAMDYGNEKEVGEGVNKAIKDGLVKREELFIVSKLWNNFHHPDSVKLAIKKVLSDLNLEYIDLFYMHFPIAQKFVPIEKKYPPNFYCGDGNKWSFEDVPLLTTWRAMEELVEEGLVKSIGISNFVGALIQDLLRGCKIRPAVLEIEHHPYLVQPRLIEYAKTEGIHVTAYSSFGPQSFVELDHPKVKDCTTLFKHETITSIASAHDVPPAKVLLTWATQRGLAVIPKSNKKERLLGNLKINDFDLTEAELEKIEALDIGLRFNDPWTWGYNIPTFI

SEQ ID NO: 2456 - protein, 462 aa, Glycine max
MFCNFHIILLIALALLVQISSQLGSKVEVLPGFEGPLPFELETGYVGLGEKDDDMQVFYYFVKSENDPQKDPLMLWLTGGPGCSSFSGLAFQIGPLRFKIEEYDGSVPNLILRPQSWTKVCNIIFVDLPFGTGFSYAKNLTAQRSDWKLVHHTHQFLRKWLIDHPEFLSNEFYMGADSYSGIPAPAIVQEISNGNEKGLQPRINLQGYLLGNPITTRNEGNDQIPFAHGMGLISDELYASLQRNCKGEYENRDSRNVLCLRDLKHYDECLSGINTFYILDRYCKSDSPKKHEAQWRRSLTQKFEASLNSHLRVPDIRCQIFGFFLATQWANDESVRKSLHIREGTIGKWERCYTTDFEEQIFSSFEFHVNLSAKGYRSLIYSGDHDAVVPFMSTQAWIRALNYSIVEDWRPWLLEDQVAGYTRIYSNQMTFATVKGSGHTAPEYKPEEGFAMFSRWIANMPL

SEQ ID NO: 2457 - protein, 487 aa, Escherichia coli
MLPLRINPTFLLPSNKFKEFEMDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 2458 - protein, 673 aa, Photorhabdus luminescens
MSHYPHLFAPLDLGFTTLKNRILMGSMHTGLEEHPDRAQRLARFYAERAAGGVALIVTGGISPNKQGVIGKGTAFLVDEKDLIHHKVITDAVHQAGGKIAMQILHTGRYSYQPHLVAPTAIQAPINPFMPREMTEEDIQQTIADFAHCAQLAQLAGYDGVEIMGSEGYLINQFLTTRTNHRQDKWGGSFENRMRFAVEVVKAVHQATGREFILIYRLSMLDLVEEGSNWQEIEQLAVAIEQAGASIINTGIGWHEARIPTIATMVPRAGFSWVTQKLMGKVSIPLITTNRINDPNIAEQVLAQGCADMVSMARPFLADAEFVMKAQQGRADEINTCIGCNQACLDQIFVGEIASCLVNPRACHETEMTAEPTTTPKKLAVVGAGPAGLSFAVTAASRGHHVTLFERDGQIGGQFNIAKQIPGKEEFHETLRYFQRQLTIHHVDVRLNQTATPEALSDFDEVIIASGIVPRQLTIDGIHHEKVLSYLDVLRDKKNVGQRVAIIGAGGIGFDTAEYLSQPGKSTSLDSTTFSEKWGIDHNLTHRGGLSPEGPKPKPSPRKIYLLQRKPTKVGEGLGKTTGWVHRTNLHLRGVKMLNNMQYLKIDDQGLHISSNGEQRCLAVDNIVICAGQEPLRELYQPLQQAGKTVHLIGGADVATELDARRAIDQGTRLGLKI

SEQ ID NO: 2459 - protein, 170 aa, Zea mays
MDGRMFGLETPLMVALQHLLDVPDGDAGAGGDKASGAAAGGGPTRTYVRDARAMAATPADVKELPGAYAFVVDMPGLGTGDIKVQVEDLYLCGMWRGIIVVCSGGASGVRVCVPSVSVSVYQFLSDVSASVSYEPCRMLSVCSKKKKKKKKKKKKKKKKKKKKKKKKKKK

SEQ ID NO: 2460 - protein, 217 aa, Arabidopsis thaliana
MAQQSLFYSFIARGTVILVEFTDFKGNFTSVAAQYLENLPSSNNKFTYNCDGHTFNDLVENGFTYCVVAVDSAGREIPMAFLERVKEDFYKRYGGEKAATDQANSLNKEFGSNLKEHMQYCMDHPDEISNLAKAKAQVSEVKSLMMENIEKVLARGVICEMLGSSESQPQAFYIKRTQMKRKKWFQNMKIKLIVLAIIIALILIIILSVCGGFNCGK

SEQ ID NO: 2461 - protein, 104 aa, Magnetospirillum magnetotacticum
MVETDNAIEVSIELPGMEMKDIEVTVNDDMLTVKGEKKIERQVEKKGYYLSERSYGAIYRTIPLPPGVDGEKAQASFKNGVLTIKLPQTPEAQAKIKRIDVKNG

SEQ ID NO: 2462 - protein, 678 aa, Pseudomonas putida
MKNDPLLQPYRLKHLTLRNRIITTSHEPAYPEDGMPKKLYRAYHVERAKAGVAMTMTAGSAAISRDSPPVFNNILAYKDEVVGWMKDLTDECHEHGAAVMIQLTHLGRRTRWDKGDWLPVVSPSHNQEPAHRAFPKQLEQWDIDRIIRDYADAAERMKAAGLDGIELQAYGHLMDQFWSPLTNELEGPYGGSLQNRLRFTFDVLTAIRKRVGPEFIVGIRYTGDEVLAGGLQKEEGLQISQLLKDSGMIDFLNVIRGNIATDAGLTDIIPIQGMRNAPHLDFAGEIKTLTGFPTFHAAKIPDVATARHAIASGLVDMVGMTRAHMTDPHIVRKIIEGREDDIRPCVGANYCLDRIYNAGAAYCIHNAATGRETTMPHEIPKAVQKRKVVIIGAGPGGLEAARVAGERGHEVVVYELADKPGGQIRLTAQSERRKEMISIIDWRMAQCERLGVRFHFNTWADTAIVLDENADVVIVATGGMPHTEVLEHGNQFLVSSWDIISGDVKPGRNVLVYDDAGDHAGLQAAEFIARSGAKTEIMTPDRSFAPEVMGMNLVPYMRALQHLDTTFTVTYRLKAVEKQGDQLLATIGTDYSDLTKTRLVDQVVVNHGTRPLDELYFDLKPLASNEGALEYMDLIVGKPQTVVSNPEGRFQLFRIGDAVASRNTHAAIYDALRLVKDL

SEQ ID NO: 2463 - protein, 150 aa, Alkalilimnicola ehrlichei
MAIMRYDPWSTLRQIQTDLDRMFGQRGMITAGEGENAESAGQWLPAVDISEDDKAYHIHADLPGVAPEDIEISMDQGVLSIKGSRESESTESEEGWKRVERARGTFYRRFALPESVDADNIAARSRNGVLEITVPKKVAPPAQRIEVKSE

SEQ ID NO: 2464 - protein, 122 aa, Spirulina platensis
HDRNKGFWWSHMGWMLREIPADADVPRFTKDINEDPVYLFLQNYFIPIQVALGVVLYLLGGWPLVVWGIFFRIVVVFHCTWFVNSATHKFGYRTYQSNDNSKNCWWVALVTYGEGWHNNHHA

SEQ ID NO: 2465 - protein, 175 aa, Xylella fastidiosa
MHPKNFQHQLKTIPQPPEETRDFVFNHTMLRVKDINASLDFYARILGFRLIDQRDFHEAQFSLYFLALLPQTVHISDNDTERRLWMSGIPGVLELTHNYGTETQEGQIYHNGNSEPRGFGHICISVPDLYSACARFDTLQVPYQKRLTDGRMKNIAFIKDPDGYWVEIISNTPLP

SEQ ID NO: 2466 - protein, 235 aa, Aristolochia clematitis
IPQASRFLFMKNKVRMICDCYAKPVKVYQDEKLPFDLTLCGSTLRAPHSCHVQYMKNMSSVASLVMAVVVNEGEEDDNPDPNQQQQQQQPKRKRLWGLVVCHNTTPRFVPFPLRYACEFLMQVFAIHVNNELELENQIREKNILRTQTLLCDMLLRDSPLSIVTRSPNIMDLVKCDGAALMYQNKVYTLGLAPTESQIRDVNRWLLEYHMDSTGLSTDSLHDAGYPKALSLGDIV

SEQ ID NO: 2467 - protein, 135 aa, Zea mays
MRKHRIVSLVAALLVLLALAAVSSTRSAQKESVADNAGMLAGGIKDVPANENDLQLRELARFAVNEHNQKANALLGLEKLVKAKTQVVAGTMYYLTIEVKDGVVKKLYEAKVWEKPWENFKQLQEFKPVEEGASA

SEQ ID NO: 2468 - protein, 257 aa, Crocosphaera watsonii
MEIKRLPALSDNYIFLLHDPHNNTAAVVDPAEAKPVLKCLDELGAKLVAILNTHHHADHVGANKKLMKKFPDVCIYGGKEDQGRIPGQQVFLEEGDTVKFAEKMAKVYFVPGHTRGHIAYYFPPHDSEGKGDLFCGDTIFAGGCGRLFEGTPAQMVNSLTKLRNLPDNTRVWCAHEYTLSNLKFAVTVEQDNNELQNRYQAIIKARKNQQATVPSLLGEEKKTNPFLRWDQPALQSLTGMNDPARVFGQIRGMKDNF

SEQ ID NO: 2469 - protein, 532 aa, Pseudomonas aeruginosa
MLVGVNVLADAVKATLGPKGRNVVLDKSFGAPTITKDGVSVAKEIELKDKFENMGAQLVKDVASKANDAAGDGTTTATVLAQAIVNEGLKAVAAGMNPMDLKRGIDKATVAIVAQLKELAKPCADTKAIAQVGTISANSDESIGQIIAEAMEKVGKEGVITVEEGSGLENELSVVEGMQFDRGYLSPYFVNKPDTMAAELDSPLLLLVDKKISNIREMLPVLEAVAKAGRPLLIVAEDVEGEALATLVVNNMRGIVKVAAVKAPGFGDRRKAMLQDIAILTGGTVISEEVGLSLEGATLEHLGNAKRVVINKENTTIIDGAGVQADIEARVLQIRKQIEETTSDYDREKLQERLAKLAGGVAVIKVGAATEVEMKEKKARVEDALHATRAAVEEGVVPGGGVALVRALQAIEGLKGDNEEQNVGIALLRRAVESPLRQIVANAGDEPSVVVDKVKQGSGNYGFNAATGVYGDMIEMGILDPAKVTRSALQAAASIGGLMITTEAMVAEIVEDKPAMGGMPDMGGMGGMGGMM

SEQ ID NO: 2470 - protein, 160 aa, Unknown
  Malus x domestica
MSLIPNSRRGSSSVFDPFSLNLWDPFKDFPFPSSSSLSAFPEFSRENSAFVNTRVDWKETPEAHVFKADVPGLKKEEVKVEVEDDRVLKISGERNVEEEDKNDKWYRVERSSGKFLRRFQLPENAKVDQIKAAMENGVLSVTVPKAELKNVDVRAIEISG

SEQ ID NO: 2471 - protein, 139 aa, Debaryomyces hansenii
MIWLSERQKFGVGFTAGGIFFFLFGIMAFFDSAFLALGNILFVIGLILIIGPQRTVTFFTRPTKMRGTLCFCTGILLILAKRSFIGFIIECFGILGLFGDFFGTIVQFLRSIPYIGDLLSHPMIAPTIDRLAGINTLPV

SEQ ID NO: 2472 - protein, 233 aa, Aristolochia eriantha
IPQAARFLFMKNKVRMICDCYAKPVKVFQDEKLSFDLTLCGSTLRAPHSCHLQYMKNMSSVASLVMAVVVNEGEEDDNPDPNQQQQVPKRKRLWGLVVCHNTTPRFVPFPLRYACEFLMQVFAIHVNNELELESQIREKNILRTQTLLCDMLLRDSPLSIVTRSPNIMDLVKCDGAALMYQNKVYTLGLAPTESQIRDINRWLLEYHMDSTGLSTDSLHDAGYPSVLSLGDIV

SEQ ID NO: 2473 - protein, 532 aa, Thiobacillus denitrificans
MVAGVNVLADAVKVTLGPKGRNVVLDRSFGAPTVTKDGVSVAKEIELKDKLENMGAQMVKEVASKTSDVAGDGTTTATVLAQSIVNEGMKFVAAGMNPMDLKRGIDKAVNAITEELKKISKPCTTSKEIAQVGSISANSDAPIGQIIADAMDKVGKEGVITVEDGSGLENELDVVEGMQFDRGYLSPYFINNADKQMAIMDDPFILLFDKKISNIRDLLPVLEQVAKAGKPLMIVAEDVDGEALATLVVNNIRGILKTCAVKAPGFGDRRKAMLEDMAILTGGTVIAEEVGLSLEKATLQDLGRAKRIEVGKENTTIIDGAGDGNAIKGRIAQINKQIEEVTSDYDKEKLQERKAKLAGGVAVIKVGAATEVEMKEKKARVEDALHATRAAVEEGIVPGGGVALLRAKAAAAAIKGDNHDQDAGVKIVLRAIEEPLRQIVKNCGDEPSVVVNKVLEGEGNFGYNAGTSEYGDMVAMGVLDPTKVTRTALQNAASIAGLMLTTDCMVADLPEDKAPAMPMGGGMGDMGGMGMM

SEQ ID NO: 2474 - protein, 1323 aa, Arabidopsis thaliana
MEVCNCIEPQWPADELLMKYQYISDFFIAIAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALSGNTDKSTKEKCMSFGLDGDGCPMPQRSNSAPAFFSRKTSEADVLWFNCVHIRDCRSVLDDILKQKGNNKIETLNRYVSVAISVIEEQDGGALRRLVEQQQWRYLVSQSTRSPKLIHGFFSFSSKTNPNPNKQQQILIDYISKSLQSNDTWETLSTKFSSIDLSDSLIETILLRFKNPETAKQALSFFHWSSHTRNLRHGIKSYALTIHILVKARLLIDARALIESSLLNSPPDSDLVDSLLDTYEISSSTPLVFDLLVQCYAKIRYLELGFDVFKRLCDCGFTLSVITLNTLIHYSSKSKIDDLVWRIYECAIDKRIYPNEITIRIMIQVLCKEGRLKEVVDLLDRICGKRCLPSVIVNTSLVFRVLEEMRIEESMSLLKRLLMKNMVVDTIGYSIVVYAKAKEGDLVSARKVFDEMLQRGFSANSFVYTVFVRVCCEKGDVKEAERLLSEMEESGVSPYDETFNCLIGGFARFGWEEKGLEYCEVMVTRGLMPSCSAFNEMVKSVSKIENVNRANEILTKSIDKGFVPDEHTYSHLIRGFIEGNDIDQALKLFYEMEYRKMSPGFEVFRSLIVGLCTCGKVEAGEKYLKIMKKRLIEPNADIYDALIKAFQKIGDKTNADRVYNEMISVR

SEQ ID NO: 2475 - protein, 555 aa, Catharanthus roseus
MGSKDDQSLVVAISPAAEPNGNHSVPIPFAYPSIPIQPRKHNKPIVHRRDFPSDFILGAGGSAYQCEGAYNEGNRGPSIWDTFTNRYPAKIADGSNGNQAINSYNLYKEDIKIMKQTGLESYRFSISWSRVLPGGNLSGGVNKDGVKFYHDFIDELLANGIKPFATLFHWDLPQALEDEYGGFLSDRIVEDFTEYAEFCFWEFGDKVKFWTTFNEPHTYVASGYATGEFAPGRGGADGKGEPGKEPYIATHNLLLSHKAAVEVYRKNFQKCQGGEIGIVLNSMWMEPLNETKEDIDARERGLDFMLGWFIEPLTTGEYPKSMRALVGSRLPEFSTEVSEKLTGCYDFIGMNYYTTTYVSNADKIPDTPGYETDARINKNIFVKKVDGKEVRIGEPCYGGWQHVVPSGLYNLLVYTKEKYHVPVIYVSECGVVEENRTNILLTEGKTNILLTEARHDKLRVDFLQSHLASVRDAIDDGVNVKGFFVWSFFDNFEWNLGYICRYGIIHVDYKTFQRYPKDSAIWYKNFISEGFVTNTAKKRFREEDKLVELVKKQKY

SEQ ID NO: 2476 - protein, 441 aa, Capsicum annuum
KEKDCDTHDLPLKARKFESFFTQLYSVTLASSGELICKDFFLYMESNQFGLFATSTAQIHDVPPTGGATQGVPSVEKITFHLLRLEDGAILGERVFHNDYVNLAHSIGAFLYDDLLAIVSLRYQRIHILQIRDSGDIVDVRAIGEFCREDDELFLNSNSQVLVDHVGNGFHHSLPESETFFLSGIKQRLLSFIFRGIWNEETDQTMRVQCLKKKFYFHFQDYIDLIIWKVQFLDRHHLLIKFGSVDGAVSRNTDSHPSFLAVYNMETTEIVAFYQNSADELYFLFELFSDHFHVSSKSSLHMNLMSSHSNNIHAFEQLRCTKNKAISFSQFVKKMMASLPFSCQSQSPSPYFDQSLFRFDEKLISAIDRHRQSTDHPIKFISRRQPNILKFKMKPGPEAGSMDGRTKKICYFLFHPILPLALSVQQTLFLQASVVNIHFRQ

SEQ ID NO: 2477 - protein, 484 aa, Hypocrea jecorina
  misc_feature (171)..(171): Xaa can be any naturally occurring amino acid
MPESLALPNDFEWGFATAAYQIEGAVKEGGRGPSIWDTYCHLEPSRTNGANGDVACDHYHRYDEDFDLLTKYGAKAYRFSLSWSRIIPLGGRLDPVNEEGIEFYSKLIDALLRRGITPWVTLYHWDLPQALHDRYGGWLNVEEVQLDFERYARLCFERFGDRVQNWITINXPWIQAIYGYATGSNAPGRSSINKHSTEGNTATEPWLAGKAQIMSHARAVAVYSRDFRPSQKGQIGISLNGDYYEPWDSNEPRDKEAAERRMEFHIGWFANPIFLKKDYPESMKKQLGERLPALTPADFAILNAGETDFYGMNYYTSQFARHLDGPVPETDYLGAIHEHQENKDGSPVGEESGLAWLRSCPDMFRKHLARVYGLYGKPIYITENGCPCPGEENMTCEEAVNDPFRIRYFDSHLDSISKAITQDGVVVKGYFAWALLDNLEWSDGYGPRFGVTFTDYTTLKRTPKKSALVLKDMFAARQRVKVAA

SEQ ID NO: 2478 - protein, 728 aa, Escherichia coli
MSDRIDRDVINALIAGHFADPFSVLGMHKTTAGLEVRALLPDATDVWVIEPKTGRKLAKLECLDSRGFFSGVIPRRKNFFRYQLAVVWHGQQNLIDDPYRFGPLIQEMDAWLLSEGTHLRPYETLGAHADTMDGVTGTRFSVWAPNARRVSVVGQFNYWDGRRHPMRLRKESGIWELFIPGAHNGQLYKYEMIDANGNLRLKSDPYAFEAQMRPETASLICGLPEKVVQTEERKKANQFDAPISIYEVHLGSWRRHTDNNFWLSYRELADQLVPYAKWMGFTHLELLPLNEHPFDGSWGYQPTGLYAPTRRFGTRDDFRYFIDAAHAAGLNVILDWVPGHFPTDDFALAEFDGTNLYEHSDPREGYHQDWNTLIYNYGRREVSNFLVGNALYWIERFGIDALRVDAVASMIYRDYSRKEGEWIPNEFGGRENLEAIEFLRNTNRILGEQVSGAVTMAEESTDFPGVSRPQDMGGLGFWYKWNLGWMHDTLDYMKLDPIYRQYHHDKLTFGMLYNYTENFVLPLSHDEVVHGKKSILDRMPGDAWQKFANLRAYYGWMWAFPGKKLLFMGNEFAQGREWNHDASLDWHLLEGGDNWHHGVQRLVRDLNLTYRHHKAMHELDFDPYGFEWLVVDDKERSVLIFVRRDKEGNEIIVASNFTPVPRHDYRFGINQPGKWREILNTDSMHYHGSNAGNGGTVHSDEIASHGRQHSLSLTLPPLATIWLVREAE

SEQ ID NO: 2479 - protein, 711 aa, Pseudomonas putida
MPSKKTDAPKQSEAAGTQTPDRANTNAKLQSLETFRSDATGQALRTNQGVKIADNQNSLKAGARGPSLLEDFIMREKITHFDHERIPERIVHARGTGAHGYFQSYGNHADLTKAGFLQDPDKITPVFVRFSTVQGPRGSGDTVRDVRGFAVKFYTDEGNFDLVGNNMPVFFIQDAIKFPDFVHAVKPEPHNEIPTGGSAHDTFWDFVSLVPESAHMVMWAMSDRAIPRSLRMMEGFGVHTFRLINAEGVASFVKFHWKPRQGVHSLLWDEAQKLAGKDTDFQRRDLWEAIENGDYPEWELGVQIVPEADEHKFDFDLLDPTKIIPEELVPVTPLGKMVLNRNPDNFFAEVEQVAFCPGHIVPGIDFTNDPLLQGRLFSYTDTQISRLGGPNFHQIPINRPVAPNHNNQRDALHQHVVHKGRASYEPNSIDGGWPKETPAAAQDGGFESYQERIDAHKIRQRSESFGDHFSQARLFFQSMSPTEQQHIIKAYSFELGKVEREHIRAREVNEILANIDLKLAAAVAANLGLPAPKAGTVQVKGSQLAQSPALSQMNHPGSVGIKGRKIAVLVANGVDAASVDKLIKALEAHSARPMLLGPTSAPVKATDGKQLPVEASMEGMPSIMFDGIVVPSGKASTDALAASGLAKHFLLEGYKHLKAMVLTKELATGLGLKEDKGLLLADDQKAVDAFVKAVEGHRVWEREAAAEAVPA

SEQ ID NO: 2480 - protein, 691 aa, Candida glabrata
MTELIDIPFLLTKDCSADLEDRLRFCIETGSLYQTHESFKKDIGEIVNTRQALVNLKFGDSKLLTKYYGYLECLLKKIDPEALAFSWSYTNYTIFEGNVFRDENLLGERRNILFNLGIAYYQSAKHIDDYKNNLPLVCDYLKRSAGCFEILSQRTKERNSEKAIISETMLKALKSMCMGLAQETVWFKSLAAKKDLLTSKLAYKCFEYFQESLNSFQLVGQSTEYIKLILVFVESKMLYFKAVCVYRLAQSIESIADNVGVVIRCLSIAVAALTNSKLESTVVFKNKCLEMLRQLEKDNDFIYLKHVPSHLQFSDFVKLYKLDSMKDLIVLPDLTEIAPSMLDQILFRNLLPIEIMDYGTSYNEKQDIYVLQHFVEPINLLNIQLDEELASFFEIDPQHIVNAHNKTKSFVTRKELDVIGQSFGDLESNAINIETQLANITSYLDLEIKTYEEDKQQYGDVWTIVDARDVTKEFYEKVEKLRQYLEIGRNINLETQELFASIDKSLVTSRTSKAHLTAQYNDPFLNKIEALKKRRERFISEIEKKSYENRIISKLIMYYKETDDIPGTISEREEIFDNIYSKHMKVFAVDMKYIEDCKNENYGLIKEIEEYKSRTNFNNEDRSSDPRTQYIQDVRQSLASLDDVKTQLKKGTAYYQQLIEKVNELVQVIVGFLEARRNDRERLLNEISTAA

SEQ ID NO: 2481 - protein, 139 aa, Oryza sativa
LYPEAVAIGEDVSGMPTFCIPVQDGGVGFDYRLHMAVPDKWIGLLKQSDEYWKMGDIVHTLTNRRWSEKCVTYAESHDQALVGDKTIAFWLMDKDMYDFMALDRPSTPRIDRGIALHKMIRLVTMGLGGEGYLNFMGNE

SEQ ID NO: 2482 - protein, 53 aa, Unknown
  Synechocystis sp. IPPAS 284
FVRLVLVWHCTWFVNSASHIFGYSTYKSQHNSKNCWWVALVTFGEGWHNNHHA

SEQ ID NO: 2483 - protein, 1119 aa, Cuscuta pentagona
MSSSRPSQSSSNSARSKHSARIIAQTSIDAKLHAEFEESGDSFDYSSSIRVTSVNTGEQKPRSDKVTTAYLHQIQKAKFIQPFGCLLALDEKTFRVIAFSENAPDMLTMVSHAVPSVGDLPVLGIGTDIRTIFTAPSGAALQKALGFGEVSLLNPILVHCKTSGKPFYAIVHRVTGSLIVDFEPVKPYEAPMTAAGALQSYKLAAKAIARLQSLPSGSLERFCDTIVQEVFELTGYDRVMAYKFHDDDHGEVVSEITKPGLEPYLGLHYPATDIPQAARFLFMKNKVRMICDCQAKHVKVVQDEKLLFDLTLCGSTLRAPHTCHLQYMENMNSIASLVMAIVVNDGDDEEEEERSGSGKRKRLWGLVVCHNTTPRFVPFPLRYACEFLAQVFAIHVNKELELENQIVEKNILRTQTLLCDILLRDAVLGIVSQSQSPNMMDLVKCDGAVLLYKSKIHRLGITPTDFQLQDIVYRLNEHHMDSTGLSTDSLYDAGFPGALSLGLCGMASVRISEKDWLFWFRSHTASEVRWGGVKHEPDDGRKMHPRSSFKAFLEVVETRSLPWKDYEMDGIHSLQLIMRNAFFNEADTVATNVIHAKLNDLRIDGLQELEAVTSEMVRLIETAMVPIIAVGVDGLVNGWNTKIAELTGLSVDEAIGNHLLTLVEDSSVHTVKKMLNLALQGEEEKNVQFEIMTHGIRSECGPISLVVNACASRDVQESVVGVCFIAQDITGQKTVMDKFTRIEGDYRAIIQNPNPLIPPIFGTDEFGWCSEWNSAMTKLSGWRRDEVIDKMVLGEVFGTQKACCRLKSHEAFVTLGVVLNNAITGHESDKTVFGFCTRNGKYVECLLSVTKRLNQDGAVIGLFCFLQLASQELQQALHFQKLSEQTATKRLKVLAYLRKQVKNPLSGIMFSRKMLEGTELGNDQQNILHTSAQCQQQLSKVLDDTDLDCIIEGYLDLEMVEFKLDEVLLASISQVMTKSNGKSLRVINDVAENVLCETLYGDSLRLQQVLAEFLSVAVNFTPSGGQLAVSSSLTKDHLGQSVQLAHLEFRVTHSGGGVPEELLTQMFGSDVDALEEGISLLVSRNLVKLMNGDVQYHREAGRSAFIISVELAVATKPRA

SEQ ID NO: 2484 - protein, 145 aa, Novosphingobium aromaticivorans
MTKFLHTMIRVTDPDATIAFFELIGLKETRRFDSEKGRFTLIFLAAPGEEGIAEVELTYNWPPEDGSPAEGYSGGRNFGHLAYRVDNIYDTCRRIMDAGHIVHRPPRDGHMAFVKTPDGISIELLQDGHLPPQEPWASMENTGTW

SEQ ID NO: 2485 - protein, 207 aa, Arabidopsis thaliana
PRVREDVTSRDSPLSSRFFFFPLILSPSAFHFFANGHTSFIWPIFQNRCVYMIANLFHAPVGQDEAVIGCGIVASSESAGLAFKMKWQHRRKAQGLPIDKPNIVTGVNVQVCWEKFARYFEVELKEVKLSEDYYVMDPAKAVEMVDENSICVAAILGSTFTGEFEYLKLLNDLLAEKNAKTAWETPIHVDAASGGFIASMGEEYQCQ

SEQ ID NO: 2486 - protein, 151 aa, Agrobacterium tumefaciens
MERNKMRYLHTMVRVKDLGESLKFYVDLLGLTEIRRIENEKGRFTLVFLSARDDIAAAKENKAPCLELTYNWDTEDYTGGRNFGHLAYEVDNIYDFCARLQQSGIVINRPPRDGHMAFVRSPDGISFEILQKGESLAPAEPWISMQNTGSW

SEQ ID NO: 2487 - protein, 512 aa, Arabidopsis thaliana
MDHSSNRFGNNGVESILPNYKLGKTLGIGSFGKVKIAEHVVTGHKVAIKILNRRKIKNMEMEEKVRREIKILRLFMHPHIIRQYEVIETTSDIYVVMEYVKSGELFDYIVEKGRLQEDEARNFFQQIISGVEYCHRNMVVHRDLKPENLLLDSRCNIKIADFGLSNVMRDGHFLKTSCGSPNYAAPEVISGKLYAGPEVDVWSCGVILYALLCGTLPFDDENIPNLFKKIKGGIYTLPSHLSSEARDLIPRMLIVDPVKRITIPEIRQHRWFQTHLPRYLAVSPPDTVEQAKKINEEIVQEVVNMGFDRNQVLESLRNRTQNDATVTYYLLLDNRFRVPSGYLESEFQETTDSGSNPMRTPEAGASPVGHWIPAHVDHYGLGARSQVPVDRKWALGLQSHAHPREIMNEVLKALQELNVCWKKIGHYNMKCRWVPGLADGQNTMVNNQLHFRDESSIIEDDCAMTSPTVIKFELQLYKAREEKYLLDIQRVNGPQFLFLDLCAAFLTELRVI

SEQ ID NO: 2488 - protein, 184 aa, Arabidopsis thaliana
MRRFLINQAKGLVDHSRRQHHHKSPSFLSPQPRPLASSPPALSRFFSSTSEMSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIA

SEQ ID NO: 2489 - protein, 233 aa, Aristolochia gigantea
IPQAARFLFMKNKVRMICDCYAKPVKVFQDEKLSFDLTLCGSTLRAPHSCHLQYMKNMSSVASLVMAVVVNEGEEDDNPDPNQQQQVPKRKRLWGLVVCHNTTPRFVPFPLRYACEFLMQVFAIHVNNELELESQIREKNILKTQTLLCDMLLRDSPLSIVTRSPNIMDLVKCDGAALMYQNKVYTLGLAPTESQIREINRWLLEYHMDSTGLSTDSLHDAGYPSVLSLGDIV

SEQ ID NO: 2490 - protein, 75 aa, Glycine max
  misc_feature (37)..(37): Xaa can be any naturally occurring amino acid
  misc_feature (57)..(57): Xaa can be any naturally occurring amino acid
IYRIESYDVTSIPACIPMYLMSRLIKSLAFNWLISIXGSDKIFGRCVCFLNAPLKEXFHQETCRMIKALHKYDCL

SEQ ID NO: 2491 - protein, 238 aa, Aristolochia grandiflora
IPQASRFLFMKNRVRMICDCYAKPVKVYQDEKLSFDLTLCGSTLRAPHSCHSHYMKNMSSIASLVMAVVVNEGEEDDNPNSNQQQQPQQQQVPKRKRLWGLVVCHHTTPRFVPFPLRYACEFLMQVFAIHVNNEVELENQIREKNILRTQTLLCDMLLRDSPLSIVTRSPNIMDLVKCDGAALMYLGKVYTLGLAPTESQIREINRWLLEYHMDSTGLSTDSLQDAGYPGALSLGDVV

SEQ ID NO: 2492 - protein, 151 aa, Oryza sativa
MRASSLFAESVFTTSAAAGRRRCPRLAAVPVTLFFSTGRGSPAMAEEAQQPRGVKVGGIHDAPAGRENDLTTVELARFAVAEHNSKANAMLELERVVKVRQQVVGGFMHYLTVEVKEPGGANKLYEAKVWERAWENFKQLQDFKPLDDATA

SEQ ID NO: 2493 - protein, 232 aa, Aristolochia kaempferi
IPQASRFLFMKNKVRMICDCYAKPVKVYQDERLSFDLTLCGSTLRASHSCHLQYMKNMGSVASLVLAVVVKEGEEDDNPDPNQEPQSKRKRLWGLVVCHNTTPRFVPFPLRYACEFLMQVFAIHVNNEVELENQIREKNILRTQTLLCDMLLRDSSLSIVTRSPNIMDLVKCDGAAFLCRNKVYTLGVTPTESQIREINQWLSEYHMDSTGLSTDSLHDAGYPNALSLGDIV

SEQ ID NO: 2494 - protein, 480 aa, Dechloromonas aromatica
MGQLEMSKTKTISLTVGAFVAGALISLNFPALADKEAKPGLPIEELRTFAEVYSAIKQGYVEPVEDKKMITNAISGMLSNLDPHSAYLDADAFKDLQVGTQGEFGGLGIEVGMEDGLVKVVSPIEDTPAYRAGVKSGDLIFKLDDTMVKGLTLSEAVKKMRGKPKTPIKLSIIRKGETKPIELTLIREVIKVQSVKSKLIEPGYGWVRITQFQENTIAELAKHVAGLYKDGNKLQGLVLDLRNDPGGLLHGAIGVSAAFLPPDVKVVSTDGRTEDAKQEFRARTQDYQRGTKEDSLKGMPIEAKNVPMVVLVNGGSASASEIVAGALQDHKRAVIVGTQTFGKGSVQSVLPLPGNTAIKLTTARYYTPSGRSIQAKGITPDIVVEESLNGNAAASMRLREADLDRHLSNDRDKEAGKELPKADTKPQAKTSPKSGKDKNGKEDAEDELPQRLEYASKSDYQFQQAINLLKGLQIMQNKAQ

SEQ ID NO: 2495 - protein, 229 aa, Aristolochia kaempferi
IPQAARFLFMKNKVRMICDCYAKPVKVYQDGRLSFDLTLCGSTLRAPHSCHMQYMKNMGSIASLVMAVVVNEGEEDNNPDTNQEQQAQPKRKRLWGLVVCHNTTPRFVPFPLRYACEFLMQVFAIHVNNELELENQIREKNILRTQTLLCDMLLRDSPLSIVSRSPNILDLVKCDGAALLYQNKVYTLGAAPTESQIHEINRWLSEYHMDSTGLSTDSLQDAGYPKALS

SEQ ID NO: 2496 - protein, 173 aa, Pseudomonas syringae
MSLHELNTLPGVTADPEAATRQFVFNHTMLRVKDITKSLDFYTRVLGFSLVEKRDFPEAEFSLYFLALVDKAQIPEDDKARNEWMKSIPGILELTHNHGTESDATASYHNGNSDPRGFGHICVSVPDVKVACERFETLGVDFQKRLSDGRMNSLAFIKDPDGYWVEIIQPTPL

SEQ ID NO: 2497 - protein, 233 aa, Aristolochia maxima
IPQAVRFLFVKNKVRMICDCYAKPVKVYQDEKLSFDLTLCGSTLRAPHSCHLQYMKNMSSVASLVMAVVVNEGEEDGNPDPNQQQQQPKRKRLWGLVVCHNTTPRFVPFPLRYACEFLMQVFAIHVNNELELENQIREKNILRTQTLLCDMLLRDSPLSIVTRSPNIMDLVKCDGAALMYQNKVYTLGLAPTESQIREINRWLLEYHMDSTGLSTDSLHDAGYAKALSLGDIV

SEQ ID NO: 2498 - protein, 496 aa, Brassica juncea
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAVRVGGTNHSHATQDLYDSIAAGNYPEWKLFIQVIDPADEDKFDFDPLDVTKTWPENLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCVIEKENNFKEPGERYRSFTPESFDFRQERFIRRWIEALSDPRITHEIRSIWISYWSQADKTLGQKLASRLNVRPSI

SEQ ID NO: 2499 - protein, 492 aa, Brassica juncea
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKAGKAHYVKFHWKPTCGVKSLLEEDAIRVGGTNHSHATQDLYDSIAAGNYPEWKLFVQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCIIEKENNFKEPGERYRSFTPERQERFIGRWIDALSDPRITHEIRSIWISYWSQADKSLGQKLASRLNVRPNI

SEQ ID NO: 2500 - protein, 237 aa, Mycobacterium avium
MSDDRLYFRQLLSGRDFAAGDMFATQMRNFAYLIGDRQTGDCVVVDPAYAASDLLDTLEADGMHLSGVLVTHHHPDHVGGSMMGFTLAGLAELLERAPVPVHVNSHEALWVSRVTGISASDLTAHENHDKVSAGDIEIELLHTPGHTPGSQCFLLDGRLVAGDTLFLEGCGRTDFPGGDSDEMYRSLQRLAKLPGDPTVFPGHWYSAEPSASLSEVKRSNYVYRASDLDQWRMLMGG

SEQ ID NO: 2501 - protein, 500 aa, Neisseria gonorrhoeae
MTTSKCPVTHLTMNNGAPVADNQNSLTAGTRGPLLTQDLWLNEKLADFVREVIPERRMHAKGSGAFGTFTVTRDITKYTRAKIFSEVGKKTEMFGRLATVAGERGADAYTRVRGFALKFYTEEGNWDVVGNNTPVFYPDLRKFPDLNKAVKRSAHQYSSATNNWDFWALLPEALHQVTIVMSDRGIPASYRHMHGFGSHTYSLWNEAGERFWVKFHFRSQQGIKNLTNEEAAKIIADDRESHQRDLYEAIERGEFPKWTMYIQVMPEADAAKVPYHPFDLTKVWPKKDYPLIEVAEFELNRNPENFFADVEQSAFAPSNLVPGIGASPDKMLQARLFNYADAQRYRLGVNFRQIPVNRPRCPVHSNQRDGQGRATELRQPAHYEPNSFGQWSQQPDFAEPPLKINGDAAHWDYRQDDDDYFSQPRALFNLMNDAQKQALFDNTAAAMGDAPDFIKYRHIRNCYRCDPAYGEGGSKALGLTVEEPQAARATDPALGQGGLL

SEQ ID NO: 2502 - protein, 492 aa, Brassica juncea
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAVRVGGTNHSHATQDLYDSIAAGNYPEWKLFIQVIDPADEDKFDFDPLDVTKTWPENLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCVIEKENNFKEPGERYRSFTPERQERFIRRWIEALSDPRITHEIRSIWISYWSQADKTLGQKLASRLNVRPSI

SEQ ID NO: 2503 - protein, 479 aa, Pseudomonas putida
MSKILTTASGAPVADNQNSRSAGPRGPLLLDDFHLIEKLAHFNRENIPERRVHAKGSGAYGTFTVTRDITGYTSAKLFEQVGKQTETFLRFSTVGGERGSADTERDPRGFAVKFYTEEGNWDIVGNNTPVFFIRDPLKFPDFIHTQKRHPQSNLKNAQIFWDSWSHSPEALHQVTILFSDRGIPDGYRHMHGFGSHTYSLINAQGERTWVKWHFKTQQGIKNLAPADAARLAGTDPDYAQRDLFEAIERGDYPRWTVCIQVMSEAEAASRDENPFDVTKTWSQKDYPLIEVGVLELNRNPLNYFAEVEQAAFGPSNMVPGVGLSPDRMLQGRVFAYADAHRYRVGTNHQQLPVNAPRCPVNSYQRDGSMATGSYGSAPNYEPNSYAAAPKQSPRHAEPALALNGSADRYDHREDADYYSHAGALFRLMSDEQKALLISNIAGTMAGVSENVIQRQLQYFFKADPAYGEGIAKGLGINLA

SEQ ID NO: 2504 - protein, 479 aa, Desulfovibrio vulgaris
MTKHKLTTNAGAPVPDNQNAMTAGPRGPMLLQDVWFLEKLAHFDREVIPERRMHAKGSGAYGTFTVTHDITSYTKAALFSKIGKKTDLFVRFSTVAGERGAATAERDIRGFAIKFYTEQGNWDLVGNNTPVFFLRDPLKFPDLNHAVKRDPRTNMRSAKNNWDFWTSLPEALHQVTVVMSDRGIPASYRHMHGFGSHTFSFISPDNQRYWVKFHLRTQQGIKNLTDAEAEAIVARDRESHQRDLYDSIERGDFPRWTMYVQVMPEKDAEKLPYHPFDLTKVWFHKDCPLIEVGVLELNRNPENYFAEVEQAAFNPANVVPGISFSPDKMLQGRLFSYGDAHRYRLGVNHHLIPVNAARCPVHSYHRDGAMRVDGNHGSTLAYEPNSYGEWQEQPDFAEPPLAIRGDAAHWNFREDADYYDQPGRLFRLMTPQQQDELFQNTARAMGDAPEEIKRRHVGNCAKADPAYGAGVARALGLKM

SEQ ID NO: 2505 - protein, 492 aa, Brassica juncea
MDPYKYRPASSYNSPFFTTNFGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAIRVGGTNHSHATQDLYDSIAAGNYPEWKLFVQIIDPADEDRFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAICSGKRERCIIEKENNFKEPGERYRSFTPERQERFIGRWIDALSDPRITHEIRSIWISYWSQADKSLGQKLANRLNVRPSI

SEQ ID NO: 2506 - protein, 249 aa, Buchnera aphidicola
MKIIFTKVLFDNYVWIMFNSSKDCIIIDPGESNSVIKKIKKLNLNPKIILLTHNHLDHIQGVKNLLYKYPEISIYGPLETQFCGTKNLIDNRNTIEILNTKFYIIPTPGHTNGHTAYYCPPFLFCGDSIFSGGCGRVKNGMMIKMYNSLRTISKLPNDTLIYCSHEYTRSNLEFFKKIFPKNLNILNYYNNIKKSKTQCTLPSTLKIEKKINPFLQLNNTNLRHQVKIHNDLSFSLNFFIYLRKIKDKS

SEQ ID NO: 2507 - protein, 586 aa, Zea mays
MCGILAVLGVVEVSLAKRSRIIELSRRLRHRGPDWSGLHCHEDCYLAHQRLAIIDPTSGDQPLYNEDKTVVVTVNGEIYNHEELKAKLKTHEFQTGSDCEVIAHLYEEYGEEFVDMLDGMFSFVLLDTRDKSFIAARDAIGICPLYMGWGLDGSVWFSSEMKALSDDCERFITFPPGHLYSSKTGGLRRWYNPPWFSETVPSTPYNALFLREMFEKAVIKRLMTDVPFGVLLSGGLDSSLVASVASRHLNETKVDRQWGNKLHTFCIGLKGSPDLKAAREVADYLSTVHHEFHFTVQEGIDALEEVIYHIETYDVTTIRASTPMFLMSRKIKSLGVKMVISGEGSDEIFGGYLYFHKAPNKKEFLEETCRKIKALHLYDCLRANKATSAWGVEARVPFLDKSFISVAMDIDPEWNMIKRDLGRIEKWVMRKAFDDDEHPYLPKHILYRQKEQFSDGVGYNWIDGLKSFTEQQVTDEMMNNAAQMFPYNTPVNKEAYYYRMIFERLFPQDSARETVPWGPSIACSTPAAIEWVEQWKASNDPSGRFISSHDSAATDHTAVSRRWPTAAARPANGTVNGKDVPVPIAV

SEQ ID NO: 2508 - protein, 127 aa, Ashbya gossypii
MCCGCTCSDCILYFLGFLIPPVAVLLRSGCFSLDLLLNTILTCLGVLPGIVHAFYYIHITSPLRHQYGDPVPVGTLDRFLYDRQRLDQAVAAQRLGGSGPMPEEQRPLTYSSNSKAQMAPPPYNEHA

SEQ ID NO: 2509 - protein, 492 aa, Prunus persica
MGSSSATSNRLLLSKIATSEGHGENPPYFDGWKAYDRNPFHPTKNPEGVIQMGLAENQLSFDLIEDWIKKNPKASICTPEGVEEFKNVAIFQDYHGFPEFRKAVAMFMSKARGGRVTFDPNRVVMSGGATGANELVMFCLADPGDAFLVPSPYYPAFYRDLGWRTGVQIVPVDCDSSNNFQITKEALAAAYEKAQKNNINVKGLIITNPSNPLGTTLDRDTLESLVEFINQKNIHLVCDEIYAATVFSSPTFTCISEVIQNMNCNPNLIHIVYSLSKDMGLPGLRVGIVYSYNDDVVNIGRKMSSFGLVSSQTQHMLASMLLDEEFVARFLETSSKRLAKRHGVFTKGLEEVGINCLKSNAGLFCWMDLRRLLKDQTFDGEMVLWRVIVNEVGLNVSPGSSFKCVEPGWFRVCFANMDDETVEVALKRIRTFVRQGKKAQDQAVQVKSPKRWKSNLRLSFSSSSTRRFDQDSVNVLSPHMMSPHSPLVRAKT

SEQ ID NO: 2510 - protein, 676 aa, Ralstonia eutropha
MCGFAGFLGGIPGSLEDRAILLTRMGQRILHRGPDHGDLWCEPGAPFGFTHRRLAIVDLSPAGRQPMISASGRYVIVFNGEIYNHPEIRAELESAGAAPRWRGHSDTETLLAGIDAWGADATVRRTIGMFAFAVWDRQTHSLTLARDRLGEKPLYYGWQGSGQARAFLFGSELKALRPHPAFDGSIDRNALTLYMRYNNVGGGHSIYQGIAKLPPAHLLTVSMLAREPVLRAYWSGSAAALQGKQDPFTGGPQEAVDSLDALLRDAVARQMMADVPLGAFLSGGIDSSTVVALMQSQSTQPIRTFSIGFHDAGYNEAAHAKAVARHLGTSHTELYVSPEHAMAVIPRLPEIYDEPFSDSSQIPTLLVSGLARQHVTVSLSGDAGDELFGGYNRYQITAELWGRLARIPGPVRAAAAWGLTRLSPHQINRVAALLPMASRWSHVGEKVHKGAGVMAAHTVDELYRGMVSQWQCPDAIVMGGAEPATLPEPVARALAMLGDVERMMAADLLTYLPDDILTKVDRAAMARSLETRIPFLDHRVVEFAWRLPLAYKIRQEDAGHTTKWVLRRVLDRYVPRELIERPKMGFGVPIDAWLRGPLRDWADDLLSEERLRREGFLNPQPIRQRWTEHLSGRRNWQHPLWCVLMFQAWLGHETTERTAPPLTDIPTSDRRLACAF

SEQ ID NO: 2511 - protein, 258 aa, Clusia minor
CEEIGRGRFGVVYKCTKLSTNETYALKSIVKNSLNDDLLDARCLVTEPKILRHVSPHPHVTQLHDSHEDDCYLHLIIDLCPNGDLYTLLLSTGPIPEAQSKAQFVQLMKAVSHCHKSGVVHRDIKPDNILFDSRESLKLADFGSAECGKGSDLNGVVGTPYYVAPEILEGREYGEKVDVWSAGVVLYVMLAGFPPFYGETVVEIFEAVLRGNLRFPTRAFCTVSSSVKDLLRRILCRDVSRRFTADQVLRHPWVTSGG

SEQ ID NO: 2512 - protein, 150 aa, Hordeum vulgare
MSIVRRSNAFDPFADLWADPFDTFRSIVPAFSGNSETAAFANARVDWKETPEAHVFKADLPGVKKEEVKVEVEDGNVLVVSGERTKEKEDKNDKWHRVERSSGKFVRRFRLPEDAKVEEVKAGLENGVLTVTVPKTEVKKPEVKAIEISG

SEQ ID NO: 2513 - protein, 260 aa, Clusia minor
CEEIGRGRFGVVYKCTKLSTNETYALKSIVKNSLNDDLLDARCLVTEPKILRQVSPHPHVTQLHDSHEDDCYLHLIIDLCPNGDLYTLLLSTGPIPEAQSKAQFVQLMKAVSHCHKSGVVHRDIKPDNILFDSRESLKLADFGSAEVICGKGSDLNGVVGTPYYVAPEILEGREYGKKVDVWSAGVVLYVMLAGFPPFYGETVVEIFEAVLRGNLRFPSRAFCTVSSSVKDLLRRILCRDVSRRFTADQVLRHPWVTSGG

SEQ ID NO: 2514 - protein, 234 aa, Aristolochia micrantha
IPQASRFLFMKNKVRMICDCYAKPVRVYQDEKLSFDLTLCGSTLRAPHSCHLQYMKNMSSIASLVMAVVVNEGEEDDNPDINQQRQQVPKRKRLWGLVVCHNTTPRFVPFPLRYACEFLMQVFAIHVNNELELENQIREKNILRTQTLLCDMLLRDSPLSIVTRSPNIMDLVKCDGAALMYQNKIYTLGLAPTESQIREINQWLSEYHMDSTGLSTDSLHDAGYPKALSLGDIV

SEQ ID NO: 2515 - protein, 234 aa, Aristolochia tomentosa
IPQAARFLFMKNKVRMICDCYAKPVKVYQDERLSFDLTLCGSTLRAPHSCHLQYMKNMGSIASLVMAVVVNEGEEDDNPDTNQEQQAQPKRKRLWGLVVCHNTTPRFVPFPLRYACEFLMQVFAIHVNKELELENQIREKNILRTQTLLCDMLLRDSPLSIVSRSPNIMDLVKCDGAALLYQNKVYTLGAAPTESQIHEINRWLSEYHMDSTGLSTDSLQDAGYPKALSLGDIV

SEQ ID NO: 2516 - protein, 206 aa, Solanum tuberosum
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFENLNNWREEFLIQASPSDPENFPFVVLGNKVDVDGGNSRVVSEKKARAWCASKGNIPYFETSAKEGTNVEEAFQCIAKNALKSGEEEEIYLPDTIDVAASSQQRTGGCEC

SEQ ID NO: 2517 - protein, 295 aa, Nostoc punctiforme
MAKDMQREFTNRDELVAYLCEQFPGAAERDDHISETVGGRKAAQDALQKIDPVRYAQTRNFFTGAVTRLSPYIRYGVLSLREIRDYVLDQVQQKNDATKLINELGWRDYWQRLYVKLGDEIWKDQEEYKTGYTVAEYLPELPQDIRQGTTGRVCIDSFSHDLKETGYLHNHARMWLAAYIVHWRRIGWQAGAKWFLEHLLDGDPASNNMSWQWVASTFSQKPYFFNRENLERYTEGVYCQKCPLYGHCDFEGSYEELQQRLFPKGEFSKQANSQSWQRDKKGKGSRGSREGQGRE

SEQ ID NO: 2518 - protein, 232 aa, Aristolochia tomentosa
IPQASRFLFMKNKVRMICDCYAKPVKVYQDERLSFDLTLCGSTLRASHSCHLQYMKNMGSVASLVLAVVVREGEEDDNPDPNQEPQSKRKRLWGLVVCHNTTPRFVPFPLRYACEFLMQVFAIHVNNEVELENQIREKNILRTQTLLCDMLLRDSSLCIVTRSPNIMDLVKCDGAALLCQNKVYTLGVTPTESQIREINQWLSEYHMDSTGLSTDSLHDAGYPKALSLGDIV

SEQ ID NO: 2519 - protein, 209 aa, Triticum aestivum
  misc_feature (53)..(53): Xaa can be any naturally occurring amino acid
SFYRRWTKNQDTVTLEEVLQPGNDMIAAGYCMYGSSCTLVLSTGNGVKAAHAXGFTLDPSLGEFILTHPNIKIPNKGKIYSVNEGNARNWDAPTAKYVERCKFPQDGSSPKSLRYIGSMVADVHRTLLYGGIFLYPADKKSPNGKLRALYEVFPMSFLMEQAGGQSFTGKHRALEIVPSEIHQRSPIFLGSYDDVEEIKSLYAAESSTA

SEQ ID NO: 2520 - protein, 682 aa, Escherichia coli
MNMFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNALWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLPKDYQEPDPYLDETVNIALDLAKLEKARPAEQPAPVK

SEQ ID NO: 2521 - protein, 221 aa, Arabidopsis thaliana
MAQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMAHPDEISKLAKVKAQVSEVKGVMMENIEKVLDRGEKIELLVDKTENLRSQAQDFRTQGTQMRRKMWFQNMKIKLIVLAIIIALILIIILSICGGFNCGK

SEQ ID NO: 2522 - protein, 473 aa, Thermobispora bispora
MTESAMTSRAGRGRGADLVAAVVQGHAAASDAAGDLSFPDGFIWGAATAAYQIEGAWREDGRGLWDVFSHTPGKVASGHTGDIACDHYHRYADDVRLMAGLGDRVYRFSVAWPRIVPDGSGPVNPAGLDFYDRLVDELLGHGITPYPTLYHWDLPQTLEDRGGWAARDTAYRFAEYALAVHRRLGDRVRCWITLNEPWVAAFLATHRGAPGAADVPRFRAVHHLLLGHGLGLRLRSAGAGQLGLTLSLSPVIEARPGVRGGGRRVDALANRQFLDPALRGRYPEEVLKIMAGHARLGHPGRDLETIHQPVDLLGVNYYSHVRLAAEGEPANRLPGSEGIRFERPTAVTAWPGDRPDGLRTLLLRLSRDYPGVGLIITENGAAFDDRADGDRVHDPERIRYLTATLRAVHDAIMAGADLRGYFVWSVLDNFEWAYGYHKRGIVYVDYTTMRRIPRESALWYRDVVRRNGLRNGE

SEQ ID NO: 2523 - protein, 83 aa, Rhodospirillum rubrum
PERVVHARGFGAHGTFETYEDLSALTSADIFQRAGEKTPAFVRFSTVAGNLGSSDVARDVRGFAVKLYTKQGNWDIVGNNTPV

SEQ ID NO: 2524 - protein, 755 aa, Streptomyces avermitilis
MRVAVVGGGPGGLYAAALLKRLDPSREVTVWERNAPDDTFGFGVVLSDETLGGIEHADPVVYAALRDEFVRWDDIDIVHRGVRHTSGGHGFAALGRQRLLGILHERCRSLGVELRFGTEAPYPAWLTETYDLVIAADGVHSSTREAYAEAFRPSVETHRCRYIWLAADFAFDAFRFEIAETEHGVLQLHGYPYAADASTVIVEMREEVWQAAGFAELDERESVERCAKIFADALGGRSLRSNKSAWTHFRTVVNERWSHGNLVLLGDAAHTAHFSIGSGTKLAVEDALALAACLEEQPGLPEALAAYEQERRPVVASTQRAARASLEWFENIGLYLGRPSRQFAFNLLTRSRRVTHDNLRLRDAHFTEAVEREFGCPSGTPPMFTPFRLRGLTLRNRVVVSPMDMYAAVDGVPGDFHLVHLGARALGGAGLVMTEMVCVSREGRITPGCAGIYTGRQAEAWRRITDFVHTRAPGVGIGVQLGHSGRKGSTKLMWEGIDEPLEEGNWPLVAASPLPYKPGSQTPRALSRAQLTDIREQFTDAAWRAARSGFDLLELHCAHGYLLSGFLSPLTNHRTDAYGGSLARRLRFPLEVFDAVRSVWPEERPMTVRISATDWAEGGTTAEDAVEIARAFAAHGADAIDVSTGQVVADEQPAYGRSYQTPYADRIRGEAGVPVIAVGAISSWDDVNSLILAGRTDLCALARPHLYDPHWTLHAAAEQGYTGPGVVWPAPYRAGSRRPQSGRTDAPKPRLTLGT

SEQ ID NO: 2525 - protein, 623 aa, Unknown
  Burkholderia sp. 383
MRSRPARPSGSHAFESSFGTTCVDVDRTRFWLWAPASRTAAVEIEGEDAPAVAMTAVGDGWFEATVPCGPGTLYRYRLDGGLAVPDPASRFQPGGVEGPSQVVDPAAYRWRHDAWRGRPWHETVLYELHIGACGGHASVERRLPEIAALGVTAVELMPVNAFPGMRNWGYDGVLPFAPDASYGRPEELKALIDAAHGLEMQVFLDVVYNHFGPEGNLLPRYAPAFFRADRQTAWGPAIDFSREQTSTFFIENALYWLDEFRIDGLRIDAAHAIDDDAWLRELARRVRAYVGDTRHVHLVLENERNAASLLGPGGFDAQWNDDFHNSAHVLLTGERDGYYRAYADAPLRHLARTLGEGFAYQGEPSPLHDGAARGEPSAHLPPTAFVAFLQNHDQVGNRAFGERLRTLANEDAVRAATALLLLAPSIPLLFMGEEDGSTQPFQFFTDYRGALADAVREGRRREFAAFPAFADAAHRDAIPDPNDIATFVRSTLHGSSDETTPDTDAWRRFYRSALAVRAALVTPNLPGARALGVDLLTGDGDPQALVARWRLGDGSTLTIALNLGSHDAVLPALPVGKIVFETPPRARDRLRDLRLPPRACIAWRDGKVNHDARQHRINGQGRS

SEQ ID NO: 2526 - protein, 362 aa, Ashbya gossypii
MSSKYVTFRGATNFRHRIVMATLSGKAVKIEKIRSEDMNPGLRDHEVSFLRLIEAVTNGSVIEISYTGTTVIYRPGIIVGGSHTHNCPNGKAVGYYVEPLLYLAPFSKKKFSIILRGVTSTHQDAGIEAIKWGLMPVMEKFGVRECALHTLKRGAPPLGGGEVHLVVDSLIAQPITMHALERPLISAIRGVAYSTRVSPSMVNRMIDGAKSVLKQVPCEANITADVWRGANSGKSPGWGITLVAETKKGWRYFTEAIGDAGEVPEDIGNKAAYNLLEEISRSAVVCRSQLPLAIVYMVIGKEDIGRLRIARAQVDESLVLLLRDIKELFGTEALLKPADDDTDDLIVTIKGIGFTNTSKKIA

SEQ ID NO: 2527 - protein, 591 aa, Chlamydomonas eugametos
MAAKFVEGTLDVTLKSASDLREDMSVKLDAYCVVSCASTAHRSNTVTDAGKTMNWEQTFHFDKVASTSVLKLESSMRRTPSDRSSCACKIPLTRACTSGSDEVCVPVLDKKGKPIGETHVSMTFKATSMADGPTKGNWILPTYANKDCWKDYEQGKVVGKGSFGTTYLVTKKDTQEQYAVKVISKRKLTTMEEVEDIQREVRIMHHLAGHPNVVQLKNVYEDKSYVYLVMDACMGGELFDAIVERGTYSEKDARALMRTIVSVVAHCHDMGVIHRDLKPENFLLLDKSANPVLKSIDFGLSSFYQEGQVFHDIVGSPFYVAPEVVRRSYGKEADIWSCGVILYILLCGYPPFHGDNETKIFEAIMNKSLDFQSDPWPKVSEPAKECIRRMLDRNPKTRASAQQTLEHEWMRENGVATEKRLEMEVLTSMKKFSAGNRLKKEAAKIIAANLPTDEICGLREMFIAIDVDHSGSITAEEFANALRMKGNSLPEDEVQRLVSNADVDGDGTCDYEEFLAATINQSKLEREDRLKIAFEHFDLDHDGSITHDELMQSLANLGINDAGIKEIIADVDRDGNGQIDYNEFCLMMRNL

SEQ ID NO: 2528 - protein, 735 aa, Unknown
  Burkholderia sp. 383
MTDTLFERSDIDALLAGRHPDPFACLGPHGQTGQVVVRAVLPGAKSVHALSPEGAELGTLACVDRAGCFAGTIPRNGGAPHYLLAIDWPDARQVIDDAYAFGTLLDDAVLARFSAGDPAAVLDCLGATPARIDDTDGVRFAVWAPNAQRVSVVGDFNGWDGRRHPMRLRRPSGVWELFVPGIGAGECYKYELRAADGRVLPHKSDPCARATEAPPRTASVVADVAALDAFAWHDEGWMHARPRADRYRVPWSIYEVHAESWQRVPEEMNRSATWDELAERLIPYVQGMGFTHVEFMPIAEYPFGGSWGYQPVAQFAPSARFGPVDGFARFVDRAHAAGIGVLVDWVPAHFPDDPHGLAQFDGTALYEHADPREGLHPDWHTCVFNVGRTEVGAFLAASALAWARRYHVDGIRVDAVASMLYRDYSRAEGEWVPNVHGGRENLESVAFLRMLNDTLHGAAAPAGVVTVAEESTAWPGVTAPTGDGGLGFDFKWNMGWMHDTLAYVREDPVHRRYHHDRMTFGLVYAFSERFVLPLSHDEVVHGKGSLVAKMPGDAWQRLATLRAYFGFMWAHPGKKLLFMGSEFAQWAEFAHDATPHWDLLDAPAHRGVQRLVRDLNRTYAAEPALHALDCHAAGFSWLIGDDRDNSVFAFARRDEAGHLVVAICNFTPVPRASYRVGLPAPGQWRELMNTDAAPYGGTNAGNDGAVWAEAVPAHGEAWSALLRLPPLATLWLRPA

SEQ ID NO: 2529 - protein, 371 aa, Pseudomonas fluorescens
MTQQLFRPIALGPYTLPHRVAMAPLTRSRAGQPGDIPTSMNAEYYRQRASAALIITEATQISRQGQGYAWTPGIYNDEQVQAWREVSRQVHEAGGLIFMQLWHVGRVSHPSFQPDNALPVAPSALPVPGKTFIVDDEGNGVWGDVPVPRALQTSEIADIISDYRRAARNALNAGMDGVEIHAGNGYLLDQFINSNSNQRTDGYGGPLENRARLLLEVVAAVVDEVGADRVGVRLTPMGRFMGMGDESPEATFGYIVRSLNRWKLAYLHLVEPAVVGTVKDENFDPRWDAIIAQLRDAWDGVLMIAGGYDPESAEQALADGRADIIAFGRPFLANPDLPRRIREGLTLNAPDPSTFFGGDQRGYTDYPVYAH

SEQ ID NO: 2530 - protein, 396 aa, Ralstonia eutropha
MFDTILDWAANGLANWSWWEIVIYTLVVTHITIAGVTIFLHRCMAHRSLDLHPIAQHFFRFWLWLTTGMVTREWTAIHRKHHAKCETEDDPHSPQTRGIRKVLLEGAELYRAEAKNKETIAKFGHGCPNDWVERNVYSRFGWQGVGLMLIIDLALFGVIGMTVWAVQMLWIPINAAGVINGLGHWWGYRNYDCEDASTNVSPWGLVIGGEELHNNHHTYPTSAKFSIKWYEFDVGWGYIRAMQAVGLAKVKKTPPKARLVEARPVDENTLEAIIANRYDVMARYAKAVKSAFRQELEQLKEGRVAEYRTFKPASKWFHREEAKLAAPQRQQLASIVEQSKSLHTFVEMRRELAAIWGRSNLTREQLLQQLQAWCHRAEASGIQALHDFSLRLRRYA

SEQ ID NO: 2531 - protein, 363 aa, Sinorhizobium meliloti
MEIPMNPMFTSVRVGRYMLPNRLVMAPMTRSRAAFDGTPGELATEYYVQRARLGLIVTEGTQPSDDGQGYLTTPGIYTPAHIAGWRKITSAVHDKGGHIFIQLMHAGRMSHPDNTPHHRQGVAPSAIAPGAGMFTATGMQDIPTPRALTTEEVRRTVAEFSHAARSAIEAGADGIEIHGANAYLVQQFFAPSANTRTDEYGGSIENRARFAIEVATAIAEEVGADRTAIRLSPGTALWGIDEGAEGPDLYRYLVAELDKLGLAYVHILHQSNEPLLADIRKLWRQPLILNRPGRPRGQIGADVASGLADLEAFGQMVLANPDFVARLKADAAMNESDPKTFYGGAAKGYIDYPVLSARTDTSS

SEQ ID NO: 2532 - protein, 158 aa, Xanthomonas campestris
MNIVRYPQFPTHALQNEIKHVFDRFFEQNGDTDESAVVTAQWVPRVDIKEEPNHFVLYADLPGIDPSQIEVQMDKGILSIKGERKSESSTETERFSRIERRHGSFHRRFALPDSADADGITAAGHNGVLEIRIPKRPAATPRRIQVGNGQSTSGSTVQ

SEQ ID NO: 2533 - protein, 501 aa, Oryza sativa
MVVSVAATDSDTAQPVQYSTFFASRYVRDPLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 2534 - protein, 453 aa, Unknown
  Nocardioides sp. JS614
MPPSTPAVLWFRRDLRLADNPALVEAAADGPVLPLFVLDPVLWGPAGAARRAYLGASLRALDASLRERGTRLSVVRGDPARLVPRAARAVGAARVHVAADFGPYGSRRDGAVEQALTGAGAELVRTGSPYAVAPGRVTNTAGAPYRVFTPFHRAWAEHGWRGPVGVPEGTGWLRLAEGTAEIPDPALPDGLTLPAAGEAAARRRWAEFLDRVDEYAEDRDRPAVDGTSQMSAHLKWGEIHPRTMLADLARRRGAGAATYRKELAWREFYADVLHARPETARQYLRPEFARMRYDEPGEHLDAWRHGRTGFSVVDAGMRQLRATGWMHNRVRMITASFLVKDLHLEWQLGARHFLRWLVDGDLASNQHGWQWTAGCGTDAAPYFRVFNPTAQGRRFDPRGEYVRRWVPELADPDVVADPHDPSPSERQAVGYPEPIVDHAAERREALGRWERIR

SEQ ID NO: 2535 - protein, 252 aa, Vibrio parahaemolyticus
MLEIKSIPAFNDNYIWLIQNSDKRCAVVDPGDAQPVLDYLQANELTLEAILVTHHHNDHIGGVPDLVRAFPHVTVVGPKAEPIPTLTTPMEEGDKLELFGEIFLVLGLPGHTLGHIGYVGDSKLFCGDVLFSAGCGRIFEGTPEQMFESLSKIAALPEETQVFCAHEYTASNVAFALAVEPDNEQLRQYRDDVNRLRALNIPTLPTTLRKEKWINPFLRTTNPDVVKSVANRIKNSDPCSVFTALREWKNEF

SEQ ID NO: 2536 - protein, 540 aa, Klebsiella pneumoniae
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIVNEGLKAVAAGMNPMDLKRGIDKAVLAAVEELKALSVPCSDSKAIAQVGTISANSDETVGKLIAEAMDKVGKEGVITVEDGTGLEDELDVVEGMQFDRGYLSPYFINKPDTGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEESAIQGRVAQIRKQIEEATSDYDREKLQERVAKLAGGVAVIKVGAATEVEMKEKKARVDDALHATRAAVEEGVVAGGGVALVRVAAKLAGLTGQNEDQNVGIKVALRAMEAPLRQIVSNAGEEPSVVANNVKAGDGNYGYNAATEEYGNMIDFGILDPTKVTRSALQYAASVAGLMITTECMVTDLPKGDAPDLGAAGGMGG

SEQ ID NO: 2537 - protein, 594 aa, Salmonella typhimurium
MSSKIFCKSWGAEYIAADVVRFRLWATGQQKVMLRLAGKDQEMQANGDGWFTLDVAGVTPGTEYNFVLSDGMVVPDPASRAQKTDVNGPSYVVDPGSYTWRNTGWKGSRWEQAVVYEMHTGTFTPEGTFRAAIAKLPYLAELGVTVIEVMPVAQFGGERGWGYDGVLLYAPHSAYGTPDDFKAFIDAAHGYGLSVVLDIVLNHFGPEGNYLPLLAPAFFHKERMTPWGNGIAYDVDAVRRYIIEAPLYWLTEYHLDGLRFDAIDQIEDSSARHVLVEIAQRIREDITDRPIHLTTEDSRNIISLHPRDQDGNAPLFTAEWNDDFHNAVHVFATGETQAYYNDFADAPEKHLARALAEGFAYQGEISPQTGEPRGVKSTGQPPVAFVDFIQNHDQVGNRAQGDRLITLAGAERTKVLLATLLLSPHIPLLFMGEEYGESRPFLFFTDFHGDLARAVREGRAKEFADHAGENVPDPNAPETFQRSKLNWKQQHSEEGKAWLAFTRELLLLRQKHIVPLLSAARESSGTVLQTAPGFIAVSWRFPGGTLSLALNISATTVLLPDLPGKTLFAWPNESTGSLSQHSLIVRLAQGESAS

SEQ ID NO: 2538 - protein, 235 aa, Aristolochia zollingeriana
IPQASRFLFMKNKVRMICDCYAKPVKVYQDDKLPFDLTLCGSTLRAPHSCHMQYMKNMSSVASLVMAVVVNEGEEDENPDPNQQQQQQQPKRKRLWGLVVCHNTSPRFVPFPLRYACEFLMQVFAIHVNNELELENQIREKNILRTQTLLCDMLLRDSPLSIVNRNPNIMDLVKCDGAALMYQNKVYTLGLAPTESQIRDINQWLLEDHMDSTGLSTDSLHDAGYPKALSLGDIV

SEQ ID NO: 2539 - protein, 1280 aa, Streptococcus pneumoniae
MRKTPSHTEKKMVYSIRSLKNGTGSVLIGASLVLLAMATPTISSDESTPTTNEPNNRNTTTLAQPLTDTAAGSGKNESDISSPGNANASLEKTEEKPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDSKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDLFEDLEPNYYHFMDADGTPRTSFGGGRLGTTHHMTKRLLIDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGPVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRNESVENSSKENIPATPDKQAELPNTGIKNENKLLFAGISLLALLGLGFLLKNKKEN

SEQ ID NO: 2540 - protein, 143 aa, Medicago sativa
DPFSLDVWDPFKDFPFTNSALSASSFPQENSAFVSTRIDWKETPEAHVFKADLPGLKKEEVKVEIEDDRVLQISGERNVEKEDKNDQWHRVERSSGKFMRRFRLPENAKMDQVKAAMENGVLTVTVPKEEIKKPEVKSIEISS

SEQ ID NO: 2541 - protein, 158 aa, Medicago sativa
MSLIPSFFGGRRSNVFDPFSLDVWDPFKDFPFNNSALSASFPRENSAFVSTRVDWKETPEAHVFKADLPGMKKEEVKVEIEDDRVLQISGERSVEKEDKNDQWHRLERSSGKFMRRFRLPENAKMDQVKAAMENGVLTVTVPKEEVKKPEVKTIDISG

SEQ ID NO: 2542 - protein, 666 aa, Vibrio vulnificus
MKCRSKVTLIAASLWLAASAQALEAKLSEKDLPLLAPEVQHETASKRVTSRFTRSHYKHFNFNDDFSRAMFNRYIEMLDYNKNIFTQADIDSFEKWSTELDDQLKEGNNQIAFDVYNLSMKKRFERFSYALKLLDQEITFDTDDEIELDRTDAAWPKDQTELNELWRQRVKYDALNLKLTGKDWPEIKEILEKRYNNAMKRITQTRNEDVFQLYMNAFAREVDPHTSYLSPRNAEQFQSEMNLSLEGIGAVLQMTDDYTVIRSLVAGGPASKSKQLGEGDRIIGVGQDKKDIVDVIGWRLDDVVQLIKGPKGTKVHLQVLPEGKDSKSYVVTIVRDKIRLEDRAVKAEVIEKDGKKIGVLEVPSFYVGLSADTDKLLTDLKGKGVDGIIVDLRNNGGGALTEATALTGLFIEKGPVVQVRDSYGRVKVNADTDGQISYSGPMTVLVNRYSASASEIFAAALQDYGRAIILGENSFGKGTVQQHRSLNHIYDLFDKEIGYVQYTIQKFYRIDGGSTQNKGVVPDIPFPTAIDPEETGESVEDNALPWDSIEKADYQVLQRNDSLIEQLRVKHDERIANELEFKFIAEDIAKYKAEKDDNTLSLNEKVRKQESEQADKQRLDRINQRQALAGKEAFKTLDDVPKDYETPDAYLDESVAIMVDMLKKPS

SEQ ID NO: 2543 - protein, 339 aa, Bacillus licheniformis
MSNRKLFTPWSLKGVTLKNRIVMSPMCMYSSHEKDGKVQPFHMTHYISRAVGQVGLIMVEATAVTPQGRISDQDLGIWDDAHIDGLAALTSQIKTYGSKTAIQLAHAGRKAEVEGTIYGPSAIPFDENSRTPVEMTKEDIKETVQAFKKGAERAKAAGFDIIEIHGAHGYLINEFLSPLSNKREDEYGGSPENRYRLLREVIDAVKEVWAGPLFVRVSASDYKTKGLDVADYVGFAKWMKEQGVDLIDVSSGAVVPADINVFPGYQVGFADTIRAQAEIQTGAVGLITSGLQAEEILQNGRADLIFVARELLRDPYWPKTAAKQLNTKIEGPVQYDRAW

SEQ ID NO: 2544 - protein, 277 aa, Bacillus thuringiensis
MSLTSLKDYTTLHNGVKMPWFGLGVFKVEDGSQVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQDIAKKYNKSTAQIILRWDLHNEVVTIPKSIKEHRIIENANIFDFELSSDDMKAIQALNEDHRVGPDPDNFNF

SEQ ID NO: 2545 - protein, 744 aa, Emericella nidulans
MATSITAGLQKAQQAVQDTATKNKKIVDISHDTVNVHTDQEQRTDFGVAITDPDHWLRVTNETHSGPSLLEDHIARERIHRFDHERIPERVVHARGTGAYGNFTLKESIEDLTYAGVLTDTSRNTPVFVRFSTVQGSRGSADTVRDVRGFAVKFYTDEGNWDIVGNNIPVFFIQDAIKFPDFVHAVKPEPHNEVPQAQTAHNNFWDFVYLHPEATHMFMWAMSDRAIPRSYRMMQGFGVNTFSLVNKEGKRHFVKFHWIPHLGVHSLVWDEALKLAGQDPDFHRKDLMEAIDNKAYPKWDFAIQAIPEEDQDKFEFDIFDATKVWPEEQVPLRVVGELELNRNIDEFFPETEQVAFCTSHIVPGIDFSDDPLLQGRNFSYQDTQISRLGVNWEEIPINRPVCPFLNHNRDGAKRHRITKGTVNYWPNRFEANPPASDKGFKSHPAPITGRKRRDLTPKFKEYHNQAQLFYNSLSEVEKVHVKKAFSFELDHCDDPIVYERLAGQRLAEIDLPLAQAVAEMVGAPIPTKALRDNHGKTSVRLSQFDFTPKAPGIISRRIAIIIGDGYDKIAFNGMKAAILAAASAPLRHWHQTSAIYAQGEDKNSSKGVIPDHMYDGMRSTMFDATFIPGGSHIETLQKNGQIRYWIAETFGHLKALGAMGEAAQLVKEVLGNVMGVQIAGADSAEPVEWYGVVTARGPESAESLSEGFKVLKDAGDFTSKFFYQISQHRNWQRELDGLASTVAF

SEQ ID NO: 2546 - protein, 362 aa, Kluyveromyces lactis
MPRTITYDIPSHYQLVDLVGEGAYGTVCSAIHKPTNTKVAIKKIQPFSRSMFVTRTLRELKLLKFFHSHENIISVLDIVRPTSWHKFEAVYLVQELMETDLQKIINQQNLSEDHIQYFVYQILRALKSLHSAQVIHRDLKPSNLLLNSNCDLKVCDFGLARCLASSDQSRENMVGFMTEYVATRWYRAPEIMLSFQEYTTAMDIWSCGCILAEMIMGKPLFPGKDYHHQLWIILEVLGSPTLEDFEQIKSKRAKEYISQLPMKKGIPWANVLNKEVNPLAIDLLSKMLTFNPDKRISAVEALEHPYLATYHDPDDEPDYPQLNLEDNFWKIDNEARDKNEEDDIPLELLKKMLYGEVMKPLN

SEQ ID NO: 2547 - protein, 284 aa, Triticum aestivum
  misc_feature (54)..(54): Xaa can be any naturally occurring amino acid
  misc_feature (88)..(88): Xaa can be any naturally occurring amino acid
  misc_feature (173)..(173): Xaa can be any naturally occurring amino acid
GLQEFGTSPTPSPLSLRQWRPAAQRNLRNQWSRLLAAKTQWLDAAASGRSHAAXLVNAYLSRSYMPGMDLGVLKDIPRIRDRASAKLXTRRCNAREMLLSAYKEMVCAMSDLVKASHAMRCFSKVSSGSPLVRFTDRQDDLNDLGDGGGAPVHRWVSMLEFENLAKELVEMFXVSELRLKRLIVLDLLSINLKEGADPSLEWSDELYDGEFNEFQRIGLGSGDSFPLPENWKADVLQARRPGHTPSHEVLQVYLTSWLANVNIKTSRIDEIFELVEEEMQIKLR

SEQ ID NO: 2548 - protein, 516 aa, Neurospora crassa
MSSNDAPVYTLAEGRPVQDPSAATVLMGSKPRGGALSLLADTQLIETLAHFPRERIPERVVHAKAAGAWGEFECTEDVSDFTSVDFLNKVGKKTKVLARISTVAGEKGSADTVRDIRGFAVKFFTEEGNWDFVGNDLPVFFIRDPVKFPSLNRSHKRHPQTNVPDSTMFWDFHNNNQEGVHCLMQLFGGRGIPASLRNVNAFGNHTYKFGKPEDGTFKYVKIHLKPDAGIKNLESDEALRLAGEEPDFHIKDMYNAIERGDYPTWTMYFQIMDPKDAETYRYNIFDITQTWSHRDYPLRPIGKLRLNKNPENHFQDIEQAAFSPSTMVPGIGPSADPMLQARMFSYPDAARYRVGPNYQQLPCNRALHVYSPYQRDGPMRVDGNYGGDPDYVRSSFRPMRFGPPDVAHDEWAGKVALFTSEVTDLDFEQPRDLWKIFKETGEDKRFAKNVAAHVGKALPEVQKKTIEMFSKVDQEVGEAIQRELDELEKKGGAGIEHDKAPVKGKGMRCKDSKDDE

SEQ ID NO: 2549 - protein, 281 aa, Corynebacterium glutamicum
MDQKNKLSKSEGIPLVTLNDGKTIPQLGFGVFKVDPDEAERVVTEALEVGYRHIDTAAIYGNEEGVGRAIAKSGIPREELFITTKLWNDRHLDVEAAFEESLQKLGLDYVDLYLVHWPAPKNDNYVAAWKGLEKLGDRARSIGVCNFLPEHLEKLLAEATTVPAINQIELHPALQQRDAVEASLAAGITVESWGPLGQGRFDLGAEEPIAAAAKNHGKTPAQVVIRWHLQNGFVVFPKTVTKSRMVENIDVFDFELSDEEMAAITALERNDRGGSHPNDLN

SEQ ID NO: 2550 - protein, 386 aa, Citrus sinensis
WIPRAAGIRLRVPLLHLSNFQINDWPELSTKRYALMVLMLPSDSARQWHVHELELVEVVADQVAVALSHAAILEESMRARDLLMQQNIALDSARREAETAIRARNDFLAVMNHEMRTPMHAIIALSSLLQETELTPEQRLMVETILKSSNLLATLINDVLDLSRLEDGSLQLQIGTFNLHAVFREVLNLIKPIASVKKLLVALNLAPDLPEYAVGDEKRLMQTLLNVVGNAVKFTKEGNISITGFVAKSESLRDSRAPEFFPVPIENHFYLRVQVRDSGSGISPQDIPNLFTKFAQNQAIALRNSSGSGLGLAICKRFVNLMEGHIWIESEGLGKGCTAIFIVKLGIPEHSNDSNLSFIPKMPVHGQTNFPGLKVLVMDENGVSRQ

SEQ ID NO: 2551 - protein, 823 aa, Triticum aestivum
MATFAVSGATLGVARPAGAGGGLLPRSGSERRGGVDLPSLLLRKKDSSRAVLSRAASPGKVLVPDGESDDLASPAQPEELQIPEDIEEQTAEVNMTGGTAEKLESSEPTQGIVETITDGVTKGVKELVVGEKPRVVPKPGDGQKIYEIDPTLKDFRSHLDYRYSEYRRIRAAIDQHEGGLEAFSRGYEKLGFTRSAEGITYREWAPGAHSAALVGDFNNWNPNADTMTRDDYGVWEIFLPNNADGSPAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYKFDGFRFDGVTSMMYTHHGLQMTFTGNYGEYFGFATDVDAVVYLMLVNDLIHGLHPDAVSIGEDVSGMPTFCIPVPDGGVGLDYRLHMAVADKWIELLKQSDESWKMGDIVHTLTNRRWLEKCVTYAESHDQALVGDKTIAFWLMDKDMYDFMALDRPSTPRIDRGIALHKMIRLVTMGLGGEGYLNFMGNEFGHPEWIDFPRGPQTLPTGKVLPGNNNSYDKCRRRFDLGDADFLRYHGMQEFDQAMQHLEEKYGFMTSEHQYVSRKHEEDKVIIFERGDLVFVFNFHWSNSFFDYRVGCSRPGKYKVALDSDDALFGGFSRLDHDVDYFTTEHPHDNRPRSFSVYTPSRTAVVYALTE

SEQ ID NO: 2552 - protein, 566 aa, Corynebacterium glutamicum
MWAPLPHDVHLILNGETLPMHKTEGSWWRAEIAPKAGDRYGFSLFDGSSWSKTLPDPRSTSQPDGVHGLSEVSDDSYLWGDQQWTGRILPGSVLYELHVGTFSEDGTFEGVVDKLPYLRDLGVTAIELLPVQPFGGNRNWGYDGVLWHAVHAGYGGPAGLKKLIDASHQAGIAVYLDVVYNHFGPDGNYNGQFGPYTSGGSTGWGDVVNINGHDSDEVRNYILDAARQWFEDFHVDGLRLDAVHSLDDRGAYSLLAQLTMVAEDVSAQTGIPRSLIAESELNDPKFVTSREAGGFGLDAQWVDDIHHALHALVSGERNGYYSDFGSVDTLAKTLREVFEHTGNYSTYRGRNHGRPVHPDITPASRFVTYTTTHDQTGNRAIGDRPSTTLTPEQQVLKAAIIYSSPYTPMLFMGEEFGATTPFAFFCSHTDPELNRLTSEGRKREFARLGWNADDIPSPELESTFTSSKLDWEFTAEQRRINDAYKQLLHLRHTLGFSQPNLLTLEVEHGENWLSMANGRGRILANFSDDTITVPLGGELIYSFTSPTVTDTSTTLQPWGFAILTRN

SEQ ID NO: 2553 - protein, 1109 aa, Saccharophagus degradans
MSKQNKNKFTHSIQKTLIQWFLLLSLVPLFLVAFIGYQVARNSLVASAQDHLESDARNTMNFLNNWFEYRLMDSLSGAQDENNIKFLQELHEAAVQTELSIESFHKSIKWAEITASRQGGLVDISRNYDYIYDVFLIDVDGNILFTVAKESDLGTNLVHGKYANTKFGGTVRKTLATGQTLFADFEHYEPSAGIIAGFVVSPLVNSEGQRIGAYAMQFRIDRIINHLKLNSASMYRHYLVGPDGTLRTQRRQSEQLLITQINTAPVKRWLEANETAKHSDKPKLIKYSEADGTVYLGMHQNLTLRNLDWLLVSEVKEADALASSNWLAGVMLLSVWFTAMLLSVLAFFLSIRITNPIKAITIVANKLVKGDFSQRVQVQESNEFGLLANSFNELIQSRKYYELELLAAKNEAESSSRAKSEFLACMSHEIRTPMNGVLGMLGLVLNSSLTPEQERKLLLAQSSGQSLLSVINDILDYSKVEAGKLELEHLDFDPHRLLSDVVQSFNYSAQEKGIELVLDDIGLGGKVLRGDPSRLRQIINNLLSNALKFTSQGEIIVRAKLDSEINGLNQLRCSVTDTGIGIPSDKISGLFDSFTQVDSSTTRRYGGTGLGLSICKMLTRIMGGDIFVVSEVGKGTRFDFVVHVETGSCLPVDNAESDVTGLNVLLVDDNLTNLDVISGQLISWGIHVTKVAGPEQALVLVAEVQDTVFDLVLMDCHMPNINGIDLAERIQGSPCIKPNSVIILSSSADMASRFHMQEVGVVGCLMKPVSAPYLHQAIQYFIQIKKSNKQQFITPALLESVHATTESTANPNIVWGDNVRILVVEDNLVNQQVIAGILEDFGLAFTLVDDGQQAISALKENTGDLRYHFVFMDCQMPVLDGYNATKQIREGAAGEECKIVPIVALTANAMQGDRDKCLRAGMNDYVAKPVDADEVRLALVSWLPAELRTDEAAIENNPETPDTPDILEKKSPPAEENPVEPQVVKVDLGLLKLPKGLVIHTPAMLQPMFKNKPERYVKILTTLLNAHASFNTSLNEAFANNDTEQVRHLVHAMKGSSGNISMGKVHEYCKQVEAQIDADGAASAEYINKLQQLIEAMFDEANQIVELNS

SEQ ID NO: 2554 - protein, 148 aa, Oryza sativa
MAAISTTTAAYFSSQPQLPATAAAKSGGRQQQRRRSSFVMLEAAAASGSGGGGGGAVGRTRSLTEEDLEELKGCLDLGFGFAYHEIPELCGTLPALELCYSMTRRFLDEQRAPGQEPESPATPPLPNWRISGPGAPIAVLYRVGRGFG

SEQ ID NO: 2555 - protein, 541 aa, Pantoea agglomerans
MAAKDVKFGNDARVKMLRGVNVLADAVKVTLGPKGRNVVLDKSFGAPTITKDGVSVAREIELEDKFENMGAQMVKEVASKANDAAGDGTTTATVLAQSIITEGLKAVAAGMNPMDLKRGIDQAVIAAVEKLKALSVPCSDSKAIAQVGTISANSDETVGQLIAQAMEKVGKEGVITVEEGTGLQDELDVVEGMQFDRGYLSPYFINKPETGAIELESPFILLADKKISNIREMLPVLEAVAKAGKPLLIIAEDVEGEALATLVVNTMRGIVKVAAVKAPGFGDRRKAMLQDIAILTGGTVISEEIGMELEKAALEDLGQAKRVVINKDTTTIIDGVGEEATIQGRVTQIRQQIEEATSDYDKEKLQERVAKLAGGVAVLKVGAATEVEMKEKKARVEDALHATRAAVEEGVVAGGGVALVRVAAQLVDLRGQNEDQNVGIKVALRAMESPLRQIVSNAGEEPSVVANNVKAGDGNYGYNAQTEEYGNMIDFGILDPTKVTRSALQYAASVAGLMITTECMVTDLPKGDAPDLGGGAGGMGG

SEQ ID NO: 2556 - protein, 546 aa, Leptospira interrogans
MAKDIEYNETARRKLLEGVNKLANAVKVTLGPKGRNVVIDKKFGAPTITKDGVTVAKEIELEDPLENMGAQMVKEVSTKTNDVAGDGTTTATILAQSIINEGLKNVTAGANPMSLKKGIDKAVTAAVESIQKRAVKIENKKDIANVASISANNDNTIGNLIADAMDKVGKDGVITVEEAKSIETTLDVVEGMQFDRGYISPYMVTDAESMVATLNDPFILIYDKKISSMKDLIHILEKVAQAGKPLVIISEEVEGEALATIVVNTLRKTISCVAVKAPGFGDRRKSMLEDIAILTGGQVISEDLGMKLENTTLQMLGRANKVTVDKENTTIIEGKGQTKEIQGRIGQIKKQIEDTTSEYDREKLQERLAKLAGGVAVIHVGAATEVEMKEKKARVEDALSATRAAVEEGIVPGGGLTLLKAQEAVGSLKLDGDEATGAKIIFRALEEPIRMITSNAGLEGSVIVEHAKAKKGNEGFNALTMVWEDMIQAGVVDPAKVVRSALQNAASIGSMILTTEVTITDKPDKDAPNPMAGMGGGGMGGMGGMM

SEQ ID NO: 2557 - protein, 393 aa, Cryptococcus neoformans
MTVIQSPKLFTPIQVGEYELKHRIVMAPLTRLRAETKTAIPSEWAETYYSQRASDGGLIVSEGTFIAEELRGYENVPGIYTPEQIAVWKKITSGVHSKGGRIFCQLWVLGRVADPNVIPVIYSVGTIRDDSPSYIAAPEPEGQRKPLTPVTEADMDRFIGHYIQASKNAIEAGFDGVEIHGANGYFIDQFLQTNSNDRIDQYGGSLENRMRFPLRVLNAVCDAIGPKRVGIRMSPFSEFQSMRMEDPLATFVPWAQAIVEAQPELAFIHAVEGRGILTPENEWYIQDNLNPIREVILNKGKSVRFIPAGGYMPDTAFEHAEKYPEDLIAFGRYFISNPDLPNRVRNGWPLHKYDRTTFYSQSSVGYNDYKDYKPETEALAQDEAAPKEGTTKA

SEQ ID NO: 2558 - protein, 273 aa, Unknown
  Nostoc sp. 36
MTIATSTKPQINWVNTLFFIGLHIGALFAFVPGNFSWTAVGVGFLLYWVTGGLGVTLGFHRLVTHRSFQTPKWLEYLLVFFGTLSCQGGPIEWIGTHRIHHLHSDTDADPHDSTKGFWWSHMDWLIHYCPAHADVPRFTKDIAEDPVYQFLEKYFILIQVALGVLLLLLGGWPFVIWGIFVRIVWVYHCTWLVNSATHKFGYRSYDSGDQSTNCWWVAVLVFGEGWHNNHHAFQYSARHGLEWWEIDLTWMTVQLLQAVGLATNVKLAPTKSS

SEQ ID NO: 2559 - protein, 215 aa, Setosphaeria turcica
MGAFGLVWKGPDTLGHYPVTDFGRSSAKDQLTNQAVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSS

SEQ ID NO: 2560 - protein, 234 aa, Asarum yakusimense
IPQAARFLFMKNKVRMICDCRAKSVKVYQDEHLSFDLTLCGSTLRAPHSCHLQYMENMSSIASLVMAVVINEGEEDDDGPDSTQQQAQPKRKRLWGLVVCHNTTPRFVPFPLRYACEFLMQVFAIHVNKELELENQIREKNILRTQTLLCDMLLRDAPLGIVTQSPNIMDLIKCDGAALLYENNVYRLGATPTESQLHEIVQWLSEHHMDSTGLSTDSLHEAGYPKALSLGDIV

SEQ ID NO: 2561 - protein, 242 aa, Unknown
  Malus x domestica
MEFPNQAPESSSQKKLGRGKIEIKRIENTTNRQVTFCKRRNGLLKKAYELSVLCDAEVALIVFSNRGRLYEYANNSVRATIDRYKKAYADPTNSGSVSEANTQFYQQEASKLRRQIREIQNSNRHILGEALSSLNAKELKNLEGRLEKGISRIRSKKNEMLFSEIEFMQKRETELQHHNNFLRAKIAENEREEQQHTHMMPGTSYDQSMPSHSYDRNFLPAVILESNNNHYPHQVQTALQLV

SEQ ID NO: 2562 - protein, 482 aa, Pseudomonas syringae
MQLIWLRSDLRVHDNTALTAAMQRGPTLAVYLLSPTQWRNHDDADCKVDFWLRNLVELEKALGKLNVPLLIREADTWDQAPEVLATLCKQFKVEGLHLNEEYGINETRRDQAVQQSMQADGVHFTSHLDQLLFKPGSILTKTGNYFQVFTQFKKVCYTRLHQAMPRTVHTPEAQQPLSIKSDAIPDQVKGFSTPSKTLRDLWPAGEVEASRRIEAFAGEQISYYKDERDFPARPGTSQLSAYLAAGVISPRQCLHAALASNQGEFETGDVGTVTWINELLWREFYKHTLVGYPRVSRHRAFRPETEALKWRDAPEELLAWQEARTGLPIIDAAMRQLLETGWMHNRLRMVVAMFLTKNLLIDWREGERFFMRHLIDGDLAANNGGWQWSSSTGTDSAPYFRIFNPLSQSERFDPEGVFIKRWLPELADLNKKQIHDPASVGGLFGVADYPKPIVDLSKSRARALAAFKALPTRQPAAGADNG

SEQ ID NO: 2563 - protein, 234 aa, Saruma henryi
IPQAARFLFMKNKVRMICDCRAKSVKVYQDEHLSFDLTLCGSTLRAPHSCHLQYMGNMSSIASLVMAVVINEGEEDDDGPDSTQQQAQPKRKRLWGLVVCHNTTPRFVPFPLRYACEFLMQVFAIHVNKELELENQIREKNILRTQTLLCDMLLRDAPLGIVTQSPNIMDLIKCDGAALLYENKVYRLGVTPTESQLHEIVQWLSEHHMDSTGLSTDSLHEAGYPKALSLGDIV

SEQ ID NO: 2564 - protein, 415 aa, Zea mays
  misc_feature (407)..(407): Xaa can be any naturally occurring amino acid
MQSTAAMRSGGGGNKRSLLLLLSAWWLLLGSLVAQLPAARGGSGHVVTRMPGFDGPLPFHLETGYVEVDEQLGVQLFYYFVRSEKDDPGEDPLLLWLSGGPGCSGLSGLAYEIGPFHFDARGYRGGFPTLLYRPETWTKVSNIIFMDSPVGTGFSYATSDEGLKSSDTQAVRQLAIFLRKWLEEHPGFLPNPLYIAGDSYGGMIIPALALEIDRSIELGEKIFSGLKGYIAGNPLTGGQFDTDSQIPYFHAMGLVSDELYKNARENCGGKYSAPLNAVCAEAVQAINNCTRDINKQYILDPACPDDDLLSPKTVAETDGTSRLMLESADFLLDSKCAEALYILSYAWGNDDTVQESLGIRKGTIGAWKRYSHALPYNYDIQSAADYHSRLATKGYRALIYSGDHDAXVIEFPRPT

SEQ ID NO: 2565 - protein, 235 aa, Unknown
  Medicago sativa subsp. x varia
MAMEALNSPTTATPFTPFEEPNLSYLETPWTKGKRSKRSRMDQSSCTEEEYLALCLIMLARSGNNNDKKSDSVATPLTTVKLSHKCSVCNKAFSSYQALGGHKASHRKAVMSATTAEDQITTTSSAVTTSSASNGKNKTHECSICHKSFPTGQALGGHKRCHYEGSVGAGAGAGSNAVTASEGVGLSHSHHRDFDLNLPAFPDFSKKFFVDDEVFSPLPAAKKPCLFKLEIPSHY

SEQ ID NO: 2566 - protein, 285 aa, Unknown
  Nostoc sp. 36
MTANFGAIAPERGNSPQLRWINVVFFGVFHALALLSPWFFSWSALGLLVFLHWLFGSIGICLGYHRLLSHKSFQVPKWLEYAIALIGALALQGGPIFWVGGHRQHHAHTEDIDLDPYSAQKGFWWSHILWIFYPRPEFFDYDTYKKYAPDLARQPFYCWLDRYFLLLQIPFALLLYVLGGWPFVFYGVFLRCVLLWHSTWFVNSASHLWGYRTFDADDGARNLWWVSIVTYGEGWHNNHHTYPHMAKSGLFWWEIDVTWWSIQLLQTLGLAKKVVSSPPQGATHG

SEQ ID NO: 2567 - protein, 471 aa, Bacillus licheniformis
MSKTEPQLEQIQYRFPNGFWWGSAASATQTEGAAAEGGKGKNIWDHWYEKEPNRFFDGVGPEKTSRFYETYREDIQLMKELGHHSFRFSISWARLFPDGKGRLNKEGAAFYNRVIDELLAAGIEPFVNLYHFDMPLALQQIGGWENRQVVDHFASYAETCFRLYGDRVKKWFTHNEPIVPAEGGYLYDFHYPNIVDFQKAVQVAYHEILSNAKAVEAYRRLGGDGKIGIILNLTPSYPRSQHPADVRASEIADAFFNRSFLDPAVKGEFPQLLTDILKEEGYLPVMEEGDLELIKNHTVDLLGINYYQPRRVKAKEHLPHPDAPFMPERFFDHYEMPGRKMNRHRGWEIYEKGIYDILINVKENYGNIECFISENGMGVEGEERFRGEDGMIRDDYRISFIKEHLKWVHRAIQEGANVKGYHLWTFMDNWSWTNAYKNRYGFVSVNLDKNGERTIKKSGYWFKKVAENNGF

SEQ ID NO: 2568 - protein, 482 aa, Arabidopsis thaliana
MASRTTPSRSTPSRSTPSGSSSGGRTRVGKYELGRTLGEGTFAKVKFARNVENGDNVAIKVIDKEKVLKNKMIAQIKREISTMKLIKHPNVIRMFEVMASKTKIYFVLEFVTGGELFDKISSNGRLKEDEARKYFQQLINAVDYCHSRGVYHRDLKPENLLLDANGALKVSDFGLSALPQQVREDGLLHTTCGTPNYVAPEVINNKGYDGAKADLWSCGVILFVLMAGYLPFEDSNLTSLYKKIFKAEFTCPPWFSASAKKLIKRILDPNPATRITFAEVIENEWFKKGYKAPKFENADVSLDDVDAIFDDSGESKNLVVERREEGLKTPVTMNAFELISTSQGLNLGSLFEKQMGLVKRKTRFTSKSSANEIVTKIEAAAAPMGFDVKTNNYKMKLTGEKSGRKGQLAVATEVFQVAPSLYMVEMRKSGGDTLEFHKFYKNLTTGLKDIVWKTIDEEKEEGTDGGGTNGAMANRTIAKQST

SEQ ID NO: 2569 - protein, 189 aa, Brassica napus
MALEALNSPRIASPVPTLFEEHWTKGKRSKRSRSDHPHRLTEEEYLAFCLMLLARDGDRHHVEEEKTVYKCGVCDKVFLSYQALGGHKASHRNFSSGVDPRVRTPAAVKSHVCSICHKSFTTGQALGGHKRCHYDGSSNVVSNSEGVGSTSHVSGNSRRGFDLNITPINELSPDDEVKSPLPSKKLRLT

SEQ ID NO: 2570 - protein, 208 aa, Ashbya gossypii
MSSRKKNILKVIILGDSGVGKTSLMHRYVNDKYSQQYKATIGADFLTKEVTVDGDKVATMQVWDTAGQERFQSLGVAFYRGADCCVLVYDVTNAKSFENVKSWRDEFLVHANVPSPESFPFVILGNKIDVEESKKVVTTRTSQELAKSLGNIPFFLTSAKNAINVDDAFEEIARSALQQSQADAGAYEDDFNDAINIQLDGEPSSCNC

SEQ ID NO: 2571 - protein, 481 aa, Clavibacter michiganensis
MSHPAFASSDLSIPEEFTLGAATAAYQIEGAASKDGRGPSIWDTFSHTPGATAEGATGDTAAGHYDNVTTDLDLMASLHLDAYRFSISWSRVMPEGEGAVNGAGLAFYSTLVDGLLARGIRPVVTLNHWDLPQMLEDKYGGWRGRETAYAFERYAEIVGAALGDRVAIWSTHNEPWNNSFAGYGHGVFAPGVKSHEAALKAAHHLNLAHGLAVRALRRTITKDDAKVSIVLNIFRVEPESPADAEAARLFDAIANRVFTGPVLDGAYPADLLEDTKAFTDWHFLQPGDEQICNQPIDLLGVNYYEIMHIRRRPDYDPTTELMGGTEFPGSERVELFRPEGFDSTAMGWTVEPWGLEDHLVALSARWPSLPIMVMENGAAFDDVLTEVDGQPAVLDRHRTQYLIDHLTATLRARDRGANVDGYLVWSLLDNFEWAAGYGPRFGIIRVDYESFHRTPKLSAHWFAEACSTRTVPALATVDLSA

SEQ ID NO: 2572 - protein, 158 aa, Xanthomonas axonopodis
MNIVRYPQFPTHALQNEIKHVFDRFFEQNGDTDESAVVTAQWVPRVDIKEEVNHFVLYADLPGIDPSQIEVQMDKGILSIRGERKSESSTETERFSRIERRYGSFHRRFALPDSADADGITAAGRNGVLEIRIPKRPAATPRRIQVGNGQNTSGSTVQ

SEQ ID NO: 2573 - protein, 200 aa, Triticum aestivum
  misc_feature (197)..(197): Xaa can be any naturally occurring amino acid
MVSADAARNIVGVIGNVISFGLFLCHAPMFRRICKAKDVEEYKPDPYLATLLTCMLWVFYGLPIVHPNSILIVTVNGIGLVVQLVYLIIFFIYSTNNKRSKMLAVLGIEAAFMAAVVVGVLHGAHTHEMRSMIVGILCVICGSVQYASNLTVMVRVIRTESVEYMPFFLSLAIFLSGCCWMAYALIEFDLYVAIPNXLDA

SEQ ID NO: 2574 - protein, 225 aa, Zea mays
REMCGGKYSDAASVACAEVTRAIANITSAVNREHVLEPACPDDDDDELFGPKTTMAETDGGTSRRLMLQSADYFLPAGFKCRRASYVLSRVWANDETVQESLGVRKGTIGAWKRCNQDILYNQNVQSVVPYHSRLAAKGYRALIYSGDHDRIVPFVGTQAWIRYLNLTVVDDWRPWYVGGQVAGFTRNSGNLIYATVKGAGHTAPEYKPTECQTMFRKWVSRDPL

SEQ ID NO: 2575 - protein, 231 aa, Glycine max
MVNVMEWQKQRWQPNGNAEMMYVKVMTDEQLETLRKQIAVYATICEQLIEMHKNISSHQDLAGIRLGNMYCDPLLGSGGHKIASRQRWTPSAMQLQILERIFDQGTGTPTKEKIKEITNELSQHGQISETNVYNWFQNRRARSKRKQQNVAPSANAESEVETEVDSKDKKTKPDEFQSPPSVSAVPADDNLGFQNHGSLQYLNPDDYLTGKMEAPENYDLYQPAGDFNMAG

SEQ ID NO: 2576 - protein, 232 aa, Thottea tomentosa
IPQAARFLFMKNKVRMICDCNTKPVKVYQDEKLPFDLTLCGSTLRAPHSCHLQYMRNMGSIASLVMAVVINEGEDDEDGSNEQQPQPTRKKLWGLVVCHNTTPRFVPFPLRYACEFLMQVFAIHVNKEFELENQIREKNILRTQTLLCDMLLRDSPMGIVSRSPNIMDLVKCDGAALVYQNKVYPLGLAPTESQINDIAQWLSECHMDSTGLSTDSLQDAGYPKALSLGDIV

SEQ ID NO: 2577 - protein, 348 aa, Triticum aestivum
  misc_feature (139)..(139): Xaa can be any naturally occurring amino acid
AYLGDIIEQVCTKKQAGTGPEFPGYLLDADLESDALGWQYISGSLPDSRELDHIDNPQLEGYKFDPHGEYVRRWLPELARLPTEWIHHPWDAPASVLQAAGVELGSNYPLPIVELDTAQVRLQEALSEMWQLEAASRAXAMDTGMEEGLGDSSEVPPIEFPQDLQMEVHWEPARVAPNVLTTAQRRQDQMVPTVTMTTSLNRVETEISADLGNSVDSRAEVPFRMHFEPRTEREEMIQSTGNAAGTNGIHHHNNFQQPQHRMRNIFAPSVSEASSSWTGRDGGVVPVWSPPAASGHSETYGADEADVSSRSYLDRHPQSHRIMNWHQLSQSLTTGRDVENSVQPNFIG

SEQ ID NO: 2578 - protein, 747 aa, Bacillus subtilis
MCGLAGIINLAAPRSQECTFHILKGMADAISYRGPDDEQYHIDSKVGFAFRRLSILDLVNGQQPFLNEDGSIVVMVNGEIYNYKELKASLHNHMFKTTSDCEVIVHLYEEKGIGFVDDIIGMFSIAIWDKNKNKVFLVRDRFGIKPLFYTELKHELIFASEIKSLFSHPHCPRQFNWKEALSDICLSGEAASNHKETTSFFVNIQNLDAGHYLEINLTTNERKTASYWSLQDILLRQGYRENLHPDDLIEGYRELLADSVHRCLQSDVEVGLFLSGGIDSAAVAHFAAEKQDLHTFTVLSQSTFTNEDAKYAHWLAKDLHLPNHQVLYQLGNDELLQPESYKHLLWICETPFCGPEQLYKFHLHKYAKAIRPNLKVMLTGQGSDEFNGGYSTTLSPAENPSWEGFIESVNTMEMNRLHRLQGNIFRVWEEHFGLSPINLSYLKSNDSSQADPWQSYVLTKYRDLQMYNCWHEDRIAAANHIENRVPFLDHRLVEWVCGIPDGLRKDLLWDKSVLRKSLTNELHTSYTHRPKVPFFYGKDVRYTHKMMFHLLKKNNYQLIEEAFSHSDASSIIQVEHIHAIMTYLEDDPEFTNFEFLLRLVNMGLLSKMTKETPSVQLDITSHLESITIKDWHSQEGDIASRLNISANKCEGQDILALNPGVTLLRPESDSEHCIYIAEEGFIQFIVSEEDVGAWLHILCDINGKDTLHTILDRHGVSLEEVAKYIQEAIEHNIILIKQKNLPEGAYR

SEQ ID NO: 2579 - protein, 932 aa, Clostridium thermocellum
MPSDELDFCAFFDIEEHLYWQGDAMKSKRMIKQSTLSAIILAIFFFIAVMLIWSILYMNSCIRAEQNAERRRTEFKQLGIDLADASDYLTDEARKFAVTRKIVHLERYWEEINVTRTRDKVISRLQELDSPKEELELLAKAKKYSDALVETERRSMRLVLEALGVDESDMVPEVASFKLSEGDQRLSREDKLLKAIEIMYDARYDSDKKNIMDPIAKFQRIMNQRLESELEAARRGTAGATVLQIILAFVIILAIAVLIRILFTQVTYPIRDYILKLKDFSFDDEEFRLVPKGTVELNMLAENFNELYRSFHNELVRRKKAEETMKAARDEADKANRAKSEFLASMSHEIRTPINSIIGYQYLLKNSVLSPKQREYVENIGLAAKNLLAIINQILDFSKIEAGRMVLEEVDFNIDDVLNELMIIVGMEAKRKGIELRIKVDEDVPRFLKGDITRLKQVVMNLVSNGIKFTHEGYISIRVELVEKNEENACIKFSVTDTGIGISDEQKKLLFQAFTQGDASTSRKYGGTGLGLAICKRLVELMKGEINVESEVGKGSTFSFSLRLKIASCNENRNGKSKSVDTEEQYKNVKILLVEDSSVNLQMTKEILENMGIDTDTAQSGEEAVKKAESNEYELILMDIRMPGMDGYEATRRIRKLERGSMPIVALTADAVEGVAQKAKEAGMNGYLTKPLEPEKLLEVIRSMTNGGGKFKEEKSKSCAKAAEAENPYYEHKYETLDFDGAVNRLGGKRDKYIGILKSFVELHKDDGVKIRELAASGKRDELRRFLHSLKGSAANIGALRLKDLLARLEESCIPQNCEKNAKWMNDLEKEFERLIEEIMQYIRAFDSYKGSSPENHENNNVREDLEMLCKLLLTGDSEAKSFFEEKLAYLGNVLRPEDYHDLKKKISCYEFQKALAIVDKLKQDFSGKLTK

SEQ ID NO: 2580 - protein, 628 aa, Streptococcus mutans
MNEREALRTFGTGENFHAQHYFGFHETEKNGVKGYIFRVWAPNAEDLHLIGDFTGWFDNPLQMDKNEAGVWEVFTDLPKEGHIYKYLVKRQGGQIVEKMDPFAIYLEERPGTGSLIRTIPEKKWKDGLWLGRRKRWGFFKRPVNIYEVHAGSWKQNEDGSPYSFEQLKDELVPYLVKMNYTHVEFMPLMAHPLGMSWGYQLMGFFAFEHTYGTPEQFQDFVEACHLNNIGVIVDWVPGHFTQNDDALAYFDGTPTFEYQDHDRAHNYRWGALNFDLGKNQVQSFLISSAKFWIDFYHIDGIRVDAVSNMLYLDYDEGPWQPNIEGNNRNLEGYYFLQRLNTVLKLAHPDVMMIAEESTATTKITGRREEGGLGFDYKWNMGWMNDILKFYEEDPIYRKYDFNLVTFSFMYLFSENFILPFSHDEVVHGKKSLMHKMWGDRYNQFAGLRNLYTYQICHPGKKLLFMGSEFGQFLEWKYDHALEWTNLEEEDGLNLKMQDFTSQLNQFYKDHKVLWQLDTSYDGLEIIDADNVDESVLSFIRKNEKGDLLVCVFNMVPVERKGFTIGVPVAGIYEEVWNTELEEFGGVWKEHNMTVKTQKNLWKEYENTLSFTLPALGASIWKIKRRLRK

SEQ ID NO: 2581 - protein, 271 aa, Lactobacillus acidophilus
MCFNKSVILNNGEKIPQIQLGTWLINNDEVNKVVRQAVNIGYRGFDTAKDYGNESGVGKGIWNSDIERSDIFLTTKLPTAVKDYEGTKKAIDAALDKFGLEYIDLLLIHSPQPWIEVNRTNDRHFKGNLENWRAMEEAVKAGKVRSIGVSNFLQEDIENIVNNGTITPAVNQIEVHIGKVPVELMDYCKKLGIKIEAYSPLSHGKLLNDDQIIAYAKKYNVTPAQLMLAFDMQLGCIVIPKSDNVTEMKENLNINFKISDEDIAKLIKIKE

SEQ ID NO: 2582 - protein, 233 aa, Haemophilus influenzae
MLFALPALNDNYIWLYQRENLPLIIVDLPETDKLFTWLDKQNVTVEAVLLTHEHDDHTQGVSAFKKRYPTVPIYGPQECEKKGATQIVNEGKILTTHYQIDVIPTGGHTKQHVSFLVDNHLFCGDALFSAGCGRVFTGNYAQMFEGLQRLNALPDETIVCPAHEYTLGNLAFAETVLVEKSAVEKQRIFVETQRAENKPSLPTTLKLEREINPFLQAKTLEEFTALRKAKDMF

SEQ ID NO: 2583 - protein, 286 aa, Mycobacterium avium
MTVIDEIYSSSSAIPTVALNDEAKKPVLGLGVAKLSDEETESSVLAALEAGCRLIDTAASYGNEAAVGRAIAASGIPREELFVTTKLGTSRQGFHSAQESCKESLDRLGLDYLDLYLIHWPAPTLGKYVESFEGMIEARERGHVRSIGVSNFTEDLLATVIEETNEVPAVNQVELHPRLNQAELRQVHAQHDVTTQSYSPLGVGRLIEEPTVTTIAAEYGRTPAQVLVRWNLQLDNVVVSRSSKPERVAENLDVFDFTLEPEHMEAIEGLHDGTRVLHDPMTFMGT

SEQ ID NO: 2584 - protein, 399 aa, Unknown
  Polaromonas sp. JS666
MIFFDAAIDWLAHGLVAASWWQIVLYTLVTTHITIASVTIYLHRHQAHRAMDLHALPAHFFRFWLWLGTGQVTKEWVSVHRKHHAKCETMEDPHSPQAHGIETVFWKGAELYRAETKNKETLTKYGHGTPNDWLERNVYTRYSWQGVGLMMILNLALFGAAGLAVWAVQMVWIPVTAAGIINGIGHYWGYRNFEAPDASTNVSPWGIMIGGEELHNNHHTYPTSAKFSVKPYEFDIGWVYIRALEKVGLASVKKVPPKLQLGAIQPVADEKTLEALIAHRYEVMAGFARELRRAGKAEIEVLKARKADVSVLRTANRWLHRDDDKVPAAAKPQLAQARAEHPVLDKMVTMREELRQMWLSTSASREQLATDLQAWCHRAEESGIAALREFSMKLRAARA

SEQ ID NO: 2585 - protein, 468 aa, Streptococcus pyogenes
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFAALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDGGRIDYVKKHLEVISDAISDGANVKGYFMWSLMDVFSWSNGYEKRYGLFYVDFETQERYPKKSAYWYKKVAETQVIE

SEQ ID NO: 2586 - protein, 236 aa, Oryza sativa
  misc_feature (11)..(11): Xaa can be any naturally occurring amino acid
MGRGKIEIKRXENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGQQPAFN

SEQ ID NO: 2587 - protein, 527 aa, Rubrivivax gelatinosus
MKSRFLATMSHEIRTPLNGVVGAAELLQKNGLSEREKAQMVSLLTQSSRALMALINDILDWSKLDVGKVMIERHPINLRALVFESNELFAAQAANKDIELTSSCNPDVPRTLHGDPTRIRQIVNNLVSNAVKFTERGGVHIHLSIDGIDPSERHQEGDPRTVRIEVSDTGIGISPEKLGKLFKAFSQGDVSVTRNFGGTGLGLVISQELANLMGGRIEVSSTPGVGSVFTALLPMIATDQVASTGVPRARPDIILAATNVGLRRHIRSLLSDLRIDPTTVGHIPDESELSECRLLLVDAPMLAGITNLSACLDRHSAAGRRVAVLTPLNCDAVVGVLPEAVLLYKPVRLTSIRALVDAVDGVSTSTGEQRTGSDGAQSTPPLRGLRVLIAEDNQVNQVVFQAMLAQAEADCSIARNGQEALDALAEHKFDVVLMDVQMPVLDGISAVRELRARESSNPGSGRTTVVAMTANTEPQDIAQCRSAGMDDFLPKPFSIGQLTSVLARHAHRSPAAAGQALATGAAASTLK

SEQ ID NO: 2588 - protein, 259 aa, Pseudomonas putida
MIQIEALPAFSDNYIWLLQDTAKRRCAVVDPGDAGPVERWLAANPEWVLSDILVTHHHNDHVGGVERLRQLTGARVCGPANERIPGRDLALDEGDRVDVLGVTFQVMAVPGHTLGHIAFFSDQPATPILFSGDTLFAAGCGRMFEGTPEQMQPALARLAALPEQTQVYCAHEYTLSNLRFAKAVEPTNPHVQQRFEDVTRLRAENRISLPSTIGLERLTNPFLRTAETLVKQKADEWKGHSNNSHVAVFAALRSWKDTF

SEQ ID NO: 2589 - protein, 685 aa, Idiomarina loihiensis
MKHWAVKKCALALMCVVPVAVAIPPEHKISELPELEQEAQHDTASERIASYFTRYHFSSLTLDNELSEQIHERYFDLLDYSKMFLLKEDIEAAQEYRHLFDDMLKRGELDVAYDIYQKSLERRFQRYEYALSILDEDKPMDFSVEGDKYYYDREDADWAESKEELDELWQNRVKYDALNLKLAGKEWPEIVETLGKRYNSALNRLTKSKSEDVFQTVMNAFARSVEPHTSYLSPSNSERFQQNMNLELEGIGAVLQSEYDYTIIRSLVPGGPADKTDELSPEDKIIAVGQGSGEDEEEFVDIIGMRLDDVVELIKGPKGTTVRLQVLKASQGAGGTPSEVEIVRDKVKLEDRAAKAEVKEFEEGPYKGRRLGVIEIPGFYNNLTADVKKLIEDLESQKVEGLVIDLRGNGGGALTEAIGLSGLFIDKGPVVQVSDGRGRVDVSEDKDGKTYYDGPLFVMVDRYSASASEIFAAAMQDYERALIIGENTFGKGTVQQHRGLARRFDFYDKPLGSVQYTIAKFYRIDGGSTQLRGVQPDVVFPSFVEASDWGESKEDNALPWDKIDKASYSPVGEINSAEVKDLQQQLNQRIEDDPEFSYIFEEIERYREEKDKTWVSLVLTEREKKQEQQKAKQLERVNERLKRAGKEPIENVEDAPDEFTEVDPFLDQAALVAFDFIDKNQLASN

SEQ ID NO: 2590 - protein, 489 aa, Unknown
  Synechocystis sp. PCC 6803
MKHVPPTVLVWFRNDLRLHDHEPLHRALKSGLAITAVYCYDPRQFAQTHQGFAKTGPWRSNFLQQSVQNLAESLQKVGNKLLVTTGLPEQVIPQIAKQINAKTIYYHREVTQEELDVERNLVKQLTILGIEAKGYWGSTLCHPEDLPFSIQDLPDLFTKFRKDIEKKKISIRPCFFAPSQLLPSPNIKLELTAPPPEFFPQINFDHRSVLAFQGGETAGLARLQDYFWHGDRLKDYKETRNGMVGADYSSKFSPWLALGCLSPRFIYQEVKRYEQERVSNDSTHWLIFELLWRDFFRFVAQKYGNKLFNRGGLLNKNFPWQEDQVRFELWRSGQTGYPLVDANMRELNLTGFMSNRGRQNVASFLCKNLGIDWRWGAEWFESCLIDYDVCSNWGNWNYTAGIGNDARDFRYFNIPKQSQQYDPQGTYLRHWLPELKNLPGDKIHQPWLLSATEQKQWGVQLGVDYPRPCVNFHQSVEARRKIEQMGVIA

SEQ ID NO: 2591 - protein, 424 aa, Arabidopsis thaliana
MASQGCVDWQFSGSDAAEKAAQASLGTYSSEIFSLCDPQGKPILPPLSEEAETSHTAEKAVVKAVLCGTGNAYAPSIGLPVAKRAVAEYLNRDLDNKLTGDDVYMTVGCKQAIELAVSILAKPKANILLPRPGFPWDMVHSIYKHLEVRRYEFIPERDFEIDFNSVREMVDENTFAIFIINPHNPNGNYYTEAHLKQLATLARELGIMVVSDEVYRWSVFGSNPFVPMGKFSSIVPVITLGSISKGWIVPGWRTGWLALHDLNGVFRSTKVLKAAKEFLEITSKPPTVIQAAIPTILEKTPQDFFEKRGIFLKDKVDFGYSKLKNIPTLTCYMKPESCTFLWTKLDPLHFVDIEDDHDFCRKLAKEENLVVLPGIAFGQNNWLRHSIDMETPRLEDAFERLKSFCERHSVIVEASSLKDVNGVN

SEQ ID NO: 2592 - protein, 502 aa, Solanum melongena
MDLSKYRPSSAYDTPFLTTNAGGPVYNNVSSLTVGPRGPVLLEDYHLIEKLATFDRERIPERVVHARGASAKGFFEVTHDVSHLTCADFLRAPGVQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPINYRHMEGFGVHAYQLINKAGKAHYVKFHWKPTCGVKSMTEEEAIRVGGTNHSHATKDLYDSIAAGNYPEWKLFIQIMDPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRTWEPDRQDRYINKWVESLSDPRVTHEIRSIWISYLSQADKSCGQKVASRLLSSLQCEEDEENSWKC

SEQ ID NO: 2593 - protein, 434 aa, Chromobacterium violaceum
MKQPHRQRKTVPSGGRPETETAAAMQPVHKSQKLANVCYDIRGPVLEHAKRMEDEGHRIIKLNIGNPAPFGFFAPDEIIEDVIVNLPAASGYSDSKGLFAARKAIMHYAQQKHLPNVAMDDIIVGNGVSELIVMAMQALLDNGDEVLVPAPDYPLWTAAVSLAGGKAVHYLCDEEQGWFPSIDDIRAKITPTTRAIVIINPNNPTGAVYPPALLQQIVDVARQHQLIIYADEIYDKVLYDAVRHTSIASLAPDLFVVTLNGLSKNYRACGYRAGWMILSGEKKHAKDYIEGLNMLASMRLCANVPSQYAIQTALGGYQSIDDLVAPGGRLARQRDLAHKLLTEIPGVSCVKPQGALYLFPRLDPKVYPIADDQQFILELLQQEKVLLVQGSGFNWIAPDHFRVVFLPNSDDLIEAIGRIARFLESYRKRHGAAE

SEQ ID NO: 2594 - protein, 182 aa, Brassica rapa
VPGVPSIDKITFVLLRLDDGVVLDERVFVHDFVNLAYNMGVFMYDDLLAILSLRYQKIHLLQIRDSGHLVDARAIGYFCREDDELFLNSSSQAMMMTTTQDKNKQQNREDDGDNGLNHTQLNADNNSFLSGIKQRLLSFVFREIWNEESDNTVRVQSLKKKFYSHFQDYVDLIIWKVQFLDR

SEQ ID NO: 2595 - protein, 488 aa, Arabidopsis thaliana
MGSKLKLYPLLNHSSVFHPDSRYQSAPTMEEEQQQLRVLFAKYEMGRLLGKGTFGKVYYGKEITTGESVAIKIINKDQVKREGMMEQIKREISIMRLVRHPNIVELKEVMATKTKIFFIMEYVKGGELFSKIVKGKLKEDSARKYFQQLISAVDFCHSRGVSHRDLKPENLLVDENGDLKVSDFGLSALPEQILQDGLLHTQCGTPAYVAPEVLRKKGYDGAKGDIWSCGIILYVLLAGFLPFQDENLMKMYRKIFKSEFEYPPWFSPESKRLISKLLVVDPNKRISIPAIMRTPWFRKNINSPIEFKIDELEIQNVEDETPTTTATTATTTTTPVSPKFFNAFEFISSMSSGFDLSSLFESKRKLRSMFTSRWSASEIMGKLEGIGKEMNMKVKRTKDFKVKLFGKTEGRKGQIAVTAEVFEVAPEVAVVELCKSAGDTLEYNRLYEEHVRPALEEIVWSWHGDNHNNNIVKSNGNYVSDENSGSDC

SEQ ID NO: 2596 - protein, 720 aa, Bdellovibrio bacteriovorus
MKQRRTAECVYLKKALKCFDPGVENTVGLENQVNPFGKLVHTSLMVQATLGFDWSQTELGPIENWDFGLINSLRIVFSCPVGMYCTWGPQRRVFYNDAYIPILKHRHPHALGSPLHEVWPEVWDQVHAIASKVESGGFVLESDVQFDIEVDGKPQGNYYTYGNSPLFNAEGKVSGMLCTILDTTTSVKRNQAAEESLARSNQEVRAERRKLRSILEKAPIAMAVLDGPEHRFSMTNDSYRDLFLGDCDVTGRRVKDVFPKTEKIGLIALLDEVYRTGKVFEAKNYEIHDRRADGVEFSVFVDVVYQPIYDFNDEIEGLVLAANNVTEQVMAERALQAAKSAAENANQAKSAFLANMSHEIRTPLGVILGFAEIIGTQDLDESERKNYFEIIHRNGLSLTRIIDDILDLSKIEAGKFEIEKSPVKLKKLLQEVLTMFFDQASRKNIYLNYELGEIAPLIILSDVVRIRQVLVNLIGNAIKFTMKGSVKVSCRAEQVTATRKKIVFSIEDTGIGMTQEQAERLFQPFTQADATSTRQFGGTGLGLALSRNLARALGGDVSIVRCEPRQGCTFEFSFQAEDVSELSVAGQAESAGAVEQKPLAGFKVLAVDDSRDNRELISTVLSSWGLDVTEAESGEEALTQALKEHFDLVLMDIQMPGLDGFGTLAGLRKQGFQGPVIALTAHAMKEDKDRSFAAGFLDHLTKPINSKVLLQAIQSHLKHS

SEQ ID NO: 2597 - protein, 476 aa, Oryza sativa
MAMETTSQDSQVIMGRYKLGRLLGRGTFAKVYKAYKLATGEAVAIKVFDKEAVQRSGTVEQVKREVDVMRRVHHRHVIRLHEVMATRSRIYFVMEYASGGELFTRLSRSPRFPEPVARRYFQQLITAVEFCHSRGVYHRDLKPENLLLDARGDLKVTDFGLSALDGGLRGDGLLHTTCGTPAYVAPEVLLKRGYDGAKADIWSCGVILFVLLAGYLPFNETNLVILYRNITESNYRCPPWFSVEARKLLARLLDPNPKTRITISKIMDRPWFQQATCPLGDMSLVASAPSVLLARKEASQQHDDEEDDGFAREKKKRSNVIMSSPVIDVRPSSMNAFDIISRSRGLDLSKMFDAEERRSEARFSTRETTTAIVSKLEEIAEAGRFSFKLKEKGRVELEGSQDGRKGALAIEAEIFKVAPEVHVVEVRKTGGDSPDFRDFYKQELKPSLGDMVWAWQGGDSPPLVPAAGRRPITKRS

SEQ ID NO: 2598 - protein, 154 aa, Castanea sativa
MALSLFGGRRSNVFDPFSLDIWDPFEGFSAVANVPPSARETTAFATARIDWKETPEAHIFKADLPGLKKEEVKVEVEDGNVLQISGERSKEHEEKNDKWHRVERSCGKFLRRFRLPENAKVEQVKANMENGVLTVIVPKEEQKKTEVKSIEISG

SEQ ID NO: 2599 - protein, 154 aa, Glycine max
KDAREGDDNLSTVHHELHFTVQECIDALGEVIYHIETYDVTTIRASTPMFLMSRKIKSLGVKMVISGEGSDEIFGGYLYFHKAPNKKEFHEETCRKIKALHLYDCLRANKATSAWGVEARVPFLDKSFISVAMDIDPQWKMIKRDSVQIEKWVT

SEQ ID NO: 2600 - protein, 584 aa, Bordetella pertussis
MNEPAPLGATVCAPGKIRFRLWAPSAPPALALEIEGRAPIALRPGPDGYAQAIVDGAPGLRYRYRLAADCVVPDPASRLQDGDVHGHSVVVGPDRYPWRHTGWRGRPWQDSVIYEAHAGLCGGYAGLRRRLPEVARLGVTLLELMPIADFPGPRNWGYDGVLPYAPDTAYGTPDELKALIDAAHGLEMGVMLDVVYNHFGPDGNYLHRYAADFFDARADTPWGAAIDYRQQAVQRYFIDNALYWLRKYRFDGLRLDAVHAMGRTDWLAGLAREARAACPDRRVHLVVENDANQASLLEQGFDAQWNDDAHHVLHHLLTGERQGYYADYAQAPAALLARALGEGYVYQGQAAPTRGGRARGEPSAHLPPWAFVLFLHNHDQVGNRADGLRLTSLLAPGSPALRAAIALQLLAPHIPLLFMGEEYGSTAPFFYFTSHGPELAAAVRAGRAREFAASMHDCDPPPDPNDPDTYRRSCPWPPPGAERQAWFEYYRELLRLRARLLGERLTGARADGAAALGPAAVRAAWRLGDGARLTLYANLLPGSVIVPAPPAGQLAYATLAGAGQDLVAGVLRGGCALALWEPAP

SEQ ID NO: 2601 - protein, 280 aa, Listeria monocytogenes
MTLSFSDTYRLNNGIEMPRHGFGVYKLTDEARMRTALETAVDVGYRLFDTASFYHNEKELGDFFASSGLKRDEFFVTTKMWNTEQGYDETLRAFEKSQKKLQLDKIDLYLVHWPKQDTFFDTWRAVEKLYDEGLVRAIGVSNFEAHHLDRLRTSANVLPVVDQLETHPHFPNHLLHRYLEELHIVHQAWSPLGRGGVLQEQILIDLAEKHGKSPAQIVLRWHLQNNISIIPKSETPSRIRENAAIYDFELSEADMRQVERLNTGERVSHAPDVMYVRSEI

SEQ ID NO: 2602 - protein, 731 aa, Bordetella pertussis
MMRDSPSIQGTLDAATQHALLAGRHADPFSVLGPHQAGAHTVVRVLAPGARTVMAVLPGGQRTPLLPMQPGLFENTVPGLQPGAPAAYRLCIEWEGGIQHTADPYAFGPVLDAAQLDHCAAGGWRYLAGLLGAHAASVDGCAGTRFALWAPNARRVAVVGDFNGWDGRRHAMRLRYPAGVWELFLPDVGPGARYKFQVLGADGHTVLKADPLARQAEAPPATASIVPDERPFAWTDKAWMEQRAARQRCDAPISIYEVHAGSWFDDAGAPRWQNLAARLPEYARSLGFTHIELLPVMAHPFGGSWGYQPLGLFAPAAAHGAPADFAHFVDRCHEAGLGVILDWVPAHFPDDAHGLARLDGTPLYEHADPREGRHPDWNTLIYNYGRREVRTFLIASAIHWLRHYHVDGLRVDAVASMLYRDYSRPAGQWIPNRHGRRENLEAIDFLRELNAAVGVQCPGAITVAEESTAWPGVTAPVANGGLGFDYKWNMGWMHDTLRYMRRDPIHRRHHHHDLSFGMVYAYAERFVLPLSHDEVVHGKGSLLGKMPGERAAQLAQLRLYYAFMWAHPGKKLLFMGGEFGQQGEWNHDAMLQWSLLDDPAHRGLQRLVADLNHVYATLPELHCRDADPSGFAWIVGDDADNSVLAFARVDASHCLVAVCNFTPVPRPGYRFGVPHAGDWRVRVDTGATRYGGAGGGPPICLRSEPIPAHGHPQSLVLDLPGFTALYLRHSE

SEQ ID NO: 2603 - protein, 394 aa, Pseudomonas putida
MWYNGLLDLSAWQLVGITLLMTHVTIVSVTVYLHRYSAHRALELNGALKHFFRFWLWLTTAQNTREWTAVHRKHHAKCETPDDPHSPVYKGLGTVLRKGAELYREEARNPETLRIYGKNCPDDWIERNLYSRYKLGGIALMAVIDLLLFGTIGITIWAVQMMWIPFWAAGVVNGLGHALGYRNFECRDAATNLVPWGIVIGGEELHNNHHTYPNSAKLSVKRWEFDMGWAWIRLFCLLRLAKVQRVAPIAHRVAGKASLDMDTAMAILNNRFQIMAQYRKLVIGPLVKQELARVDASVRHRFRRAKRLLSRETSLLEDRHHVRIESMLAHSQALKTIYEKRLALQQIWARTSANGHDMLAAMKDWVHEAETSGIQALRDFAAQLKTYSLRPTGA

SEQ ID NO: 2604 - protein, 478 aa, Buchnera aphidicola
MNVNLMWFRNDLRLSDNSALHFSCRNNASTVLALFIATPKQWERHCLAPKKKMLIYKNIVALKKKITELGIIFYYYESTDYLESTNYIIEFCKIHKVTSIFFNLEYEFYERQRDKIIKKKLKKNNIIINCFHDSVLITPGSIKNSYGKMYKKFSYFKYKCIKQLQLNIPSCFPKPQNKNLHDHYSLDFTIPIFHTYLEKFDANIFPIGEDIVYEKLKFFIKYAFNKYNFDQEIFELNSTSMLSAHLSIGVISPRQCVTLLFKEYPDIIHKLEECKWINELLWREFYQHLLYFYPNIGQNQSLYHWENRIKWDNNLYYLNLWKQGNTGYPIIDAGMRQLKQLGWISNRLRMITASFLVKNLLIDWRKGEEYFMSQLIDGDFASNNGNWQWIASVGTDSMPYFRIFNPMLQSKKFDINAKFIRKYIPELSNVSTYNIHNPCDNNKTNKIHSKYPQPIINYYHSKKKTLLVFKHAKCSNKL

SEQ ID NO: 2605 - protein, 170 aa, Triticum aestivum
  misc_feature (89)..(89): Xaa can be any naturally occurring amino acid
RIIYAARGIFNRFIPDVHIDKDHRSGSAGGRSPGYGVTLVAETTTGCLLSVDVTVSCPIVDEINEESEKPELTSPEDLGVQAASMLLEXVAQGGVVDSTHHGLLFILCALCPPDVSKVPVGQLTPYGIETLRNIRDFLDVKFIIKPDPNSNTVTLKCVGAGVKNLARKIS

SEQ ID NO: 2606 - protein, 155 aa, Brassica napus
QTDILYDSGKSLNPAVDLGQIEGAFVQGLGFFMLEEYITDSEGLRLTDSTWTYKIPTVDTIPRQFNVEILNSGRHEKRVLSSKASGEPPLLLAASVHCATREAVKEARKQLRMWKGVNDSELMFQLPVPATMPVVKELCGLDIVESYLEWPPSVN

SEQ ID NO: 2607 - protein, 353 aa, Burkholderia fungorum
MPTLFDPLQIGDITLPNRIIMAPLTRQRAGEIRVPNALMAKYYAERATAGLIISEATSVTPQGVGYADTPGIWSQEQVEGWKLVTSAVHAAGGRIFLQLWHVGRISDPLFLNGELPVAPSAIAAQGHVSLVRPERAYVTPRALELDEIAGVVEAFRKGAENAKAAGFDGVEVHGANGYLLDQFLQDSTNKRTDAYGGPIENRARLLLEVTDACIGVWGANRVGVHLAPRRDSHTMGDSDPAGTFGYVARELGKRKIAFIAAREALGDDRLGPQLKKAFGGPYIANEKFTTETAQQVLDAGEADAVAWGQLFIANPDLVRRFATNAPLNKPNPATYYARGETGYVDYPTLETVE

SEQ ID NO: 2608 - protein, 256 aa, Arabidopsis thaliana
MLFPHERKKEKERSQGFYLVTRLRIRMGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 2609 - protein, 592 aa, Bacillus anthracis
MAETLAKRGPDDNKVWIKGNVAFGHKRLIVVDPEGGKQPMTCLKDEANYAICYNGELYNTEDIRKELLRRGYTFKGHSDTEVLLASYIEWKEECVDHLNGIYAFAVWDEQKEQVFIARDRLGVKPLFYKYDSGRLLFGSELKAILAHPDVKAEVTLEGLSEIFGLGPSRTPGHGIYTGIKELRPGHAMTFSKNGLCIWRYWNVESKKHEDSFEETVEKTRFLLQDAITRQLVSDVPLCTFLSGGVDSSAITAIAAKEYEKSGKGQLHTYSVDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQQRYEESIQEVPILDGESPLEAKRRQLFYLNMVWFMTTLLDRKDRMSMGASLEVRVPFADHRLVEYAWNIPWEMKMYKNREKGLLRKALEGLLPNDILYRKKSPYPKTHNPHYTKAVTVWIQDLLTDKGSILHELFDKEQLSGLIESGGSAFQTPWYGQLMTGPQLLAHLAQIHVWFKEYGVNIKE

SEQ ID NO: 2610 - protein, 678 aa, Ralstonia eutropha
MQLNQLTLRNRIVSTAHAEVYAEPGGLPGDRYIRYYEEKAKGGVGLAICGGSSPVSIDSPQGWWKSVNLSTDKIIDPLSRLAETMHRHGAKIMIQATHMGRRSAFHGEHWPHLMTPSGVREPVHRGNAKIIEVEEIRRIIADFAAAAKRVKDAGMDGIEISAAHQHLIDQFWSPRTNFRADEWGGSLENRMRFGVEVLQAVREVVGKDFCVGLRMCGDEFHEDGLDHEQLKEIAQAMSESGLVDYIGVVGSGADTHNTLANCMPPMALPPEPFVHLAAGIKSVIKVPLMHAQSIRDAGQAERLLANGMVDLVGMTRAQIADPHMVIKIRDGREDEIKQCVGANYCIDRQYNGLDVLCVQNAATSREATMPHIIEKSRGPKRKVVVVGAGPAGLEAARVARSRGHDVVLFEKNTEVGGQILLAAKAPQREQMQGIVRWFDMETKRLGVDRRLGVEADAKMIMAEKPDIIVLATGGRAFSDQVPGWAVAEGLAVSSWDVLAGRVEAKENVLVYDGVSTHAGAGVADYLASRGAKVEIVTPDVKVADDCGGTTFPIFYRRLYAQGVIHTPNYWLDRVYEEGGKKIAVLRNEYTEELEERAVDQVVIENGSTPNDALYWKLKPESLNRGQVDVHKLFASEPQPSLSETLGNGRFLLFRVGDCISMHNIHGAIYDALRLVKDF

SEQ ID NO: 2611 - protein, 488 aa, Bacillus anthracis
MNPNNRLTTNQGAPVGDNQNSRTAGRRGPVLLEDYHLVEKLAHFDRERIPERVVHARGAGAHGVFVTKNSMKKYTKAAFLQNEGTETPVFVRFSTVIHGQGSPETARDPRGFAVKFYTEEGNYDIVGNHLPVFFIRDAIKFPDMVHSLKPAPDTNIQTPDRYWDFMTLSPESTHMMTWVFSDYGTPASYREMEGFGVHSFKWINAEGKIVYIKYHWKPQQGVRNLSAKEVQEVQGKDFNHATRDLFDAIEKGNYPKWDLHVQVMQLEETDSLDFDPLDPTKVWPEDRFPLMEVGTMTLNRNPKNFFAEVEQVAFSPSATVNGIEPSEDKLLQGRLFSYPDTQRYRLGANYLQIPVNCPYAAVHNQQRDGAMQINQNPSTINYEPSRHAENPVEDPAYRDSTMKVEGYVSREKIDKPNDFKQAGERYRSFSKEEQDNLIANLTSDLKDVNERTKLLAVCNFFRADQEYGMRLAQALNVDITQYVGNAPK

SEQ ID NO: 2612 - protein, 831 aa, Arabidopsis thaliana
MSEPKVRRWVGKYEVGRLIGECNFGKLRSAVDTETGDPVALMILDKDKVLKHKMAEQIKREISIMKLINHPNVVQLYEVLASKAKIYIVLEFISGGKLFDKIKNDGRMNEDEAQRYFQQLINAVDYCHSRGVYHRDLKPENLLLDAQENLKVAEFGLIALSQQAGGDGLRHTACGNPDYAAPEVLNDQGYDGAKADLWSCGVILFVLLAGYLPFEDSSLTTLYKKISSADFSCPPWLSSGVKNLIVRILDPNPMTRITIPEILEDVWFKKDYKPAVFEEKKEANLADVEAVFKDSEEGRVQLRSFPCVICSGGTTCGDVRSRTKLMNGLIERGRPQEAHSIFNTLIEEGHKPSLITYTTLVTALTRQKHFHSLLSLISKVEKNGLKPDTILFNAIINASSESGNLDQAMKIFEKMKESGCKPTASTFNTLIKGYGKIGKLEESSRLLDMMLRDEMLQPNDRTCNILVQAWCNQRKIEEAWNIVYKMQSYGVKPDVVTFNTLAKAYARIGSTCTAEDMIIPRMLHNKVKPNVRTCGTIVNGYCEEGKMEEALRFFYRMKELGVHPNLFVFNSLIKGFLNINDMDGVGEVVDLMEEFGVKPDVVTFSTLMNAWSSVGDMKRCEEIYTDMLEGGIDPDIHAFSILAKGYARAGEPEKAKQILNQMRKFGVRPNVVIYTQIISGWCSAGEMKKAMQVYKKMCGIVGLSPNLTTYETLIWGFGEAKQPWKAEELLKDMEGKNVVPTRKTMQLIADGWKSIGVSNSNDANTLGSSFSTSSKLNIPNNIASSRSPLFLKGMPEKPKLCIKSQFGLRQTLLVVLCRDQIGEAGRFCKFM

SEQ ID NO: 2613 - protein, 536 aa, Moorella thermoacetica
MAKQVVFDREAREALEKGITKLTEAVRVTLGPRGRNVVLEKKFGAPTITNDGVTIAKEVELEDPLENVGALLVREVASKTNDVAGDGTTTACVLAQAIVREGMKNVAAGANPMFMKRGIEKAVAAVVENLKAQARPVETKDSISQVASISANDPQIGALVADAMEKVGKDGVITVEESKGMETAVDVVEGMQFDRGYISPYMVTDNERMEAVLEEPYILITDKKITAVADLVPVLERVVRTGKPLLIICEDMEGEALATLVVNKIRGTFTCVAVKAPAFGDRRKAMLQDIAILTGGQVITEEAGLKLENTTLDMLGQARQVRVGKEETTIVEGRGKEEAIEARIAQIRREYEESTSDYDREKLQERLAKLAGGVAVIKVGAATETEMKEKKMRIEDALAATRAAVEEGIVPGGGTALVRAQTALDGVQAQGDELTGVRLVYRALEEPMRQIAANAGVDGSVVVEKVRQSGDSMGFNAATREYVNLFEAGIVDPLKVTRSALENAASIASLVLTTESLIADIPEEEPPVPGGGMPPM

SEQ ID NO: 2614 - protein, 138 aa, Glycine max
MYRSSNIVARIFDRQICTPAPGTSVHHARRFYENLVPSYTVYEVECPDHSFRKFTDDGQYLISFSRNHQELIVYRPRWLSFSCKDEDCDKHDLPSRAKRFDSFFSQLYCVPLASCNELICKDFFLYMESNLSGLYATP

SEQ ID NO: 2615 - protein, 647 aa, Unknown
  Azoarcus sp. EbN1
MNMHYRDTGIPARKSPELEYGGLRPGRPSHHGPSHHMHRMPFGPERIDEHDESAGYRFRLWAPATKHVELCLVTPSGAKHYVPCAKSEGWHSCRVGEARAGDLYMFRLDGQLEVPDPASRFNPQDVHGPSLLVDPRQFGWEDGAWHGRPWHEAVIYELHVGTFTPEGRYDAAERRLAELARLGVTAIELMPLADFPGSRGWGYDGVLPFAPDAAYGSPDELKHFVQSAHRLGLMVLLDVVYNHFGPDGNYLQVYTPQFFTTEHATPWGGAIAFDGVASATVREFFIHNALYWLEEYRFDGLRLDAVQSIFDASPSHILEELSMWVRARAIHRQLHLVLEHVDNEASRLGVPQATGSYDAQWNDDFHHAAHVLLTGERDGYYADYADHPVRHLVRCLAEGFAYQGELSPFHGRPRGEPSAALPPTAFVNFLQNHDQVGNRAFGERLVTLAPPERLRAVVALQLLAPSPPLMFMGEEAGVTTPFLYFCDYQGELATAVREGRKREFAGFERFSTAGEGRHEIPDPCAEETFVASKLDWSARESEAGQQWLSFYRELLGLRHQFVVPRVPQIVAGACTTTMHGDEAFEIRWPCADGAALVLRANLSDTPVTFDRLEVAPFASLGPDADELRQFAPCSVRAYVVPSGRAGT

SEQ ID NO: 2616 - protein, 546 aa, Allochromatium vinosum
MSAKDVKFGGDARVRMMEGVNILANAVKVTLGPKGRNVVLEKSFGAPTVTKDGVSVAKEIELKDKFENMGAQMVKEVASKTSDIAGDGTTTATVLAQAMVREGLKAVAAGMNPMDLKRGMDKAVEAATEELKKLSKPCPRPMAIAQVGTISANSDDSIGTIIAEAMEKVGKEGVITVEDGTSLQNELDVVEGMQFDRGYLSPYFINNQQSQSAELDAPYILLYDKKISNIRDLLPVLEGVAKAGKPLLIIAEDVEGEALATLVVNTIRGIVKVCAVKAPGFGDRRKAMLQDIAILTGATVISEEVGLSLEKATLTDLGTAKRVQVGKDETTIIDGSGSEIDIKARCEQIRAQVEETSSDYDREKLQERLAKLAGGVAVIKVGAATEIEMKEKKARVEDALHATRAAVEEGIVPGGGVALVRAIAAVKDLKGANHDQDVGIAIARRAMEEPLRQIVANAGEEPSVILHKVAEGTGNFGYNAANGEYGDMVEMGILDPTKVTRSALQNSCSVAGLMITTEAMIADEPKDDAPAMPGGGMGDMGGMGMM

SEQ ID NO: 2617 - protein, 479 aa, Bacillus subtilis
MGNMPKDFLWGGALAAHQFEGGWNQGGKGPSVVDVMTAGAHGVPRKITDTIEENEFYPNHEAIDFYHRYKEDIALFAEMGLKCLRTSIGWSRIFPKGDEAEPNEAGLQFYDDVFDELLKHGIEPVITLSHFEMPLHLAREYGGFRNRKVVDFFVNFAEACFTRYKDKVKYWMTFNEINNQMDVNNPLFLWTNSGVVVGENENAKEVMYQTAHHELVASALAVAKGKDINPEFQIGAMVSHVPIYPFSSNPEDVMLAEEEMRQRYFFPDVQVRGYYPSYALKEFEREGYNITFEDGDDEILRNGTVDYLGFSYYMSTTVKSDVKNDNTGDIVNGGLPNGVENPYITSSDWGWAIDPTGLRYTLNRFYDRYQIPLFIVENGFGAVDTLEEDGKVHDPERIQYLKSHIEALKKAVTYDGVDLIGYTPWGIIDIVSFTTGEMKKRYGMIYVDRDNEGNGSMKRYKKDSFEWYKNVIQTNGEEL

SEQ ID NO: 2618 - protein, 542 aa, Cytophaga hutchinsonii
MAKQILFDRDAREKLKKGVDALADAVKVTLGPKGRNVILDKKFGSPAITKDGVSVAKDIELKDAIENMGAQLVKEVASKTADQAGDGTTTATVLTQAIFNAGLKNVAAGANPMDLKRGIDKAVSAIIADLKVQSKKISNSNEIAQVATISANNDHEIGKMIAHAMDKVGKDGVITVEEAKGTETEVKTVEGMQFDRGYLSPYFVTNTDKMEVELDRPYILIYDKKVSSMKELLPILEQVVQSGRPLLIIAEDVDGEALATLVVNKIRGALKIAAVKAPGFGDRRKAMLEDIAILTGGTVISEESGYKLENATLEYLGTAEKINIDKDNTTVVNGSGLKDNIVARVNQIKSQMENTTSDYDREKLQERLAKLSGGVAIMYIGAATEVEMKEKKDRVDDALHATRAAVEEGIVPGGGVALIRAGAALDNVAFHNEDEKTGIQIIRTAIESPLRAIVYNAGLEGSVIVQKVKEGTGDYGYNAREDRYEAMIAAGIIDPTKVTRLALENAASVASLLLTTECVVADEPEEKSAMPPMGGGGMGGMM

SEQ ID NO: 2619 - protein, 445 aa, Arabidopsis thaliana
MQRFCVCSPSSYRLNPITSMATGSGSLIWFRKGLRVHDNPALEYASKGSEFMYPVFVIDPHYMESDPSAFSPGSSRAGVNRIRFLLESLKDLDSSLKKLGSRLLVFKGEPGEVLVRCLQEWKVKRLCFEYDTDPYYQALDVKVKDYASSTGVEVFSPVSHTLFNPAHIIEKNGGKPPLSYQSFLKVAGEPSCAKSELVMSYSSLPPIGDIGNLGISEVPSLEELGYKDDEQADWTPFRGGESEALKRLTKSISDKAWVANFEKPKGDPSAFLKPATTVMSPYLKFGCLSSRYFYQCLQNIYKDVKKHTSPPVSLLGQLLWREFFYTTAFGTPNFDKMKGNRICKQIPWNEDHAMLAAWRDGKTGYPWIDAIMVQLLKWGWMHHLARHCVACFLTRGDLFIHWEQGRDVFERLLIDSDWAINNGNWMWLSCSSFFYQALSPFCFSF

SEQ ID NO: 2620 - protein, 155 aa, Ipomoea nil
MDLRLMGFDHPLFHHIMDYAGDDKSSNSSAPSRTFMLDAKAMAATPADVKEYPNSYVFIIDMPGLKSGDIKVQVDGDNVLSISGERKREAEEKEGAKYVRMERRVGKLMRKFVLPENANKEKITAVCQDGVLTVTVENVPPPEPKKPRTIEVKIG

SEQ ID NO: 2621 - protein, 187 aa, Triticum aestivum
MSTSSGAKEAPANNPGLQAEADPATKGYIMQQTMFRVKDPKVSLDFYSRVMGMSLLKRLDFAEMKFSLYFLGYEDLSAAPADPVQRTGWTFGQKATIELTHNWGTESDPEFKGYHNGNSDPRGFGHIGVTVDDVYKACERFERLGVEFVKKPDDGKMKGIAFIKDPDGYWIEIFDLKRIGEVTATAS

SEQ ID NO: 2622 - protein, 124 aa, Zea mays
  misc_feature (10)..(11): Xaa can be any naturally occurring amino acid
  misc_feature (115)..(115): Xaa can be any naturally occurring amino acid
HASSNTLDGXXGFDGTDTHYFHSGPRGHHWMWDSRLFNYGNWEVLRFLLSNARWWLEEYKFDGFRFDGVTSMMYTHHGLQVTFTGNFNEYFGFATDVDAVVYLMLVNDLIHGLYXEAVTIGEDV

SEQ ID NO: 2623 - protein, 167 aa, Ipomoea nil
MDLRNFGLSNFGLEPQLLSTIQDMLDFADDHDRAGRAPPEQPIRAYVRDAKAMAATPADVKEYPNSYVFIADMPGVKAAEIKVQVEDDNVLVVSGERTEREKDEKDGVKYLRMERRVGKFMRKFVLPENANVEAINAVYQDGVLQVTVEKLPPPEPKKPKTVEVKVA

SEQ ID NO: 2624 - protein, 126 aa, Clostridium perfringens
MASKMLHTCIRVKDLDKSLKFYKEALGLVETRRRDYPEYKFSLVYLSDKEDGYEVELTYNYDQEKPYNLGNGFSHIAVGVEDIEAERERHISLGYEVTPMKGLSDGAATYYFVTDPDGYKVEVIKL

SEQ ID NO: 2625 - protein, 124 aa, Zea mays
  misc_feature (48)..(48): Xaa can be any naturally occurring amino acid
  misc_feature (109)..(109): Xaa can be any naturally occurring amino acid
HASSNTLDGLNGFDGTDTHYFHSGPRGHHWMWDSRLFNYGNWEVLRFXLSNARWWLGEYKFDGFRFDGVTSMMYTHHGLQVTFTGNFNEYFGFATDVDAVVYLMLVNDXIHGLYPEAVTIGEDV

SEQ ID NO: 2626 - protein, 269 aa, Brassica napus
  misc_feature (93)..(93): Xaa can be any naturally occurring amino acid
MHIYIKERKLQSNKNKMGRGRVELKRIENKINRQVTFAKRRNGLLKKAYELSVLCDAEVALIIFSNRGKLYEFCSSYNMIKTLERYQKCSYGXSIEVNNKPAKELENSYREYLKLKGRYEGLQRQQRNLLGEDLGPLNSKELEQLERQLDGSLKPVRPVQTQYMLDQLSDLQSKEQMLLETNRALAIKLDDMIGVRSHHMGGGGGWEGNEQNVPYEHHHQAQSQGLFQPLECNPTLQIGYDNPVGSEQITTTTQAQAQPGNGYIPGWML

SEQ ID NO: 2627 - protein, 460 aa, Pediococcus pentosaceus
MKGKLPDNFLWGNSTSSMQTEGGVHEGGKGPSVYDTYEATETTSNWDVAIDNYHHYEEDLDLMANQGMNCYRFQISWSRVNPTGDGDFNEEGIQYYDRLINDLLKRGIKPMICLYHFDMPLHLAEKYNGFMSRHVVDAFVRFGKKMVDCFSDRVKLWVTFNEQNLYSQTEAFHIAGYLKGDQTDEELQLIAHHVMTAHAQVANYVHETSDAQIGGMLAYVESYPKNCRPRDVYVARQIDEFLNRNLLEAWVHGHYSTEVTQYIKNHHFDIDFTEQDQIAFEKLKSDFISFSYYASNVVDSTKIPQGTMPNRYLDYGGVENPYLKATDWGWNIDPLGFRDVITKTYNEYGIPMFPIENGIGYREKFDGTEIQDDYRIEYHRDHIQAMIDAVVEDGVPVLGYLGWGLIDIPSSSGNMEKRYGMVYVNRGNHELRDMKRVPKKSYKWFKKVIETNGNDLENDL

SEQ ID NO: 2628 - protein, 492 aa, Oryza sativa
MDPYKHRASSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPGFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 2629 - protein, 220 aa, Thermococcus litoralis
MKKVLITGFEPFGGDSKNPTEQIAKYFDRKQIGNAMVYGRVLPVSVKRATIELKRYLEEIKPEIVINLGLAPTYSNITVERIAVNIIDARIPDNDGYQPIDEKIEEDAPLAYMATLPVRAITKTLRDNGIPATISYSAGTYLCNYVMFKTLHFSKIEGYPLKAGFIHVPYTPDQVVNKFFLLGKNTPSMCLEAEIKAIELAVKVSLDYLEKDRDDIKIPL

SEQ ID NO: 2630 - protein, 632 aa, Archaeoglobus fulgidus
MKLFEPIEFGGMKVKNRIVLPAVGLNYTTPDGRVTDKLLRFYEERAKGGIGFAVVGIAKIEPHFFGGIAAHSDEFIPDLKKIADVFHKYDVKCALQLWHPGRYEISFDPNRQPVAPSPIPPPIFTKRTPKELTKEEILQIEEEFADAAVRAKKAGFDAVELIGSAGYLISQFFSPATNKRTDEYGGSLENRTRFAVEIIQKIKEKCGESYPVMIRIPGDEFIEGGNTVREMKQIAKILEDAGVVAINVMAGWHESRKPLTTMLVPRGGFAYLAAEIKSAVSVSVIASHRINDPIVAEKILQEGKADMVAMLRALIADPELPKKAKEGRFDEIRYCVACNQGCMDMVMQAQPVTCLVNPIVGREAEFENLKAEKPKKVVIVGGGPGGCMAAEMLARKGHKVVLFEKTDKLGGQLNLAAKSPLGYEFAEVGKYFMNVLPKLGVEVRYNTEADAGKVLAENPDVAVIAVGASPLIPPIPGVENAVTAFDVLAGRAEVGNSVVVIGGGGVGCDVAAELANEGKKVTIVEMLPKIGQDIGISTRWTVLMYLKEKGVEMLTNTKAVEIKPNAVVVEQNGERKELQCDTAVIAVGTKPNNGLYDELQGKVSELYKIGDCVKPRKALDATREGAELALKV

SEQ ID NO: 2631 - protein, 474 aa, Trichodesmium erythraeum
MSNLILFWHRRDLRISDNVGLTQASQEGQTVVGIFCLDENILKRDDIASARVTYMIGCLQHLQKRYKQIGSQLLIMSGKPIEAIPKLATFLEAKAVYWNLDVEPYSRKRDRQVKENLEAANIQVKTFWEQLLHSPEEIFTSTKKPYSVYTPFWKNWQGKKKSNPLNTPVLKGLTEDQLQYTKKIGVIDLPTAKQLGFNWDNKLILEPGETAALEKLEKFSNGAISSYQEQRNFPSLDGTSQLSVALKFGTIGIRTVWAKTQELIENCYSSEVFENIETWQKEIAWREFYQYVMYHYPELETGPYREHWKNFPWKNNKAHFQAWCEGNTGYPIVDAAMRQLNETGWMHNRCRMIVASFLTKDLIINWQWGEKYFMQNLIDGDLCANNGGWQWSASSGMDPKPLRIFNPVSQTQKYDPEGEYIRQWVCELRSVDTQYLVTGKIPAEEREAIGYPLPIVDHKKQQQLFKDLYREQKN

SEQ ID NO: 2632 - protein, 476 aa, Bacillus cereus
MQNKIIVMFQKDFRLYDNPALFEAVQSGEVLPVYIQDETFSIGSASKWWLHHAVIDVKKQLEALGSTLIIRKGRTEEEILSLIEQLDITAVYWNICYDPDRLQSNQKMKMMLEDKGIICKEFNSHLLLEPWIIKKKDNTEYKVFTPFYNAFQKQVIPKPFSRVQSIKWGNSLPASLSVSELQLLPIIPWTSHMEVIWDPTEEGAYKTFKKFFSSKLVSYSEGRDFPGQNVHSMLAPYLSFGQISVKLMFHYLINKSTERQCSLFEKQVNSFIRQLIWREFSYYLLYHYPFTVYKPLNKSFENFPWDKEEELLRVWQKGKTGYPFIDAGMRELWQTGFMHNRARMAVASFLVKHLLIPWQEGAKWFMDTLLDADIANNTMGWQWVAGSGADASPYFRIFNPITQGEKFDKNGEYIRRWVPELRDIPNKYIHKPWEAPEHILQKSNIKLGDTYPFPIVDHKAARERALCAYKSMKEFV

SEQ ID NO: 2633 - protein, 192 aa, Oryza sativa
MASDGAAATPAKASPKKANLLDPHSIKHLLDETISDVVKSKGYAEDTRLGNWKLAIGAAVIAIALLAQFYPKKFPQNREFLLGCIALYVVLNVVLLILSYTKEKDAIMFTHPPAGSFNSTGLVISSKLPRFSDMYTITIASADPQSISANKPVHFTKSVTKWFTKEGVLVEGLFWKDVERLIDDYNTERKGK

SEQ ID NO: 2634 - protein, 373 aa, Xylella fastidiosa
MGDRILLDTLDTDISDKNKPVRLYCYHINTAGVKKEFEFDLPAPPLGAQQTAVPSGDHVLHIARFDQGEIQALKHVSEDRNSSITQLHYISLGAVTTALHLPKNKVIDVVKDSEADKAGVEIGSFIGNGTNIKAGPENIGGKKVIKTDSRYEVVLPDGRKVTFSINKIIPKLNDIEGIRSAQLIGKTLVITFNEMSDENTQWALQQIKNTPATAILLDLRYNTGGSGIAGEKLLAGFLASGTRIATEIRGKKTNEINVPAGYTPTDKPTAVLISLLSASGAELAARTLQFHHRARIYGAQSSGQVLTSRFYKLTDGTYMQIADTNLLDPAGKPIEWYGVMPDVKKWKTLSDVRAGRDPVLECALTDLSGGQCH

SEQ ID NO: 2635 - protein, 327 aa, Psychrobacter arcticus
MTTLAQYLNTNAASPALNDVITTVTDVGKTISQLLRKGALADILGEAGNQNVQGEDQKKLDVLANDLLLDALAKNTHCAGVASEELDDAIPANAEGSLLVLFDPLDGSSNIDINMAVGTIFSILPYQHQGKVSENSDFLQAGNQQLAAGYLLYGTSTVLALTITDNVVMFSLDPDTNDYVLIEENVTVDADTSEYAINASNYRYWRAPMQQYIDELIAGEIGVRGRDFNTRWVAAMVGDVHRILCRGGLFTYPFDTKYANKAGKLRLMYEANPMSLLIERAGGGATDAVNRILDIEPTDIHQRVPVVLGSKNEVDYVKNLHLNYAEK

SEQ ID NO: 2636 - protein, 394 aa, Xylella fastidiosa
MSKVLSLETWSPLYAHGVRVGDRILLDTLDTDISDKNKPVRLYCYHINTAGVKKEFEFDLPAPPLGAQQTAVPAGDHVLHIARFARFDQGEIQALKHVIEDRNSPMTQLHYIPLGAVTTRPHLIRTKVIDVVKDSEADKAGVEIGSFIGDGTDPKTESKNIGGKTVVKSNGIYKMILPDGKKVTFSINKEITLSNFEGIRSAQLIGKTLVIAFNEMTDENTQWALQQIKNTPATAIVLDLRDNTGGSSIAVPKLLAGFLASGTRIATEIRGKKTNEINVPTGYTPTDKPMAVLIGLVSASGAEVTARTLQFHRRARIYGAQSSGQVLMSRFYKLTDGSYIQIPHANLLDPAGKPLEWYGVMPDVKKWKTLSDVRAGRDPVLECALTDLSGGQCH

SEQ ID NO: 2637 - protein, 546 aa, Unknown
  Frankia sp. CcI3
MPKILTFNEDARRALEHGVNALANAVKVTIGPRGRNVVIDKHYGAATITNDGVTIAREIELEDPYENLGAQLAKEVATKTNDVAGDGTTTATVLAQEMVRFGLKQVTAGAAPLTLKLGIEAAVEAVSAALLKQAIEVNSKETIAQVAAISAQDPQVGELIAEAIDKIGKDGVITVEESQTLGLDLELTEGMQFDKGYISPYFVTDAEAQEAVLEDAYVLLYPGKISALNEILPVLEQVVQERKPLLIIAEEVEGEALSTLVVNSIRKTFQVVAVKAPGFGDRRKALLQDIAVLTGGQVVASEVGLSLDAVTLADLGRARRVVVDKDNTTIVDGVGEASSIADRVRQLKQEIEVSDSDWDREKLQERLAKLAGGVAVIRVGAATEVELKERKHRLEDAVSATRAAIEEGIIAGGGSALTHVASVLDDGLGRTGDELAGVRIVRRALDAPLSWIARNAGLEGAVIVSKVKELEPGRGYNAATGEYTDLIAAGVIDPVKVTRSAVANAASIAALLITTEGLVVEKPAEPAPQDGHGHGHGHSHPQGPGF

SEQ ID NO: 2638 - protein, 456 aa, Gibberella zeae
MTSSAKLGENPISTLANGQPTENPGSTQQIRYGQSNGGLVVLSDTQTIEILAHFARERIPERSVHAKAAGATGEFEVLEDLSDITDANFLSEKGKKTPMLMRISTVGGEKGSADTVRDVRGWSTKLYTEEGIQDFVFNDLPVFFIREPIKFPSMNRSHKRHPRTNVPDNAMFWDYHVNNPEGIHALMHLFGQRGIPASLRHISGFGVHTYTLNKADGSYVYVKWHYKPEGGIETMDSETAARLAGTDPDYHVKDLFNAIEKGDYPSWIVYIQVMRPEEVMAAPIDIFDCTYTWPHEKYPLRRVGQMTLKKNPDNYFQDIEQACFSPSNMVPGIGPSADPVLQARMFSYPDAHRYRVGPNYFQLPPNRPRNQVYAPCVRDGPGTMNGNYGGDPDYVFSQLRPVSARELWKIICGEDKGKRQFFNNIAPTIKDLPVKLQDYLSGVDPEIKTILTAHMN

SEQ ID NO: 2639 - protein, 1150 aa, Gibberella zeae
MGTRTASSAVADASLRGPGRTHSTRSSRSSRVPSFPPPSPSASAAPAAPAPATSTGTGANYNQSHTRQLSHSHSQSQSRSQSQSLSQAQSQAYASRSHSHSHSHSHSRSASNAANSHPPPHHSQHQRTSSSARTTSQNDHESSRLAANPKHHRTSSKDDRHPPPTRGPDPSRAHRRSSSSRSKNNNHNPPPEMAPSASAPSNGTSHASAAPPTNHADAPPRASTSKHARSRTVIPTQSGKWMLGKTIGAGSMGKVKLARKEDGSEQVACKIIPRGSTDDGHQSRADKERADQSKEIRTAREAAISTLLNHPHICALHDVVRTNHHWYMLFEYVNGGQMLDYIISHGKLKEKQARKFSRQIASALDYLHRNSIVHRDLKIENILISKTGDIKIIDFGLSNLFAPRGHLKTFCGSLYFAAPELLQARAYTGPEVDVWSFGIVLYVLVCGKVPFDDQSMPALHAKIKRGLVDYPAWLSSECKHLLSRMLVTDPKQRATMQEVLTHPWMAKGFNGPPDNYLPNREPLTTPLEPEVILAMQGFNFGTPESINAQLTKIIESDEYQRAIKLYQREKELPQPTKDAEKKRAFGFDFYKRRNSGNSRDTLSAPSSEALQMGNDPMNAFSPLLSVYYLVKEKQDRDHADMVPPAASQSREKEKEKEREREREREEKREREREREKEREREREREREAREKEKAREPELPEIAAPQAAHTNSSAYEMPGEKPTGGRSRPRARTHGEDDMPELPKQTPAPPPEPRVEQIQKKEGTAAGILRRFSTRKRREPERLDRDRSHPPVVQVHSPAEPSPLAPRKSFSIRRGRRDREDASDTQIRSSSNQGQHGELLSPPMSSGGNREGRRGSALGRSTSVNSAEMRRRKDHPATNESDQSVGNEESSSSRRAHGHSRSVSLRAKSIGHARRESIQQRRQRRDAAQEANVPEETDQELEQSGVSTERLDDTELSKPVFLKGLFSVSTTSGKSVPAIRTDIKRVLKQLNVDYTEIKGGFRCRHSPSIDLNKVQDPPMSPGNTPGHKRRFSFGGLIRGDDRDRDDFRDSDRPPTTPRTPGRSDRDRSFSNSETSFDSNSGRNAGPSRQVPGETSTQVQSDLGGSMVLEFEIFIVKVPLLSLHGIQFKRMAGNTWQYKSMADHILRELRL

SEQ ID NO: 2640 - protein, 473 aa, Photorhabdus luminescens
MKKQFPNNFLWGGALAANQVEGAHQIDGKGLSTSDMQPHGVIGHSIERNLGDFHIKDIGIDFYHRYPEDIALFAEMGFKCLRTSIAWTRIFPEGDEEIPNENGLAFYDRLFDEMIKYNIQPLITLSHFEMPYGLVKKYGGWGNRKTIAFFDHYARTVFERYQHKVKYWLTFNEINMSLFSCFTGAGLPENSKIQDIYQALHYQLVASANAVKACHEIIPDAKIGNMVAAAPYYPLTCHPDDILESLKKNREWLFFFDVQARGYYPSYMPRLFKEKNITLDITDEDKIALKETVDFLSFSYYMSSCATTNLEIIKTSGNIINPVKNPYLSSSEWGWQIDPKGIRYLLNMLYDRYQKPLFIVENGLGARDVIQNDGSIIDDYRIKYLNDHLFQIREAIEDGVQLLGYTSWGPIDLVSASTAEMSKRYGFIYVDRDDQGNGTLERRRKKSFNWYKAVISSHGNTLQAPEVENENNQ

SEQ ID NO: 2641 - protein, 482 aa, Zea mays
MAASVTVENLNPKVLKCEYAVRGEIVIHAQRRQQQLQTQPGSLPFDEILYCNIGNPQSLGQQPVTFFREVLALCDHPCLLEKEETKSLFSADAISRAKQILATIPGRATGAYSHSQGIKGLRDAIAAGIMSRDGFPANADDIFITDGASPGVHMMMQLLIRNEKDGILCPIPQYPLYSASIALHGGTLVPYYLNEKNGWGLEISDFKTRLEDVRSKGIDVRALVVINPGNPTGQVLAEDNQYDIVKFCKNEGLVLLADEVYQENIYVDNKKFNSFKKIVRSMGYGEDDLPLVSLQSVSKGYYGECGKRGGYMEITGFSAPVREQIYKIASVNLCSNITGQILASLVMNPPKAGDESYASYKAEKDGILESLARRAKALEDAFNKLEGFSCNKAEGAMYLFPQIHLPQKAIEAAKAAKKAPDAFYALRLLESTGIVVVPGSGFGQVPGTWHIRCTILPQEDKIPAVISRFRAFHEAFLAEYRD

SEQ ID NO: 2642 - protein, 541 aa, Sinorhizobium meliloti
MAAKEVKFTSDARDRMLRGVDIMANAVRVTLGPKGRNVVIDKSFGAPRITKDGVSVAKEIELEDKFENMGAQMLREVASRTSDIAGDGTTTATVLAQAIVREGAKAVASGMNPMDLKRGIDLAVEAIVKELRNNARKVSKNAEIAQVATISANGDAEIGRYLAEAMEKVGNEGVITVEEAKTAEIELEVVEGMEFDRGYLSPYFITNQEKMRVELEDAYILLHEKKLSNLQAMIPILESVIQSGKPLLIIAEDVEGEALATLVVNKLRASLKIAAVKAPGFGDRRKSMLEDIAILTGGTVISEELRIKLENTTMDTLGRAKRIMVDKETTTIVDGAGSKEDIGGRVAQIKAQIEDTTSDYDREKLQERLAKLAGGVAVIRVGGSTEVEVKEKKDRVDDALHATRAAVEEGILPGGGVALLPVVSALNGLATANDDQRVGIEIVRRAIEAPVRQIAENAGAEGSIIVGKLREKQDFAFGWNAQTGEFGDLFQMGVIDPAKVVRTAVQDAASIAGLLVTTEAMIAEKPKKDGQPQMPPGGMDF

SEQ ID NO: 2643 - protein, 203 aa, Thermobifida fusca
MRQLPELTISKIAVGPMDNNAYLLRCVRTGEAVLIDAAAEADRLLELIGDNGLARVITTHRHRDHWGALADVVGATGARTVAHPADAPELPVSTDELVEHGDTIPVGSCTLSVIHLRGHTPGSIALRYDDPAGHTHLFTGDSLFPGGVGKTWSDADFRSLITDVETRIFDQMDDDTWVYPGHGRDTTLGAERPSLPEWHRRGW

SEQ ID NO: 2644 - protein, 414 aa, Vibrio fischeri
MNSINLNQPFTLTNGQVIKNRLFKSAMSEQLGDKLHNPTSGLVTLYARWAKGGIGLSMTGNVMVDRTALGEPKNVVLDDKSDLRLFSEWAKAGTQNSSHIWMQLNHPGKQIPKFLCANPVAPSAISLERGLEKGFNTPRALTESEIHEIITKFATSAKLAKQAGFTGVQIHGAHGYLVSQFLSSRHNKRNDKWGGSLENRLRFVLEVYNAIRKEVGAEFPVGIKLNSADFMKGGFTEKESMQVVQALSNNGIDLIEISGGTYESPSMMGAKDKNKPVKESTVKREAYFMDYMEKVRTLVNTPLVVTGGFRSAPAMNEALNTSATDFIGIARTMAVDPDFPNKLMHDSNYGMPLAEPTTGKPALDKMAMVGLVWYEHQMWRIADGKDADPQLSAFSVVLKTLLSAGWYAFKKRRA

SEQ ID NO: 2645 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPKSNLPERLVQNRSFNTFDLTKEDFEEIAKLDIGLRFNDPWDWDNIPIFV

SEQ ID NO: 2646 - protein, 342 aa, Gibberella zeae
MSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWDDKTINYFNSLKQAQENGKPYSARYIGSMVADAYRTLLYGGIFAYPADKKSPKGKLRILYECAPMALIFENAGGQAVDSKMNRLLEVVPEHIHDKAGIFMGSYDEVEKVKKFHQ

SEQ ID NO: 2647 - protein, 545 aa, Sinorhizobium meliloti
MAAKEVKFGRSGREKMLRGVDILADAVKVTLGPKGRNVVIDKSFGAPRITKDGVSVAKEIELEDKFENMGAQMVREVASKTNDIAGDGTTTATVLAQAIVREGAKAVAAGMNPMDLKRGIDLAVAEVVKDLLAKAKKINTSDEVAQVGTISANGEKQIGLDIAEAMQKVGNEGVITVEEAKTAETELEVVEGMQFDRGYLSPYFVTNPEKMVADLEDAFILLHEKKLSNLQAMLPVLEAVVQTGKPLLIIAEDVEGEALATLVVNKLRGGLKIAAVKAPGFGDRRKAMLEDIAILTGGTVISEDLGIKLESVTLDMLGRAKKVSITKENTTIVDGAGQKSDIEGRVAQIKAQIEETTSDYDREKLQERLAKLAGGVAVIRVGGATEVEVKEKKDRIDDALNATRAAVQEGIVPGGGVALLRSSVKITVKGENDDQDAGVNIVRRALQSPARQIVENAGDEASIVVGKILEKNTDDFGYNAQTGEYGDMIAMGIIDPVKVVRTALQDAASVASLLITTEAMIAELPKKDAPAMPGGMGGMGGMDMM

SEQ ID NO: 2648 - protein, 124 aa, Arabidopsis thaliana
MTTISLRKSNTRLPPEVNRVLYVRNLPFNITSEEMYDIFGKYGAIRQIRIGCDKATKGTAFVVYEDIYDAKNAVDHLSGFNVANRYLIVLYYQHAKMSKKFDQKKSEDEITKLQEKYGVSTKDK

SEQ ID NO: 2649 - protein, 541 aa, Sinorhizobium meliloti
MAAKEVKFQTDARERMLRGVDVLANAVKVTLGPKGRNVVIDKSFGAPRITKDGVSVAKEIELEDKFENMGAQMLREVASRTNDLAGDGTTTATVLAQAIVREGAKAVASGMNPMDLKRGIDLAVDAVVKELKNNARKISKNSEIAQVGTISANGDTEIGRYLAEAMEKVGNEGVITVEEAKTAETELEVVEGMQFDRGYLSPYFITNQDKMRVELEDPYILIHEKKLSNLQAMLPVLERVVQSGKPLLIIAEDVEGEALATLVVNKLRGGLKVAAVKAPGFGDRRKAMLEDIAILTGGTVVSEDLGIKLESVTLDMLGRAKKVSIEKENTTIIDGAGSKADIEGRTAQIRAQIEETTSDYDREKLQERLAKLAGGVAVIRVGGSTEVEVKEKKDRVDDAVHATRAAVEEGILPGGGVALLRAVKALDGLKTANNDQRVGVDLVRRAIEAPVRQIAENAGAEGSIIVGKLREKTEFSYGWNAQTNEYGDLYAMGVIDPAKVVRTGLQDAASVAGLLVTTEAMIAEKPKKEAAPAFRPRGMDF

SEQ ID NO: 2650 - protein, 1116 aa, Debaryomyces hansenii
MGTPELMKILEDPVLFQENHEKIRNDILKHIKSQNVTIKTLTNELDTSKSANKAFKQALSEIGTVVISVAMGDLSKKVEIHTVESDPEILKVKITINTMMDQLQAFANEVTKVATEVANGELGGQAKNEGSVGIWRSLTDNVNIMALNLTNQVREIADVTRAVARGDLSRKINVHAQGEILQLQMTINSMVDQLRTFAFEVSKVARDVGVLGILGGQALIEGVEGIWKELTDNVNAMALNLTTQVRNIANVTTAVAKGDLSKKVTADCKGEILDLKLTINQMVDRLQNFALEVTTLSREVGTLGILGGQANVQDVEGAWKAVTENVNLMATNLTNQVRSIATVTTAVAHGDLSQKIDVHAQGEILQLKNTINKMVDSLQLFASEVSKVARDVGINGKLGIQAQVSDVDGLWKEITSNVNTMASNLTSQVRAFAQITAAATDGDFTRFITVEASGEMDALKTKINQMVLNLRESIQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKSLDLTYQCDSSFPDNLIGDSFRLRQVILNLAGNAIKFTKKGRVSVSVKKSTRIIEDKERLLLEFCVSDTGIGIEKDKLGLIFDTFCQADGSTTRKFGGTGLGLSISKQLIHLMGGEIWVTSDYGEGSNFYFTVSVAPSAIRYTRQTEQLLPFGGHYILFISTEHTKDELGDIKNGALELGLNPVIVDNIKDGNLTEPVRYDIIMIDSIETAKNLRLLPEVKYIPLVLLHHSIPELNMRVCIDLGISSYGNTPCTISDLASALIPALESRSIAQNTDESASYNILLAEDNLVNQKLAVKILEKQGHHVEVVENGLEAFEALQKTKYDVVLMDVQMPVMGGFEATEKIRQWEKKSNPIDSLSFRTPIIALTAHAMLGDREKSLAKGMDDYVSKPLKPKLLMQTISKCIHNIKQLKELSKQNNSNRTSDFAKNLKKSSIEGSEIPNSNLLNIGSSPTSNSTYNGLSTSLASDGATFASPKMKKSISNDVFVNGRPGKLSMDNRSVTESAISLKPKSPKSDSMDLDNSSPRIEYLD

SEQ ID NO: 2651 - protein, 559 aa, Sulfolobus shibatae
MTFGYKIDGNEVIFTLWAPYQKSVKLKVLEKGLYEMERDDKGYFTITLNNVKVGDRYKYVLDDASEIPDPASRYQPEGVHGPSQIIQESKEFNNETFLKKEDLIIYEIHVGTFAPEGTFEGVIRKLDYLKDLGITAIEIMPIAQFPGKRDWGYDGVYLYAVQNSYGGPEGFRKLVDEAHMKGLGVILDVVYNHVGPEGNYMVKLGPYFSQKYKTPWGLTFNFDDAESDEVRKFILENVEYWIKEYNVDGFRLDAVHSIIDTSPKHILEEIADVVHKYNRIVIAESDLNDPRVVNPKEKCGYNIDAQWVDDFHHSIHAYLTGERQGYYLDFGNLDNIVKSYKDVFVYDGKYSKFRRKTHGKPVGELDGCNFVVYIQNHDQVGNRGKGERIIKLVDKESYKNAAALYILSSIISMIFMGEEYGEQKPFYFFSDFSDTKLIQGLREGRKKENGQDTDPQDESTFNASKLSWKIDEEIFSFYKILIKMRNELSIACDRRVYVENGENWLIIKGREYLSLCVFSRSSIEVKYSGTLLLSSNNSFPQHIEEGQYEFDKGFALYKL

SEQ ID NO: 2652 - protein, 370 aa, Nostoc punctiforme
MTTEINLFSSYQLGNLELPNRIVMAPLTRNRASKGNVPYELNATYYAQRASAGLIISEATQVTPEGQGYPATPGIHSPEQVEGWKLITDAVHQQGGRIFLQLWHVGRISHPDLQPNGALPVAPSAIAPKGEAATYEGPKPFVTPRALETSEIPQIVEQYRQGAANALAAGFDGVEIHSANGYLIDQFLRDRTNQRTDKYGGSIENRTRFLLEVTEAVTSVWDSNRVGVRLSPSGTFNDIGDSNPLETFGYAAQALNQFNLAYLHIYEATEADIRHGGIIVPTSHIRDRFTGTLIVNGGYTREKGDAVLANKAADLVAFGTLFISNPDLPRRLALNAPLNEANQATFYGGGEQGYTDYPFWSAANEAVAKA

SEQ ID NO: 2653 - protein, 537 aa, Arabidopsis thaliana
MATGSGSLIWFRKGLRVHDNPALEYASKGSEFMYPVFVIDPHYMESDPSAFSPGSSRAGVNRIRFLLESLKDLDSSLKKLGSRLLVFKGEPGEVLVRCLQEWKVKRLCFEYDTDPYYQALDVKVKDYASSTGVEVFSPVSHTLFNPAHIIEKNGGKPPLSYQSFLKVAGEPSCAKSELVMSYSSLPPIGDIGNLGISEVPSLEELGYKDDEQADWTPFRGGESEALKRLTKSISDKAWVANFEKPKGDPSAFLKPATTVMSPYLKFGCLSSRYFYQCLQNIYKDVKKHTSPPVSLLGQLLWREFFYTTAFGTPNFDKMKGNRICKQIPWNEDHAMLAAWRDGKTGYPWIDAIMVQLLKWGWMHHLARHCVACFLTRGDLFIHWEQGRDVFERLLIDSDWAINNGNWMWLSCSSFFYQFNRIYSPISFGKKYDPDGKYIRHFLPVLKDMPKQYIYEPWTAPLSVQTKANCIVGKDYPKPMVLHDSASKECKRKMGEAYALNKKMDGKVDEENLRDLRRKLQKDEHEESKIRNQRPKLK

SEQ ID NO: 2654 - protein, 547 aa, Rhodopseudomonas palustris
MAAKDVKFSGDARDRMLRGVDVLANAVKVTLGPKGRNVLIEKSFGAPRITKDGVTVAKEVELEDKFENMGAQMVREVASKTNDLAGDGTTTATVLAQAIVREGAKAVAAGMNPMDLKRGIEIAVAAVVKDIQKRAKPVASSAEIAQVGTISANGDAPIGKMIAQAMQKVGNEGVITVEENKSLETEVDIVEGMKFDRGYLSPYFVTNAEKMTVELDDAYILLHEKKLSGLQSMLPVLEAVVQSGKPLLIIAEDVEGEALATLVVNRLRGGLKVSAVKAPGFGDRRKAMLEDIAILTGGQLISEDLGIKLETVTLKMLGRAKKVVIDKENTTIVNGAGKKPEIEARVSQIKAQIEETSSDYDREKLQERLAKLAGGVAVIRVGGATEVEVKEKKDRVEDALNATRAAVQEGIVPGGGVALLRAKKAVGRISNDNPDVQAGINIVLKALEAPIRQIAENAGVEGSIVVGKILENKTETFGFDAQTEEYVDMLAKGIVDPAKVVRTALQDASSVASLLVTTEAMVAELPKADAPAMPAGGGMGGMGGMGF

SEQ ID NO: 2655 - protein, 481 aa, Bordetella pertussis
MSTRKFRGFGLVAIGAVAGILLSVGVSAVAQRGSPLPLDELRQLSNVFAAIKNNYVEAVDDKTLIGNAISGMVSNLDPHSAYLDADAFREMQTATQGEFGGLGIEVGAEDGFVKVISPIEDTPAARAGIQAGDLIIKIDDTPTKGMSLNDAVKLMRGAPKSPITLTIMRADRPQPIVVKIVRDIIKVRSVRSKMLDSNVAYLRIAQFQEKTGPDLARHLKELGAKGAPKSLVLDLRNDPGGLLTSAIGVAGAFLPPDALVVSTDGRTPDSRHKYRATPSEYARGEGNYLNDLPGWVKTVPMVVLVNVGSASASEIVAGALQDHKRAKVLGNRTFGKGSVQVILPLSESTAVKLTTSRYFTPSGRSIQATGIEPDYVVADTADGDLFRLPREADLQRHLSNQQSPDAEVKSNNDDNTEVAGKAFEFGGKDDFQLQQALNLLAGKPVQKGSARAQAKADIKPSEGKTQRMTITPTGVEPAKSK

SEQ ID NO: 2656 - protein, 443 aa, Geobacter metallireducens
MFGTRKGKKIALLAVVLFAMLAGGGFVAQKHCAAQGGNDYESIELFTDVLAIVKKSYVEEVDTKKLIYGAINGMLASLDPHSSFMPPDMYKEMKIDTKGSFGGLGIEITIKDGILTVISPIEDTPAFRAGIKAGDQILKIDDRFTKDMTIMDAVKRMRGAKGTKVILTIVREGFDKPKDFTLVRDIIQVKSVRFSSLDNGYGYIRIAQFQEKTDDDLVKALATLKEENGGSLKGLVLDLRNDPGGLLDQAVKVADHFVEQGLIVYTEGREKDSRMQFNAHKGGTEPAYPMVVLINGGSASASEIVAGALQDHKRAVVMGTQSFGKGSVQTIIPLSDDSGLRLTTARYYTPNGRSIQAKGITPDIIVERAEIQPTEKKDGHIREKDLENHFESGEKVEGEDKKTEKGKVPAAKSDDQLKGDYQVLRALDLLKGWEILKTMNRAN

SEQ ID NO: 2657 - protein, 540 aa, Lactobacillus helveticus
MAKDIKFSENARRSLLKGVDKLADTVKTTIGPKGRNVVLEQSYGNPDITNDGVTIAKSIELKDRYENMGAKLVAEAAQKTNDIAGDGTTTATVLTQAIAREGMKNVTAGANPVGIRRGIEKATKAAVDELHKISHKVESKDQIANVAAVSSASKEIGALIADAMEKVGHDGVITIEDSRGINTELSVVEGMQFDRGYLSQYMVTDNDKMEADLDNPYILITDKKISNIQDILPLLQEIVQQGKSLLIIADDITGEALPTLVLNKIRGTFNVVAVKAPGFGDRRKAQLQDIAALTGGTVITEDLGLELKDTKIDQLGQARRITVTKDSTTIVGGAGSKEAIDERVDTIRKQIEDSTSDFDKKKLQERLAKLTGGVAVIHVGAATETELKERRYRIEDALNSTRAAVDEGYVAGGGTALVNVEKAVREVKGETTDEQTGINIVLRALSAPVRQIAENAGKDGSVILDKLEHQENEIGYNAATDKWENMVDAGIIDPTKVTRTALQNAASIAALLLTTEAVVAEIPEPKQAAPQGGAGAPMGM

SEQ ID NO: 2658 - protein, 1249 aa, Magnaporthe grisea
MADAATLAAVAAIVENIATNSGAPGKNASFRSSTYVQLPGPESDEKKQLERELAALVIRVQQLETRANAAPATIFPDTPNETAYSLFGDDSSSPTSSSSGREPKRLKSASSTTRNGFTTDGRPSKLNAITDEELEGLREHVDGQSRLLDSQRAELDGVNAQLLEQKQLQERALAIIEQERVATLERELWKHQKANEAFQKALREIGSIVTAAARGDLSKRVKINPIEMDPEITTFKRTMNAMMDQLGVFSSEVSRVAREVGTEGILGGQAQIEGVDGTWKELTDNEVTRVARDVGTEGMLGGQADVEGVKGMWNELTVNVNAMANNLTTQVRDIINVTTAVAKGDLTQKVQAECRGEIFELKNTINSMVDQLQQFAREVTKIAREVGTEGRLGGQATVHDVQGTWRDLTENVNGMAMNLTTQVREIANVTSAVAAGDLSKKIRVEVKGEILDLKNTINTMVDRLGTFAFEVSKVARAVGTDGTLGGQAQVENVEGKWKDLTENVNTMASNLTSQVRGISTVTQAIANGDMSRKIDVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKRKINQMVYNLRDSIQRNTQAREAAELANKTKSEFLANMSHEIRTPMNGIIGMTQLTLDTDLTQYQREMLNIVNNLAMSLLTIIDDILDLSKIEAKRMVIEEIPYTLRGTVFNALKTLAVKANDKFLDLTYRVDSSVPDHVIGDSFRLRQIILNLVGNAIKFTEHGEVSLTIQKGNDVTCLPNEYMIEFVVSDTGIGIPTDKLGLIFDTFQQADGSMTRKFGGTGLGLSISKRLVNLMGGDVWVKSQYGKGSSFYFTCRVRLADVDISLIRKQLKPYKGHQVLFIDKGKTGHGPEVGQMLGQLGLVPIVLESEQNHTLTRVRGKECPYDVIVVDSIDTARRLRGIDDFKYLPIVLLAPTVHVSLKSCLDLGITSYMTMPCKLIDLGNGMVPALENRATPSLSDNTKSFEILLAEDNTVNQRLAVKILEKYNHVVTVVSNGAEALEAVKDNKYDVILMDVQMPVMGGFEATAKIREYERSLGTQRTPIIALTAHAMMGDREKCIEAQMDEYLSKPLQQNHLIQTILKCATLGGALLEQNRERELELARHAEHKGGLSTDPARASSVMRPPLHHRPVTTAESLSGGAESPSLMANDGEDPIQRARSSLSEPGCL

SEQ ID NO: 2659 - protein, 142 aa, Brassica rapa
RQVTFCNRRNGLLKKAYELSVLCDAEVTLIVFSSRGRLYEYSNNSVKGTIERYKKAISDNTNTGTVAEINGQYYQQESAKLRQQIISIQNSNRQLMGETIGSMSPKELRNLEGRLDRSINRIRSKKNELLFAEIDYMQKREL

SEQ ID NO: 2660 - protein, 208 aa, Bacillus anthracis
MKWIQMPLGPLQTNAYILKNDKNECVIFDPGHEGEKLVTYLQEEQLKPLAVLLTHAHFDHIGAVDAVRDAFHIPVYVHKEEDWLGDATVNGSQIFMMNRSITAKPADHIIDAEGTLAIGSFNFEIFETPGHSPGSISYYCKEASAVFSGDVLFQMSIGRTDLPGGSFAELIGSIEEKLFVLPDETAVLCGHGPETSIGFEKENNPFLQ

SEQ ID NO: 2661 - protein, 469 aa, Bacillus cereus
MVVAFLIGAGGMFAGMSLFGVNPAEVTQTISNGNASTAQGNLAKINEAYALIDSRYVEDVKDEKLVEGAIQGMLSTLKDPYSTYMDKETAKQFSESLDPELEGIGAEVNKTDGKLIIVSPIKGSPAEKIGIKPNDQILSVDGNSVKDLSREEAVLKIRGKKGTTVAIEIKRAGVADPIVFKIKREKIPIFTVFSSVKQESGKDIGYMQITSFAENTAKEFKDQLKELEKKNIKGLVIDVRGNPGGYLNSVEEILGEIMTDKKPMLQVEQRNGEKKKFSTELKERKPYPISVLIDNGSASASEILAGALKEGEGYDLIGEKTFGKGTVQQAVPFKDGSNIKLTMFKWLTPDGNWIHKKGIKPTVEVKQPDYYHATPIQIEKTLSYNANDVQVKHAQEMLKSLGYVPGREDGYFSKETESALKAFQNANKMEATGQLDKKTAEAIQTKIIEKIRSGENDLQLQSALKLMAK

SEQ ID NO: 2662 - protein, 407 aa, Unknown
  Polaromonas sp. JS666
MKPITKSAKLANVLYDIRGPIMDAAKQMEEEGHHLIKLNLGNLAVFGFDAPEEIQQDMIRNLPSSAGYSDSKGIFAARKAVMHETQKQGISGVTLDDIYLGNGASELIAMATNALLDDGDELLLPTPDYPLWTASTSLSGGKPVHYLCDEDNGWMPNLDDIRAKITPKTKGIVVINPNNPTGALYSDELLKQIVEIARTHGLVILADEVYDKVLYDGAHHTAIASLSTDVLTLTFNSLSKSYRSCGYRAGWLVVSGPKKRAEDYIEGLNMLANMKLCSNVPGQWAIQTALGGYQSINDLTGEGGRLRRQRDLAYELITAIPGVSCVKPSAALYMFPKLDPKVYPIKDDRQFFLELLKETKVMLVQGTGFNWASPDHFRIVFLPHEEDLREAVGRIAKFLENYRNNNI

SEQ ID NO: 2663 - protein, 651 aa, Oryza sativa
MAGSERTVVWFRRDLRIDDNPALASAARDGAVLPVFIWCPADEGQFYPGRCSRWWLKQSLPHLSQSLESLGCPLVLIRAESTLEALLRCIDSVGATRLVYNHLYDPVSLVRDDKIKKELSALGISIQSFNGDLLYEPWEIYDDSGLAFTTFNMYWEKCMELPIDASPSLAPWKLVPVPGLESVRSCSVDDLGLESSKDEESSNALLMRAWSPGWRNAEKMLEEFVSHGLLEYSKHGMKVEGATTSLLSPYLHFGEVSVRKVYQLVRMQQIKWENEGTSEAEESIHFFMRSIGLREYSRYLCFNFPFTHEKSLLGNLKHYPWKVDEERFKSWRQGMTGYPLVDAGMRELWATGWTHNRIRVIISSFAVKFLLIPWTWGMKYFWDVLLDADLESDILGWQYISGSLPDGHELSRLDNPEVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKASNRSSICVDMIRSSKMEATSSVANSPVSRKRSFCETAFHVPSYSSSAEVHSHIQDHGGSLVGPSRYLLQEAGRNYVDEVEDSSTADSGSSISRQRKAA

SEQ ID NO: 2664 - protein, 466 aa, Oryza sativa
MPEKGTVVMSRYELGRSLGHGTFSKVYQARSLVSGETVAVKVIDKEKALRAGAGMVDQIEREVAVMRLVGRHPNVVRLHEVMASRSKIYFVMELVRGGELLARLVAGGGRLGEDAARRYFHQLVAAVDFCHSRGVYHRDLKPENLLVDDDGSGGGGNLKVTDFGLSALSASRRHDGLLHTTCGTPSYVAPEIIGDKGYDGATADVWSCGVILFLLLAGYLPFFDSNLMEMYKKITNGEFKVPDWFTPDARSLISRLLDPNPTTRITIDELVKHPWFKKGHTKRPASSNTMKLNEEEKPANAAMNMKPASLNAFDIISLSQGFDLSGMFCCHGHSSRTQDQLFVTGKPATAIVSRLEEIAETEHFTVKKKQKKRQEEDGMAVKLQGWKEGRKGQLAIDAEIFEVSPSCYVVEVKKTAGDTLEYQAFCNRDLRPSLNDICWTSPATAASEKNQLPAVSEVSPLSSPRN

SEQ ID NO: 2665 - protein, 466 aa, Fusobacterium mortiferum
SFPKNFLWGSATAAYQVEGAWNQDGKGPSIWDLYSKLPGTTFEGTNGDIAADHYNRYKEDVKTMAEMGLKTYRFSIAWTRIFPEGSGKINEKGIEFYSNLIDELLKYNIEPMITLYHWDLPQALQDKYAGWESREIIDDFVEYARVCFKNFGDRVKYWIVMNEPNVFIGLGYGIALHPPGGKDRKKELNAGHITALANAKAIKLFREIVPNGMIGSSIAYGPAYAASESEEDKLALEKYYNYNVWWWFDPYFKGEYPADMLKYNQEKYGAPEILDGDMELLKSAKSDFIGINYYCTQMIADNKEGVGYNGMNTTGEKNSQKENGVPGLFKNVRNTNLEYTDWDWAIDPDGLRYGMVQLKERYNLPIIISENGLGAVDPIDEEGNIQDIPRIDYLREHIIACEKAIEEGVDLLGYCTWSYIDLLSWLNGYKKQYGFIYVDRKNNLERKKKASYFWYKDVIASNGEKL

SEQ ID NO: 2666 - protein, 1122 aa, Ralstonia metallidurans
MRKLIKGEKLAALPLSISQIRNLVYVFVTCLLVLIGLSWFVLLKYRMDEAVDRQKILFQARAEQVEANLTAVRRMTLRAQGTLERLIEVGVGKPMAQTTSRDWIDHLQKRGERPYVALPISAGREAIPADASIAPLANVLAFMLRVSSVQYQGLENVWLVDLNADRFYVTPRNLPQARETLRNDATYQAFVEGSIARLRSRKLLEQLKAAPGRVVMLEPGYDWVSRTPIVTVATLIHVDGEPRAVFAMDFPLSAIFPEDDDLEDGFFVQTAEGTILRPDSMSRDPLPPAVSQALVKRAHVATNLPTFVGSGLLPSVMVLDGPVDRSGWRAVEVVETGMLWESLRRNTLWLFALTGLTCTLMLAWVRLVDRRIMRPTQTQSLRLQESEVLGRTIIESTGVGLVILDSTNAAVLMENDVSDRITAHAKPGELARFHRAACNALADGERGNTVGRHGKFNFELAHTDETVSYLTVRVVESTYQGKPAKLCAMDDVTAARQSESTLLQAIHDADAANRAKSAFLATMSHEIRTPLNGMLGSIELLEVSALDAAQRDQLEVMQQSAQSLIQIINDVLDFSKIEAGQMALQARPCQIDSLVEDVCRRFAPDAERRSLQLLCVIDPALHAPILLDPLKTEQVLGNLVSNAIKFTEQGKVVVEATTMTEGGRDWLKLRVIDTGIGIAIEDQQRLFAPFVQAEQSDSRRFGGTGLGLSICNRLVGLMNGSIRLVSEPGLGSCFDVRIPMEPVTVTQPADIVQTGLLNDLYIANGLSGLTVGLCSPSRETYHGIEHLLQHYGAVVVRFDSSQPPATPVDVVVCEHGDIHACPDADVVIESNASLLPDTSQTPIRASRYAWRGLVQAILTAAGLELPMPVQRRADSAQGHLALKSLRILLVEDHRVNQVVMRRLLEWLGQRVDVAGDGREALALTASQSYDLILTDLQMPSMDGYELARTMRERGITVPIIAVTASVGPDLQSACQKAGINRCLTKPVRLAALRELIEPLDASPPLPGTEPSLIPKEAMMSLSEYLGEDLAELSEAAAAGDTVRLMRKLHALAGALATLGHASESQACRWLERTIEESGLAGMEEQWIALRTALETLIAQYAGVDLGQPVRRASAPGLPLPDR

SEQ ID NO: 2667 - protein, 298 aa, Oryza sativa
MAGSERTVVWFRRDLRIDDNPALASAARDGAVLPVFIWCPADEGQFYPGRCSRWWLKQSLPHLSQSLESLGCPLVLIRAESTLEALLRCIDSVGATRLVYNHLYDPVSLVRDDKIKKELSALGISIQSFNGDLLYEPWEIYDDSGLAFTTFNMYWEKCMELPIDASPSLAPWKLVPVPGLESVRSCSVDDLGLESSKDEESSNALLMRAWSPGWRNAEKMLEEFVSHGLLEYSKHGMKVEGATTSLLSPYLHFGEVSVRKVYQLVRMQQIKWENEGTSEAEESIHFFMRSIGLREYSR

SEQ ID NO: 2668 - protein, 641 aa, Listeria monocytogenes
MKFNSMFSPIDIGPMKVPNRFVVSPMCNNYANTDGTLSDTSLAYYKERALGGFGLITFEATVVDVRAKGGANKACLYSDHQIASFKRVIDVCHDAGAKISVQLQHAGPEGNSKVSGYPLRAASAIASAAGRNTPEAISREELYELIELYGEAALRAKKAGADAVEVHCAHGYLVSSFLSARTNKRVDEFGGCFENRMRLPRLIIESIRKRVGHSIAILCRINSTDGVDGGLSVQDSATVAAYLEDCGLDGLHVSRSVHIRDEYMWAPTVLHAGFSSDLVTQIKRAVSIPVITVGRFTEPHYAELMVREGRADLVAFGRQSLADPETPNKAAAGKLDELLPCIACLQGCVANMYAGKPITCLVNPLLGRESEAYLPKTPSKKVVVVGGGVGGLYAGWMAGSRGHDVTVYEASDMIGGQMRLAAYPPGKGDLTNMVRSYIKKCEQFDVEIKTNTPVTLELIQEVAPDAVIIATGATPLVLPIPGIEDAGLIHAVDLLDGKEKCGQKVLVVGGGMVGSETAAFLGEAGHDVTVVELRDEVGADVISEHRKFLMHDFDEYKIKSVTNAKVTSFFEDGVTYSLADNKEQRIDGFDSVVLAMGSRAYNPLEEAIKAIVPETYVIGDAVRARRALDATKEALDAVLQL

SEQ ID NO: 2669 - protein, 141 aa, Glycine max
  misc_feature (5)..(6): Xaa can be any naturally occurring amino acid
  misc_feature (8)..(9): Xaa can be any naturally occurring amino acid
  misc_feature (21)..(21): Xaa can be any naturally occurring amino acid
  misc_feature (40)..(40): Xaa can be any naturally occurring amino acid
  misc_feature (46)..(46): Xaa can be any naturally occurring amino acid
VDTDXXRXXFMNAFDRAMNLXDDNFSFLASTKQIVSSADXDDKVIXVFERGDLIFVFNFHPENTYEGYKVGCDLPGKYRVVLDSDAWEFGGHGRVRSPNLSGGKHEYNQERNYCPQIFLKLQNKYKPLNFCFTSQKFFDSA

SEQ ID NO: 2670 - protein, 796 aa, Gibberella zeae
MKNTINLMVDRLGTFAVEVSKVAREVGTDGTLGGQAQVANVEGKWRDLTENVNTMASNLTAQVRSISTVTQAIANGDMSQKIKVEANGEIQVLKETINNMVDRLSSFCYEVQRVAKDVGVDGKMGAQADVGGLDGRWKEITTDVNTMASNLTTQVRAFSDITNLATDGDFTKLVDVEASGEMDELKRKINQMISNLRDSIQRNTQAREAAELANKTKSEFLANMSHEIRTPMNGIIGMTQLTLDTDLTQYQREMLNIVNNLANSLLTIIDDILDLSKIEARRMVIEEIPYTLRGTVFNALKTLAVKANEKFLDLTYMVDSSVPDYVIGDSFRLRQIILNLVGNAIKFTEHGEVSLTIKESMGQSHVRPGEYAVEFVVQDTGIGIAQDKLDLIFDTFQQADGSMTRKFGGTGLGLSISKRLVNLMGGDLWVNSQHGKGSEFHFTCLVKLAPDDAALIEQQIRPYRGHQVLFVDKAQSQNAASIKPMLEKIGLKPVVVDSEKSPALARLHTGGSLPYDAILVDSIDTARRLRAVDDFKYLPIVLLAPVVHVSLKSCLDLGITSYMTTPCKLIDLGNGMIPALENRATPSLADNTKSFEILLAEDNTVNQRLAVKILEKYHHVVTVVGNGWEAVKAVQSKKFDVILMDVQMPIMGGFEATGKIREYERGIGSHRTPIIALTAHAMMGDREKCIQAQMDEYLSKPLQQNHLIQTILKCATLGGPLLEKNRERELALHAETKSKHKEGGQGLLRPTLESRAFTSREPLLGNGKESPAIIATDEDPMARARLDLSDMRSLTN

SEQ ID NO: 2671 - protein, 698 aa, Pseudomonas aeruginosa
MKRFLPRTALLLLLGASSLPLFASTAVSVGSAQNSWDSLQPDREQVIASLNVVELLKRHHYNKPPLNDERSAKIYDSYLKMLDPARMYFTAGDIAEFDRWRNRFDDFLKSGDLDPGFVIYKRHLDRLKGRLDYALAMLDKGVDKIDFSVDESLLIDREKAPWAKDTAELDDLWRKKVKDEVLRLKITGKDDKAIQEQLTKRYKNQLSRLKQTRSEDIFQAYINAFAQSYDPHTQYLSPDNAENFDINMSLSLEGIGAVLQSDNDYVKVVRLVPAGPAAKSKQIATSDKIIGVAQGKGEMVDVVGWRLDEVVKLIRGPKGSQVRLEVIPASNAPNDQTSKIVAITREAVKLEDQAAKKSIIKVDHEGRSYKLGVIDLPAFYLDFKAYRAGDPNYKSTTRDVKKLVAELQKDKVDGIVLDLRNNGGGSLQEATELTGLFIDQGPTVLVRNSDGRVDVLNDDEGKAFYTGPLAVLVNRLSASASEIFAGAMQDYHRALILGGQTFGKGTVQTIQPLNHGELKLTLAKFYRVSGQSTQHQGVIPDISYPSIVDDKEIGESALPDSMPWDTIRPVVKDEANPFKPFLAQLKAQHDARTENNADFVYARERLALAQELMKEKTVSLNEAKRRAQQTSIENRQLAMENALRKSKGQEPLKELKREDENALPEEDDKTKPQDDAYLTESGHILLDYLNLNSAVAKH

SEQ ID NO: 2672 - protein, 476 aa, Humicola grisea
MSLPPDFKWGFATAAYQIEGSVNEDGRGPSIWDTFCAIPGKIADGSSGAVACDSYKRTKEDIALLKELGANSYRFSISWSRIIPLGGRNDPINQKGIDHYVKFVDDLIEAGITPFITLFHWDLPDALDKRYGGFLNKEEFAADFENYARIMFKAIPKCKHWITFNEPWCSAILGYNTGYFAPGHTSDRSKSPVGDSAREPWIVGHNILIAHARAVKAYREDFKPTQGGEIGITLNGDATLPWDPEDPADIEACDRKIEFAISWFADPIYFGKYPDSMRKQLGDRLPEFTPEEVALVKGSNDFYGMNHYTANYIKHKTGVPPEDDFLGNLETLFYNKYGDCIGPETQSFWLRPHAQGFRDLLNWLSKRYGYPKIYVTENGTSLKGENDMPLEQVLEDDFRVKYFNDYVRAMAAAVAEDGCNVRGYLAWSLLDNFEWAEGYETRFGVTYVDYANDQKRYPKKSAKSLKPLFDSLIRKE

SEQ ID NO: 2673 - protein, 466 aa, Hypocrea jecorina
MLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVDDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWISKRYGYPPIYVTENGTSIKGESDLPKEKILEDDFRVKYYNEYIRAMVTAVELDGVNVKGYFAWSLMDNFEWADGYVTRFGVTYVDYENGQKRFPKKSAKSLKPLFDELIAAA

SEQ ID NO: 2674 - protein, 551 aa, Triticum aestivum
  misc_feature (104)..(104): Xaa can be any naturally occurring amino acid
  misc_feature (291)..(291): Xaa can be any naturally occurring amino acid
  misc_feature (326)..(326): Xaa can be any naturally occurring amino acid
  misc_feature (391)..(391): Xaa can be any naturally occurring amino acid
MRAYPGEQIEQVCTKKQAGTAPEFPGYRRPTRPPPTPPPSRPHRPPPTQAPGSPPVPTMDPYKHRPTSGANSGYWTTNSGAPVWNNNNALTVGQRGPILLEDYXLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVXCLLDNEAVTVGGTCHTHATKDLTDAIAAGNYPEWXKLFIQTIDADHEDKFDFDPLDVTKTWPEDIIPLQPVGRMVLNKNIDDFFAENEQLAFCPAVTVPXIHYSDDKLLQTRIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDASLGQKLASRLKIKPSM

SEQ ID NO: 2675 - protein, 407 aa, Oryza sativa
MSWFHPDAWGVQRKPISSSVLTRRRRDRELNHGTAGDLVDLACRHIIAAVAYSPPLPDPDPIRSAPHLFIPARELITARSTAADNTQAKRGRFRVLISSSSSSSHSPLAWAGRKSQMVALLRSCRRLIPHLSACAAAAPSSSSSCAPRARPISRGLRLLPVVLAMAGYSSGSAAEGRRLLFRQLFEKESSTYTYLLADVGDPEKPAVLIDPVDRTVDRDLNLIKELGLKLVYAMNTHVHADHVTGTGLIKTKLPGVKSVIAKVSKAKADHFIEHGDKIYFGNLFLEVRSTPGHTAGCVTYVTGEGDDQPSPRMAFTGDALLIRACGRTDFQIFTLPKDTLLYPGHDYKGFTVSTVEEEVAYNARLTKDKETFKKIMDNLNLAYPKMIDVAVPANLLCGIQDPPPSKV

SEQ ID NO: 2676 - protein, 550 aa, Unknown
  Azoarcus sp. EbN1
MAAKEVKFGDSARDRMVAGVNILANAVKVTLGPKGRNVVLERSFGAPTVTKDGVSVAKEIELKDKFENMGAQMVKEVASKTSDIAGDGTTTATVLAQSIVREGMKFVAAGMNPMDLKRGIDKAVIAVTEELKKLSKPCSTNKEIAQVGSISANSDADIGEIIAKSMDKVGKEGVITVEDGKSLQNELDVVEGMQFDRGYLSPYFINNPDKQVAILENPFILLFDKKISNIRDLLPVLEQVAKAGRPLLIVAEDVEGEALATLVVNNIRGILKTCSVKAPGFGDRRKAMLEDIAVLTGGQVIAEEVGLTLEKATLAELGQAARIEIGKENTIIIDGAGEGSRIEGRVKQIRAQIEEATSDYDREKLQERVAKLAGGVAVIKVGAATEVEMKEKKARVEDALHATRAAVEEGIVPGGGVALLRARANLGTLKGDNHDQDAGIKIVLRALEQPLREIVANAGDEPSVVVNRVVEGTGNFGYNAATGEYGDLVDMGVLDPTKVERIALQNAASVAGLMLTTDCMVGELAEEKPSMGGMGGMGGMGGMGGMDMGM

SEQ ID NO: 2677 - protein, 483 aa, Citrus sinensis
MAFALSNQVQLLSKIAAGNGHGEDSPYFDGWKAFESDPYHPTKNPNGVIQMGLAENLLCHELVEDWLMNNPKASICSAEGLNEFKGIAIFQDYHGLPEFRNAVAKFMGKVRGNRITFDPDRIVMSGGATGAHETVAFCLADPGDAFLVPTPYYPGFDRDLRWRTGVQLVPVVCDSSNDFKVTMEALEAAYEKAQESNIRIKGVLITNPSNPLGTFLDRETLKDIVSFINEKNIHLVCDEIYAATVFTKEPSFVSIAEIIDQDIACNRNLIHIVYSLSKDMGFPGFRVGIIYSYNDQVVSCARKMSSFGLVSSQTQHLIATMLSDDQFVEKFIAESAKRIAERHKAFTWGLSQVGIGCLKSNAGLFLWMDLHHLLKEQTYEAEMALWRVIINEVKLNVSPGSSFHCPNPGWFRVCFANMDDRTMEIALSRITSFMLKNVEAKVPNKKKLCWQRSLRLSMSSRRMDDFMASPCMSPQSPLVQART

SEQ ID NO: 2678 - protein, 544 aa, Treponema denticola
MAKQLLFNEEARKSLLAGVEQISNAVKVTLGPKGRNVLIDKSFGAPTVTKDGVSVAREVELENKFENMGAQLLKEVATKTNDVAGDGTTTATVLAYSMVKEGLKAVAAGMTPLELKRGIDKAVAIAVEDIQKNSKEIKGSEEVAHVASVSANNDAEIGKIIADAIAKVGKDGVIDVGEAQTMETVTDYVEGMQFDRGYISSYFVTDRDRMETVFENPYILIYDKSISTMKDLLPLLEQVAQSGRPLLIIAEDVEGEALATLVVNSLRGALKTCAVKAPGFGDRRKEMLEDIAVLTGGQVVSEELGFKLEAAQISMLGQAKSIKIDKDNTMIIDGAGKSKDIKDRVTQIKAQLDATDSEYDSEKLRERLAKLSGGVAVIKIGAVTEVEMKEKKHRVEDALSATRAAIEEGIVAGGGLAMIQAIAALEKADMSSLTEDEKVGFKIVKRALEEPIRQIAENAGLDGAVIAEKAKEKKGVGFDAAKMEWTDMVKAGIIDPAKVTRSALQNAASIASLLLTTECAITDIPEKQAGPAMPSPDMGGMGMY

SEQ ID NO: 2679 - protein, 367 aa, Pseudomonas syringae
MSAAALFTPFRLGGLELSSRVVMAPMTRSFSPGHVPNSKVIEYYRRRAAAGVGLIITEGTTVNHPASNGYPNVPQFFGDAPLAGWKKVVDAVHAEGGKIAPQLWHVGAVRRLGTEPDGSIPAYGPMEKVKDGQVLVHGMSKQDIDEVVAAFAQAAADAKAIGMDGVEIHGAHGYLVDQFFWEGSNQRSDEYGGSLANRSRFAIELIKAVRAAVGPDYPIIFRFSQWKQQDYSARLVQTPEALGEFVQPLSDAGVDIFHCSTRRFWEPEFEGSELNLAGWTRKLTGKPTITVGSVGLDGEFLQFMVNTEKVAQPASLENLLERLGKDEFDLVAVGRALLVDPDWAVKVREGREQDILPFSREALTTLV

SEQ ID NO: 2680 - protein, 446 aa, Zea mays
KENPPHRRGGPGGRAGMAYAARRKKRVGRYEVGRTIGQGTFAKVKFAVDADTGAPVAMKVLDKETIFAHRMLHQIKREISIMKIVRHPNIVRLNEVLAGKTKIYIILELVNGGELFDKIARYGKLRENEARKYFQQLIDAIDYCHSKGVYHRDLKPQNLLLDSRGNLKLSDFGLSTLSQNGVGLVHTTCGTPNYVAPEVLSSNGYDGSAADIWSCGVILYVLMAGYLPFEENDLPHLYEKITAAQYSCPYWFSPGAKSLIQRILDPNPRTRITIEEIREDPWFKKNYVTIRCGEDENVSLDDVQAIFDNIEDKYVSDEVTHKDGGPLMMNAFEMIALSQGLDLSALFDRQQEFVKRQTRFVSRKPAKTVVATIEVVAESMGLKVHSRNYKVFEVAPSLFMVDVRKVAGDTPEYHRFYENLCSKLCSIIWRPTEVSAKSTPLRTTTC

SEQ ID NO: 2681 - protein, 333 aa, Unknown
  Azoarcus sp. EbN1
MRRVTLTQFLIEQQRAGRTSPDLRLLIEVVARAVKAIAVNVSKGALADLLGEAGTDNVQGEAQKKLDVIANEILLQANEWGGHLAAMASEEVEEVHQIPFDYPKGGYLLLFDPLDGSSNIDVNISVGTIFSVLRFPEGIQEPNEQCFLQPGREQVAAGYALYGPSTLLILTVGNGVHGFTLDREMGSFVYTHPFMTVPVDTQEYAINASNARHWEPPVQRYVAELQQGRTGPRGKDFNMRWVASMVADVHRVLTRGGIFMYPLDEKCRDQGGKLRLMYEANPMAMIVEQAGGSATTGRQRILDVQPAKLHQRVPVILGSTHEVERVTAYHREG

SEQ ID NO: 2682 - protein, 252 aa, Arabidopsis thaliana
MFQVPCSKDNYAYLLHDEDTGTVGVVDPSEAAPVIEALSRKNWNLTYILNTHHHDDHIGGNAELKERYGAKVIGSAVDKDRIPGIDILLKDSDKWMFAGHEVRILDTPGHTQGHISFYFPGSATIFTGDLIYSLSCGTLSEGTPEQMLSSLQKIVSLPDDTNIYCGRENTAGNLKFALSVEPKNETLQSYATRVAHLRSQGLPSIPTTVKVEKACNPFLRISSKDIRKSLSIPDSATEAEALRRIQRARDRF

SEQ ID NO: 2683 - protein, 546 aa, Psychrobacter arcticus
MAKDVKFGIDARKQMMDGVNILANAVRVTLGPKGRNVVIDKSFGAPTITKDGVSVAKEIELENKFENMGAQLVREVASRTNDVAGDGTTTATVLAQSILQEGMKSVAAGMNPMDLKRGIDKAVRAAVEQIHLLSTPADDSKAIAQVGSISANSDTKIGELIAQAMEKVGKQGVITVEEGSSFEDTLEVVEGMQFDRGYISPYFANKQDSLTAEFENPYILLVDKKISNIREIVPLLEQVMQQSKPLLIIAEDVENEALATLVVNNMRGGLKTCAVKAPGFGDRRKAMLEDIATLTGGTVISEEIGLSLETATLEQLGTAKKVTVGKENTVIVDGAGHSADIENRVESIRRQVEESTSDYDKEKLQERMAKLAGGVAVIKVGAATETEMKEKKDRVDDALHATRAAVEEGVVPGGGVALVRAMNALSELRGDNDDQNAGINILRRAMEAPLRQIVTNSGEEASVVVNEVKSGSGNYGYNAASGEYGDMLEMGILDPAKVARSALENAASVAGLMLTTEVMITDLPQGDDGMAGMGAGGGMGGMGGMM

SEQ ID NO: 2684 - protein, 140 aa, Oryza sativa
MRKYRLAGLVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANA

SEQ ID NO: 2685 - protein, 245 aa, Populus tremuloides
MGRGRVELKRIENKINRQVTFAKRRNGLLKKAYELSVLCDAEVALIIFSNRGKLYEFCSTSNMLKTLERYQKCSYGAEEVNKPAKELENSYREYLKVKARFEGLQRTQRNLLGEDLGPLNTKDLEQLERQLESSLNQVRSTKTQYMLDQLADLQNKEHLLQEANRGLTIKLDEISARNSLRPSWEGDDQQNMSYGHQHAQSQGLFQALECNPTLQIGYNPVGSDQVSAITHATQQVHGFIPGWML

SEQ ID NO: 2686 - protein, 702 aa, Xanthomonas campestris
MAKSPSKSAQVPALAPANTTVDGSRGTGDELHQKAGGTHPQLTTNQGIPVGDNQNSLRATPRGPTLLEDFILREKITHFDHERIPERIVHARGSAAHGYFELTKSLSQYTTAKIFTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMVMWAMSDRTIPRSLRMIEGFGIHSFRFLNDKGESTFVKFHWRPKLGLQSTIWDEAVKIAGADQDFHRRDLFEAIQNGDFPEWELGVQLFTEAQAATFPFDHLDSTKVIPEELVPLQIVGRMVLDRWPDNFFAETEQVAYCPANIVPGIDFSNDPLLQGRLFSYLDTQLSRLGGPNFHQIPINAPKCPFANNQRDGHMQMSVPKGRVAYEPSSLQADAPREALRGFPSHATAAEEGTKGRVRAERFADHYSQARLFFRSQTAPEQAHIASALVFELSKVETAHVREAIVGHLRHIDQELAQRVADGMGMTALPPAPPAAVAPIDMPLSPALQVIGKMKDTLKGRTVGILIHDGSDAAAIKAVRKAAEAAGATVKIVAPKLGGAKLSDGKPLAADGQLAGTPSVVFDAVAVLLSSEAAKLLTRESAALDFVSFAWAHLKAIAFDEGAQLLLKAGNVGKDAGVVPAADTKAFITAAKTRQWAREPKVRMLA

SEQ ID NO: 2687 - protein, 455 aa, Streptomyces griseus
MSVAVVLFTSDLRLHDNPVLRAALRDADEVVPLFVRDDAVHRAGFDAPNPLAFLADCLAALDAGLRHRGGRLIVRRGEAATEVRRVAEETGAARVHIAAGVSRYAARREQRIREALADSGRELHVHDAVVTALAPGRVVPTGGKDHFAVFTPYFRRWEAEGVRGTQTAPRTVRVPDGVASDPLPDRDCVENLSPGLARGGEEAGRKLVTSWLNGPMADYEDGHDDLAGDATSRLSPHLHFGTVSAAELVHRAREKGGLGGEAFVRQLAWRDFHHQVLADRPDASWSDYRPRHDRWRSDADEMHAWKSGLTGYPLVDAAMRQLAHEGWMHNRARMLAASFLTKTLYVDWREGARHFLDLLVDGDVANNQLNWQWVAGTGTDTRPNRVLNPVIQGKRFDARGDYVRGWVPELAEVEGSAIHEPWKLQGLDRAGLDYPDPVVDLAEARARFERARGLD

SEQ ID NO: 2688 - protein, 686 aa, Unknown
  Azoarcus sp. EbN1
MTHPLSALRPTPPLPGGNYPHLLEPLDLGFCTLKNRVLMGSMHTGLEESGNGFEKLAAFYARRARGGVGLIVTGGIAPNADGVIFPGASMLTSEDEVPHHRAIAAAVHAEGGKICMQILHTGRYAYHRGSVAPSALKAPISPANPREMNEADIERTIEDYARCAALAKSAGYDGVEVMGSEGYLINEFTVPHTNHRTDGWGGSVGNRHRFPVEIVRRVRERVGAEFIIIYRLSMLDLVEGGAPWEEIVALAKAVEAAGATLINTGVGWHEARIPTIATMVPRGAFSWVTRRMKGEVGIPLITSNRINTPEVAENVLTRGDADMVSMARPFLADPDFVVKAATGRAAEINTCIACNQACLDHIFEAKPCTCLVNPIACRELEFVITPATAKKRVAVVGAGPAGMAAAATAAERGHSVTLFDSAAEIGGQFNLAKHIPGKEEFAETLRYFRHRLDKAGVEVKLERRVGANDLVGRFDTVLLATGISPRTPDIPGIDHPKVTSYVDVITRRKAVGRTVAVIGAGGIGFDVSEFLTHADLADDPIEHYRREWGIDATYARRGGLGTASEEKPPRQLWLLQRKPTKVGEGLAKTTGWIRRTLLARRGVKMLAGVRYEKIDDAGLHLRIGDERQVLPVDTVVVCAGQEPLRDLEAPLQAAGMPVIRIGGADVAAELDAKRAIDQGTRVAAAL

SEQ ID NO: 2689 - protein, 294 aa, Listeria monocytogenes
MTKTLQDRMILPGNGTIPYIGLGVFQVTEQEFIAGAVEKAIEVGYRLFDTAAVYNNEAIVGQAIASSAVSREELFISSKVWNGDLGYDETLFAFERTLRNLKLDYLDLYLIHWPVAGKYRDSWRAMERLHDEKLIKSIGVANFKQHHLSDLLVAANEKPVLNQVETHPLLPQNDLRKYLVEQNIAHAAWSPLAKGILMQNPVITEIAKKHQASVDQVILQWHLNRNTIIFPKSITSSRIEENSRLSYFQLDASDMEKIDRLETGKRVGPDPDDLEYFLSSIERERAYLASENEE

SEQ ID NO: 2690 - protein, 310 aa, Zygosaccharomyces rouxii
MVTLQNSTSTLKLNTGQTIPQVGLGTWRSKENEGYKAVIEALKAGYRHIDGAAVYGNEGEVGKAIQDSGVPRNEIFLTTKLWCTHQRNPQEALDQSLQRLGLDYVGLYLVHWPVPLRTENIKDGNLFQFAEKPDGSKDVDLEWNFIKTWELMQKLLESGKTKAIGVSNFSVNNLKDLLAAPTTKVTPAVNQVEFHPLLPQEELIQYCSEKGIVIEAYSPLGGENAPILSDPTVQEIAKANGVEAGHVVISWAVQKGLVTLPKSVTPSRIVGNLKVLTLSDSDVAKVDGLLKAKGERRTCYQDFSPFPIFQ

SEQ ID NO: 2691 - protein, 487 aa, Medicago truncatula
MGLVSMDQPQLLSKIATGDGHGETSSYFDGWKAYDKNPFHPTKNPQGVIQMGLAENQLTADLVQNWIMSNPEASICTLEGVHNFKEMANFQDYHGLPEFRNAVAKFMSRTRGNRVTFDPDRIVMSGGATGAHEATAFCLADPGDAFLVPTPYYPGFDRDLRWRTGVKLVPVICESANNFKLTKQALEEAYEKATEDNIRIKGLLITNPSNPLGTVMDRNTLRTVVNFINEKRIHLISDEIYAATVFSHPSFISIAEILEHDTDIECDRNLVHIVYSLSKDMGFPGFRVGIIYSYNDTVVNCARKMSSFGLVSTQTQYLMAKMLSDDEFVKKFLTESAKRLAQRYRIFTSGLTKVGINCLQSNGGLFVWMDLRGLLKEATLESELELWRVIIHEVKINVSPGVSFHCSEPGWFRVCYANMDDRDVQIALQRIRSFVVQNNKEVMVSEKNTKPCWHSNLRLSLKTRRFDDIVMSPHSPFPQSPLVKATT

SEQ ID NO: 2692 - protein, 273 aa, Nostoc punctiforme
MTIATSTKPQINWVNTLFFIGLHIGALFAFVPGNFSWTAVGVGFLLYWVTGGLGVTLGFHRLVTHRSFQTPKWLEYLLVFFGTLSCQGGPIEWIGTHRIHHLNSDTDTDPHDSNKGFWWSHMGWLTHYCPAHADVPRFTKDIAEDPVYQFLEKYFILIQVALGVLLLLLGGWPFVIWGIFVRIVWVYHCTWLVNSATHKFGYQSYDSGDKSTNCWWVAVLVFGEGWHNNHHAFQYSARHGLEWWEIDLTWMTVQLLQAVGLATNVKLAPAKSS

SEQ ID NO: 2693 - protein, 156 aa, Arabidopsis thaliana
MSLVPSFFGGRRTNVFDPFSLDVWDPFEGFLTPGLTNAPAKDVAAFTNAKVDWRETPEAHVFKADVPGLKKEEVKVEVEDGNILQISGERSSENEEKSDTWHRVERSSGKFMRRFRLPENAKVEEVKASMENGVLSVTVPKVQESKPEVKSIDISG

SEQ ID NO: 2694 - protein, 251 aa, Sinapis arvensis
ENQLCFDLIESWLAKNPDAASLKRNGQSIFRELALFQDYHGMPEFKKAMAEFMEEIRGNRVTFDPKKIVLAAGSTSANETLMFCLAEPGDAFLLPTPYYPGFDRDLKWRTGAEIVPIHCSSSNGFQITESALQQAYQQAHKLDLKVKGVLVTNPSNPLGTALTRRELNLLVDFIASKNIHLISDEIYSGTMFGFEQFISVMDVLKDKKLENTEVSKRVHVVYSLSKDLGLPGFRVGAIYSNDEMIVSAATK

SEQ ID NO: 2695 - protein, 605 aa, Legionella pneumophila
MFGFISDLLTAAVSSLDELLQDTPAHQIILGTAALYFLYNQYHNPSISRWYLSRNNASMKQRIIDSAYALAKNLPGVNQIIEKELNKELSSTREKLRIQRSGMTLREEIPEEGLSPQDILSAFDVDVEKCHFDFLSVNNDSPEREFLVGGGDGKDSGALYAIHPKELTELLKEVYGATALTNPLHDKWPRINAMQAEVIRWCQNLFHGSKEGYGLLTHGGTTSIIEAMAAYVIRARAKGIDYPEIVVPETAHAAFKKAAELTGAILITVPVDKKTGAVNPRVMSSYITRNTAVIVGSAPSFMNGIHDPVSELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIIKLRNAIQKELTALVEEGNGLTSEDIYVYGNPQWSILGFRSNTCNAHFIADELEKRGWKLNLLQNPDGFHLCLTHVHTLVRGFETQFIKDLREAVIDVKNYPPGKKASGNVKVYGAVGMMPIELQKEICKQYQKARLDFTAASHGSLGIFTTSPTEEDDGLRNRKVGEQKVQTSL

SEQ ID NO: 2696 - protein, 138 aa, Zea mays
AGRAGAQHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEECASA

SEQ ID NO: 2697 - protein, 371 aa, Candida albicans
MSSVASKKIITFEGHRNFRLRLVLATLSGKPIKITKIRSQDLNPGLKDHEVSFLRLLEAVTNGSHIEISYTGTTIIYRPGIIIGGDLTHNCPDTKSIGYFIEPMLMLAPFSKKKFSIIFKGLTNIAGNDTGVDAIKWGLLPVMEKFGVREVSLHILKRGSAPLGGGEVHLLCSSLIPQPLTIHALDIPKFSAIRGVAYCTRVSPSIVNRMIDSARAVLKPTGCEVNITADVWRGENSGKSPGFGITLVAESKRGWRIVTENVGSAGSLPEDSGELTAYQLLEEISNSGVVGRYQLPLALVYMTIGKEDIGRLKIQKSEIDENLVSVLRDIQEVFGTEAFFKDDAEELDSDDKFMTVSIKGVGFTNVSKKIA

SEQ ID NO: 2698 - protein, 124 aa, Zea mays
HASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAVVYLMLVNDLIHGLYPEAVTIGEDV

SEQ ID NO: 2699 - protein, 200 aa, Glycine max
  misc_feature (199)..(199): Xaa can be any naturally occurring amino acid
YDIVKFCKNEGLVLLADEVYQENIYADNKKFHSFKKIVRSLGYGEEDLPLVSYQSVSKGYYGECGKRGGYMEITGFSAPVREQIYKIASVNLCSNITGQILASLVMNPPKASDESYASYKAEKDGILASLARRAKALEVAFSKLEGITCNKAEGAMYLFPQICLPQKAIEAAKAANKAPDAFYALRLLESTGIVVVPGXG

SEQ ID NO: 2700 - protein, 314 aa, Arabidopsis thaliana
MEKTLVGGCGGENEEVILGKELDFLGREQVSNIRRDSFVEPLGSILLQLEAFWVFPWLVFINGICITLSYHRNLSHRSFDLPKWLEYLFAYGGVLAFQGDPIEWVSNHRYHHKHCETQRDPHSPTQGFWFSHMAWIFDTSSILENNTLFPIRGRDLTLTKPLGACSQCGGEENVDDLVRQPFYRFLQRTVLLHMMAYSFLFYFCGGMPLLVWGIGITIAVRLHLTFLVNSVCHIWGTRAWNTSDFSKNNWWVAILTLGEGWHNNHHAFEFSARHGLEWWQLDITWCLIRFLEAIGLATNVKLPTETQMKGKALV

SEQ ID NO: 2701 - protein, 135 aa, Arabidopsis thaliana
  misc_feature (79)..(79): Xaa can be any naturally occurring amino acid
  misc_feature (90)..(90): Xaa can be any naturally occurring amino acid
  misc_feature (92)..(92): Xaa can be any naturally occurring amino acid
  misc_feature (102)..(103): Xaa can be any naturally occurring amino acid
  misc_feature (109)..(109): Xaa can be any naturally occurring amino acid
  misc_feature (112)..(112): Xaa can be any naturally occurring amino acid
  misc_feature (115)..(116): Xaa can be any naturally occurring amino acid
  misc_feature (119)..(119): Xaa can be any naturally occurring amino acid
  misc_feature (121)..(122): Xaa can be any naturally occurring amino acid
  misc_feature (128)..(133): Xaa can be any naturally occurring amino acid
MASSMLSSTAVVTSPAQATMVAPFTGLKSSASFPVTRKANNDITSITSNGGRVSCMKVWPPIGKKKFETLSYLPDLSDXVNLVKEVDLPXSXTKWVPCVEFXXGHGFFXPLXTGXXPGXLXXGRVLGXXXXXXFF

SEQ ID NO: 2702 - protein, 105 aa, Lactococcus lactis
MLYGKENRDEAEFLEPIFGSESEQVDLPKYKLAQQSIEPRVAYQLVQDEMLDEGNARLNLATFCQTYMEPEAVKLMSQTLEKNAIDKSEYPRTTEIENRCVNMIA

SEQ ID NO: 2703 - protein, 173 aa, Candida albicans
MCLCLSDLFLIVLSVLFPPLPVWIRKGCCSCDSLINIALCMLGYFPGLIHSWYIIAKYPPYYYQQQQQQQQRKDTIYYVYRSDLENQTPRRDGRDGRDECHHDHHHHHHHHHNQAESQSAGLIVSNNHNNNNNNYGSVVEGSSSSNLTPVAPIPVENGAPPPAYTEIDNKTQH

SEQ ID NO: 2704 - protein, 509 aa, Triticum aestivum
MEGNTRGGGHSDALKNYNVGRTLGIGTFGKVRIAEHKHTGHKVAIKILNRRQMRTMEMEEKAKREIKILRLFIHPHIIRLYEVIYTPTDIFVVMEYCKYGELFDCIVEKGRLQEDEARRIFQQIISGVEYCHRNMVAHRDLKPENLLLDSKYNVKLADFGLSNVMHDGHFLKTSCGSPNYAAPEVISGKLYAGPEVDVWSCGVILYALLCGTLPFDDDNIPKLFKKIKGGIYILPSHLSALARDLIPRMLVVDPMKRITIREIREHPWFQNRLPRYLAVPPPDTAQQAKMIDEDTLKEIVNLGYDKDHVCESLCNRLQNEATVAYYLLLDNRFRATSGYLGADYLQSMGRSFNQFTSLESASPSTRQYLPASNDSQGSGLRPYYPVERKWALGLQSRAQPREIMIEVLKALQELNVCWKKNGHYNMKCRWCPGFPQVSDMLDANHSFVDDSTIMDNGDANGRLPAVIKFEIQLYKTKDDKYLLDMQRVTGPQLLFLDFCAAFLTNLRVL

SEQ ID NO: 2705 - protein, 176 aa, Gossypium barbadense
LFSFILILTHFLLKSSIRIQVLGWICVAISVSVFAAPLNIMARVIRTESVEFMPFTLSFFLTLSAVMWFAYGLFIKDLCVALPNVLGFILGMLQMLLYAIYRHSEKVNIEEKKLPAEQMKSINVVLTTLGASEVHPVVLDIHTDDTKEEDNKNNEPTGEPDKQTDVKMEDANESPV

SEQ ID NO: 2706 - protein, 157 aa, Lactococcus lactis
FVDPELEWDFRLKNVISINTSGHKYGLVYTGVGWVLWRDKKYLPEELIFKVSYLGGELPTMAINFSHSASQLIGQYYNFVRYGFDGYKAIHERTHKVAMYLAEEIEKTGMFEIMNDGSQLPIVCYKLKENSNLGWNLYDLADRLFNEGMASACLSTS

SEQ ID NO: 2707 - protein, 197 aa, Davidia involucrata
MVVMETWLLNCYHRYKEDVKILKKMGLNAYRFSISWSRVLPCGRLSGGVNKEGINYYNNLIDELLHNGIEPYVTLFHWDLPQALEDEYGGFLSPRIVEDFCNYVELCFWEFGDRVKHWITFNEPWSYSVAGYVNGVFPPGRGATSPEPVRRSNIKTISALHRSSGNQGLRMIINSGDPGTEPYIVSHYQLLAHAAAV

SEQ ID NO: 2708 - protein, 695 aa, Psychrobacter arcticus
MNKNIDHTDPAKDMNMERGNGGETHQRAGDDTKILTTQQGVPISDNQNSLKAGPRGPTLLEDFVLREKIHHFDHERIPERIVHARGSAAHGYFELTESLEEYTTAKILTETGKQTPLFTRFSTVAGSKGSKDTPRDVRGFAVKIYTEEGNWDLVGNDMPIFFIQDAMKFPDLVHAVKPEPDRGFPQAASAHDTFWDFVSLSPETMHNVIWLMSDRGIPRSLRMIEGFGIHSYRLINKAGKSTFMRFHWKPVLGVQSTTWDEAVKISGADPDYHRRDLFESINNGDFPEWEFGVQLFTEEEASKFPFDHLDATKMIPEEMVPVKIVGKMVLNRYPDNFFAETEQVAFCPSHVPPGIDFSNDPLLQGRLFSYLDTQLSRLGSPNFAQIPINAPKCPFANNQQDGHMQMQVPKTRVLYEPQSLDPTRPRESVKRGFASFAETLDDGVKGRIRAESFADHYSQPRMFYRSQTTIEQAHIASAYAFELGKVDTAHVRSRTLGHLRNIDEDLASRVAKALGMELPEAADAAAPIQDMEISPAVRTIGLSPKSLKGRMIGILVAEGSKHSEIEKYEKAAQAQGASVKIIAPNKEVTLDDDTIIQADERVAGGPSVMFDAVVSIIMPDQAKKLAKDSATLDWFTDAYVHCKAISYCGATDEFILSKLPIEKDAFVTPLSDLDVFIENAKSRLWEREPKVRDLA

SEQ ID NO: 2709 - protein, 499 aa, Secale cereale
PQIVNDGVTVAREVELEDPVENIGAKLVRQAAAKTNDLAGDGTTTSVVLAQGLIAEGVKVIAAGANPVQITRGIEKTAKALVLELKKMSKEVEDSELADVAAVSAGNNYEIGNMIAEAMSKVGRKGVVTLEEGRSSENNLYVVEGMQFERGYISPYFVTDSEKMTTEYENCKLLLVDKKITNARDLINVLEEAIRGQYPILIIAEDIEQEALATLVVNKLRGSLKICAIKAPGFGERKTQYLDDIAILTGGTVIRDEVGLTLDKADNTVLGTAAKVVLTKESTTIVGDGSTQEEVTKRVAQIKNLIEAAEQDYEKEKLNERIAKLAGGVAVIQVGAQTETELKEKKLRVEDALNATKAAVEEGIVVGGGCTLLRLAAKVDAIKDTLENDEQKVGAEIVRRALCYPLKLIAKNAGVNGSVVTEKVLSNDNFKFGYNAATGQYEDLMAAGIIDPTKVVRCCLEHAASVAKTFLTSDVVVVEIKEPEAAPLANPMDNSGFGY

SEQ ID NO: 2710 - protein, 174 aa, Lycopersicon esculentum
NCVGFVCPEYFKSDFVYRTLWLQDSPSEDITSILYDVFDYFEDVREQHGKVFVHCCQGVSRSTSLVIAYRMWREGQSFDDAFEYVKAARGIADPNMGFACQLLQCQKRVHASPLSPSSLLRMYRVAPHSPYDPLHLVPKMLNDPSPAALDSRGAFIIHIPSSVYVWIGKKCEAI

SEQ ID NO: 2711 - protein, 703 aa, Xanthomonas axonopodis
MAKSPSKSAQVPAVSPAASATPDVSRGTGDELHQKAGGTHPQLTTNQGIPVGDNQNSLRATPRGPTLLEDFILREKITHFDHERIPERIVHARGSAAHGYFELTKSLSQYTTAKIFTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMIMWAMSDRTIPRSLRTIEGFGIHSFRFLNEKGESTFVKFHWRPKLGLQSTIWDEAVKIAGADQDFHRRDLFEAIQRGDFPEWELGVQLFTEAQAETFPFDHLDSTKVIPEELIPLQIVGRMVLDRWPDNFFAETEQVAYCPANIVPGIDFSNDPLLQGRLFSYLDTQLSRLGGPNFHQIPINAPKCPFANNQRDGHMQMGVPKGRVAYEPSSLQADAPREALRGFPSHATPAEEGAKGRVRAESFADHYSQARLFFRSQTAPEQAHIASALVFELSKVETAHVREAIVGHLRHIDQELAQRVADGMGMTALPPAPPAAVAPIDMPLSPALQVIGKMKDTLKGRTVGILIHDGSDAAAIKAVRKAAEAAGATVKIVAPKLGGAKLNDGKQLAADGQLAGTPSVVFDAVAVLLSSEAAKLLTRESAALDFVSFAWAHLKAIAFDEGAQLLLKAGNVGKDAGVVPAADTKAFIAAAKTRQWAREPKVRMLA

SEQ ID NO: 2712 - protein, 242 aa, Zea mays
MRVAATRPASSAPVALLAALALLFLVGSASLAIGAMASHVLGGKSENPAAANSLETDGLARFAVDEHNKRENALLEFVRVVEAKEQTVAGTVHHLTLEALEAGRKKVYEAKVWVKPWLDFKELQEFRHTGDATSFTISDLGAKRGGHEPGWRDVPVHDPVVKDAASHAVKSIQQRSNSLLPYELVEIVRAKAEVVEDFAKFDILMKLKRGTKEEKMKAEVHKNLEGAFVLNQMQPEHDESSS

SEQ ID NO: 2713 - protein, 274 aa, Saccharomyces cerevisiae
MQVKSIKMRWESGGVNYCYLLSDSKNKKSWLIDPAEPPEVLPELTEDEKISVEAIVNTHHHYDHADGNADILKYLKEKNPTSKVEVIGGSKDCPKVTIIPENLKKLHLGDLEITCIRTPCHTRDSICYYVKDPTTDERCIFTGDTLFTAGCGRFFEGTGEEMDIALNNSILETVGRQNWSKTRVYPGHEYTSDNVKFVRKIYPQVGENKALDELEQFCSKHKVTAGRFTLKDEVEFNPFMRLEDPKVQKAAGDTNNSWDRAQIMDKLRAMKNRM

SEQ ID NO: 2714 - protein, 477 aa, Streptococcus mutans
MSKLPENFLWGGAVAAHQLEGGWQEGGKGISVADVMTAGRHGVAREITAGVLEGKYYPNHEAIDFYHHYKEDVKLFAEMGFKCFRTSIAWTRIFPKGDEAEPNEAGLQFYDDLFDECLKYGIEPVVTLSHFELPYHLVTEYGGFTNRKVIDFFVHFAEVCFRRYKDKVKYWMTFNEINNQANYQEDFAPFTNSGIVYKEGDDREAIMYQAAHYELVASARAVKIGHAINPNLNIGCMVAMCPIYPATCNPKDILMAQKAMQKRYYFADVHVHGFYPEHIFKYWERKAIKVDFTERDKKDLFEGTVDYIGFSYYMSFVIDAHRENNPYYDYLETEDLVKNPYVKASDWDWQIDPQGLRYALNWFTDMYHLPLFIVENGFGAIDQVEADGMVHDDYRIDYLGAHIKEMIKAVDEDGVELMGYTPWGCIDLVSAGTGEMRKRYGFIYVDKDDEGKGTLKRSPKLSFNWYKEVIASNGDDI

SEQ ID NO: 2715 - protein, 540 aa, Clostridium difficile
MAKEIKFSEETRRALEAGVNKLADTVKVTLGPKGRNVILDKKFGSPLITNDGVTIAKEIELEDRFENMGAQLVKEVATKTNDVAGDGTTTATVLAQAIIREGLKNVTAGANPILLRKGIQKAVTVAVEELKNQSRIVETQEAISQVASISAGDEEVGKLIAEAMEIVGKDGVITVEESQTMNTELDAVEGMQFDRGFVSAYMVTDVDKMEAVLNDPYILITDKKISNIQELLPVLEQIVQQGKKLLIIAEDVEGEALSTLVVNKLRGTFDVVAVKAPGFGDRRKEMLQDIAILTGAQVISEELGYDLKEADLSMLGRASSVKVTKESTTIVDGSGDKKAIEDRVTQIKHQVEQTTSDFDREKLMERLAKLAGGVAVVKVGAATEVELKERKLRIEDALNATRAAVEEGIVAGGGTAFVSVIPAIGTLIESLEGEVKLGAQIVKKALEEPLRQIAINAGLEGAVIVQNVVNSEAETGFDALNEKYVNMIEAGIVDPTKVSRSALQNAASIASTFLTTEAAVADLPEKEDAGMPGTGMDGMY

SEQ ID NO: 2716 - protein, 348 aa, Oryza sativa
MVEQLRREISIMRMVRHPNVVGIREVLASRARVFVVMEYARGGELFAKVARGRLTEEHARRYFQQLVAAVGFCHGRGVAHRDLKPENLLLDEEGRLKVTDFGLAALPEQLRQDGLLHTQCGTPAYVAPEVLRKRGYDGARADLWSCGVVLYVLLCGFLPFQHENYAKMYQKIFKAEYQVPPWVSGDARRLIVRLLVVDPAKRISIPEIMRTPWFKKGFVPPVPTSPVSPKKWEEDDVLLDGGDSGAMSPRTCNAFQLISSMSSGFDLSGMFESEQKAATVFTSRAPAATVIQKLEAVGRSLGYSATRGKGWKLRLEATASVQRDVKSVGCISFSFFARGYVQAKSRDV

SEQ ID NO: 2717 - protein, 130 aa, Streptococcus mutans
MKFLHTCIRVKDLDASLKFYQEALDFKEVRRNDFPEYKFTLVYLQLEDDPDYELELTYNYDHEAYDLGNGYGHIAVGVDDLEATHQAHQKAGYTVTDLSGLPGKPKMYYFITDPDGYKIEVIRLKQFQEK

SEQ ID NO: 2718 - protein, 346 aa, Mycoplasma penetrans
MKKNLFDSFKIGNVEIKNRIVMPPMCMHTAKNGEVNDFHILHYGSRSIGGVGLIIVEATSVQQHYGNITDQDLGIWDDSFIFGLSKIATAIHKFGAKAAIQLGHAGRKCESKYVDKIYGPSPIKFESKYVNYLTPTEMTIKEIQEVKQHFIDAAIRAKKAGFDMVEIHAAHGYLLSSFLTPISNQRDDVYGQNKALLLEEILTGIKKANGSDYPIIVRISAYDWHPNGNKPQDFIEMLNPLIKQSLIDAIDVSTGGTTEDAKITAYDCYQIPFCLEIKQNVNVPCIGGGLIVDAKSANKIVENEAADAVYIGRQLLRNPYWPIQASEDLNIDIKFPKQYERAKLVK

SEQ ID NO: 2719 - protein, 534 aa, Nicotiana plumbaginifolia
MGNCCSRGQPDDNEHTSNNDQKSNTKNDQSISNNSQQQQNNGSITPSKSPDPSSKPSKNSPIGPVLGRPMEDVRKTYSIGKELGRGQFGITHLCTHKQSGEQFACKTIAKRKLVNKEDIEDVKREVQIMHHLTGQQNIVELKGAYEDKHSVHLVMELCAGGELFDRIIAKGHYTERAAATLLRTIVQIVHTCHSMGVIHRDLKPENFLLLNKDEDSPLKATDFGLSVFYKQGDVFKDIVGSAYYIAPEVLKRRYGPEVDIWSVGVMLYILLSGVPPFWAETEHGIFNAILRGHVDFSSDPWPAISHGAKDIVKKMLTIDPKQRLTAIQVLNHPWIKEDGEAPDTPLDNAVLSRLKQFRAMNNFKKVALRVIAGCLSEEEIMGLKQMFKSMDTDNSGAITLEELKQGLAKQGTKLSDHEIEQLMEAADADGNGTIDYEEFITATMHMNRMDKEEHLYTAFQYFDKDNSGFITIEELEQALREFGMTDGKDIKEIVAEVDSNNDGRINYEEFVAMMRKGTPETAANLKKRRESFVA

SEQ ID NO: 2720 - protein, 336 aa, Pseudomonas syringae
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPETTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 2721 - protein, 1425 aa, Ashbya gossypii
MTAGHRDERPDREGGSERDEHLNRVVQSVSDATKRLSQISNSSTAHTKTGKRKNRDTVGPWKLGKTLGKGSSGRVRLAKNMQSGKLAAIKIVPKRNVRHNQKQVTALPYGIEREIIIMKLITHPNIMALYEVWENKSELYLVLEYVEGGELFDYLIARGKLPEQEAIHYFKQIVQGVSYCHNFNICHRDLKPENLLLDKKNKTVKIADFGMAALETTNRLLETSCGSPHYASPEIVMGQKYHGSPSDVWSCGIILFALLTGHLPFNDDNVRKLLLKVQHGRYQMPSNVSKEAKDLISKILVVDPEKRITVDKILEHPLLVKYDNPGKGGLACPLEKPEERPKVLDIHSIDDIDETILSNLQILWHGAPKEYLVDKLLQSGFTEEKLFYALLLRYQQRQSVEPTSVPSNMASTNGSGAFARASNNDQSVINAPKVTQKSQFSINSLLVSPKKTREGYVASSSRVFKHSVSRRSLHVSPSPMKSSTSCRSLKSSSSKRLQSPNPKAITQPVKVTSPQPRRRTLHNSASKRSLYSLTSISKRSLNLNEFLQEANEVKTPKLPSMPLQDQPRSEAPKTPTKTTYGADSHGGEKPTFISVLHDCPTVDSEGMVFKSSSGTPMIAANAPIIQPAFIFGVGAFPGTKQPSSNSLSKPSLNSQSSPKQAQEATANSMRETIRDRQTLVVEKRVPSKTESVPPAFPRVRPIMERKHGSDLTLVRDTRSVAKEKRSSLSLDPRRTAPEPPRGIETLLRRYSLKNSIKSRSSLKKKRDSGAWSITDKTIFQDLGQVPEDEEQEKDSEEKGNDTFISTTETSDTPSSKFKVTTSTPIKKDDATAISAENAAVGTEQSGSEDEATNFDSNAHSYPISTDLKTEDDLTPIKPQGQTDLLRMPSSFMNSSNTFANLNNFISNIDKEYSPENSDSGRIEKDEPAGKAQPEQITVKKRQRTLAPGGYLSPSIPRMESENSLNQELGSRISDLSDLSFANDMPTYTNTAHAVSISPGTRNVCSFSPLEPRSPQDVSNNGKMRSNLHIPLRQLSEDMCDKTITTQEGESVNIFEDAPEEEGSLTTSTSGSVPNIHQKAISIDTMNTSCALVPVSHVRTSIHMNGDSSVLDWSTSDGILSKARPLPTSNHVRKKSGNRLSNNLTLSKSMMSMFKNLDQINVTDIQDPMPVSDLLSKGVDPIEPIEPLKNDQVTLKAESIGAESDSINMDLADRKHVTIFHDNVSDKNFKSTRMENSDKGSLGSGAPQATHLFHTGNKDMKSHETLLSPITETPAAALSATSLTRKESISSDGKSVKDETKKSGKGNWFMRLIMSFTKPKKTVIQEHMTVLPFDDVNIITLQQFSYQGVEYEIRQMERRKDKQKVEYDCRLLDGDFKFKINIYGENSAATKVSVKQKGRSDELAFTKLNTDIEALIKAKENAANVK

SEQ ID NO: 2722 - protein, 371 aa, Zea mays
MGSGGANTAPLITPYKMGKFDVSHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGLYMANALNEFGILYCHMVEPRMVKLGEKFETPYSLRPIRDAFRGTFIVAGGYGREDGNRAISTGYADLVAFGRLFLANPDLPRRFEVDAPLNKYNRDTFYIPDPVVGYTDYPFLSSDV

SEQ ID NO: 2723 - protein, 537 aa, Bifidobacterium animalis
MAKIIEYDEEARQGMLAGLDKLADTVKVTLGPKGRNVVLDKTYGAPTITNDGVSIAKEIDLEDPFERIGAELVKEVAKRTDDVAGDGTTTATVLAQSLVHEGLKNVVAGSNPIALRRGIEKASDALVKQLVASAKPVETKEQIAATATISAGDPEVGEKIAEALDKVGQDGVVTVEDNNRFGLDLDFTEGMRFDKGYISPYFVTNAEDQTAVLDDPYILLTSSKVSSQQDVVHIAELVMKTGKPLLIVAEDVDGEALPTLILNNIRGTFKSCAVKAPGFGDRRKAMLQDMAILTGGQVVSEDLGLKLDSIDLSVFGTAKKVIVSKDETTIVSGGGSKEDVAARVAQIRAEIEKTDSDYDREKLQERLAKLAGGVAVIKVGAATEVEAKERKHRIEDAVRNAKAAIEEGLVPGGGVALVQAAEKVEKDFNLEGDEATGAAIVFSGIEAPIKQIAENAGLSGAVVIDKVRSLPEGEGFNAATDTYEDLMAAGVTDPVKVTRSALQNAASIAGLFLTTEAVVANKPEPAAAPAAGQDMGY

SEQ ID NO: 2724 - protein, 435 aa, Triticum aestivum
  misc_feature (250)..(250): Xaa can be any naturally occurring amino acid
  misc_feature (276)..(276): Xaa can be any naturally occurring amino acid
  misc_feature (324)..(324): Xaa can be any naturally occurring amino acid
  misc_feature (359)..(359): Xaa can be any naturally occurring amino acid
MMGRKALDYEELNENVKKVQYAVRGELYLRASELQKEGKRIIFTNVGNPHALGQKPLTFPRQVVALCQAPFLLDDPNVGLIFPADAIARAKHYLSLAPGGLGAYSDSRGIPGVRQEVAEFIQRRDGYPSDPELIYLTDGASKGVMQMLNAIIRNERDGILVPVPQYPLYSAAISLFGGSLVPYYLEEEANWGLDLVSTRQSVAEARSKGITVRAMVIINPGNPTGQCLSEANIRELLNFCYQENLVLRAXEVYHPNVYQDEPPFISARKVMFDLGXPPVSREVQLISFHTVSKGYWGECGQRGGYFEMTNIPSKTVDEIYKESXWTLSPNVPGHIFMGLMINPSKTVYILYLTNSIQAXTFLQSAMTTAQIMTDCFHRVLMLLFYSSKRAVIISLFLKLQDLLMKTNFPMKDIFSISITIIPCTSNHQRLLHNAS

SEQ ID NO: 2725 - protein, 481 aa, Bacillus subtilis
MLYLEKTNGVINMSSNEKRFPEGFLWGGAVAANQVEGAYNEGGKGLSTADVSPNGIMSPFDESMTSLNLYHNGIDFYHRYKEDIALFAEMGFKAFRTSIAWTRIFPNGDEEEPNEEGLRFYDDLFDELLKHHIEPVVTISHYEMPLGLVKNYGGWKNRKVIEFYERYAKTVFKRYQHKVKYWMTFNEINVVLHAPFTGGGLVFEEGENKLNAMYQAAHHQFVASALAVKAGHDIIPDSKIGCMIAATTTYPMTSKPEDVFAAMENERKTLFFSDVQARGAYPGYMKRYLAENNIEIEMAEGDEELLKEHTVDYIGFSYYMSMAASTDPEELAKSGGNLLGGVKNPYLKSSEWGWQIDPKGLRITLNTLYDRYQKPLFIVENGLGAVDKVEEDGTIQDDYRINYLRDHLIEAREAIADGVELIGYTSWGPIDLVSASTAEMKKRYGFIYVDRDNEGNGTFNRIKKKSFNWYQQVIATNGESL

SEQ ID NO: 2726 - protein, 180 aa, Arabidopsis thaliana
MTTYGTNQKSSNDLAPKLEYITRGINQHKRSGLATRRPWKQMLDLGSFNFPRKLATVITRIRANTVYFQTNYTIVVLFSVFLSLIWNPFSLLVLLALLGAWLFLYFLRDEPLTVFDREIDHRIVLIIMSVITLSILFLTDAKLNIAVAIVAGALAVLSHAAVRKTEDLFQTDEETSLLNP

SEQ ID NO: 2727 - protein, 232 aa, Medicago truncatula
MALEALNSPTSTTPKFTFDEPNLPWTKRKRSKRSRSCTEEEYLALCLIMLARGHTNRHDFNPLNPPPTTIDNNNNNTKLSYKCSVCNKEFSSYQALGGHKASHRKNSVGGGGDDHPSTSSAATTSSANTNGGGVRSHECSICHRSFPTGQALGGHKRCHYEGVVGGGASAVTVSEGMGSTHSHQRDFDLNIPAFPEFANKVGEDEVESPHPVMMKKKARVFVVPKIEIPNFQ

SEQ ID NO: 2728 - protein, 445 aa, Clostridium cellulovorans
MEKLRFPKDFIFGTATAAYQIEGAYKEDEKGESIWDRFSHIPGNVAKMHNGDIACDHYHRYKEDVQLLKSLGIKSYRFSIAWPRIFPKGFGEINQKGIQFYRDLIDELIKNDIEPAITIYHWDLPQKLQDIGGWANPQVADYYVDYANLLFREFGDRVKTWITHNEPWVASYLGYALGVHAPGIKDMKMALLAAHNILLSHFKAVKAYRELEQDGQIGITLNLSTCYSNSADEEDIAAAHRSDGWNNRWFLDAALKGTYPEDMIKIFSDTNIMPELPKELFTEVFETSDFLGINYYTRQVVKNNSEAFIGAESVAMDNPKTEMGWEIYPQGLYDLLTRIHRDYGNIDLYITENGAAFNDMVNRDGKVEDENRLDYLYTHFAAALSAIEAGVPLKGYYIWSFMDNFEWAEGYEKRFGIVHVNYKTQERTIKKSAYWYKELIERSNK

SEQ ID NO: 2729 - protein, 334 aa, Actinobacillus pleuropneumoniae
MKTLGEFIIEKQAEYPEAKGELSGILSSIRLAAKIIHREINRAGLSQDILGVAGSENIQGEAQMKLDVFANETMKKALLAREEVAGFASEEDDNFVAFENDRAKNAKYILMTDPLDGSSNIDVNVSVGTIFSIYKRVSPIGSPVTMEDFLQEGRKQVASGYVTYGSSTMLVYTTGNGVNGFTYDPSLGLFILSHPDMKIPTEGKYYSINEGQYVTFPMGVKKFIKYCQESDEATKRPYSSRYIGSLVSDFHRNLLKGGIYIYPTSTVYPKGKLRLLYEGNPMAFLAEQAGGMATDGFNPILDIKPSELHQRVPFFVGSTSMVKQADKFMQECAE

SEQ ID NO: 2730 - protein, 666 aa, Vibrio vulnificus
MKCRSKVTLIAASLWLAASAQALEAKLSEKDLPLLAPEVQHETASKRVTSRFTRSHYKHFNFNDDFSRAMFNRYIEMLDYNKNIFTQADIDSFEKWSTELDDQLKEGNNQIAFDVYNLSMKKRFERFSYALKLLDQEITFDTDDEIELDRTDAAWPKDQTELNELWRQRVKYDALNLKLTGKDWPEIKEILEKRYNNAMKRITQTRNEDVFQLYMNAFAREVDPHTSYLSPRNAEQFQSEMNLSLEGIGAVLQMTDDYTVIRSLVAGGPASKSKQLGEGDRIIGVGQDKKDIVDVIGWRLDDVVQLIKGPKGTKVHLQVLPEGKDSKSYVVTIVRDKIRLEDRAVKAEVIEKDGKKIGVLEVPSFYVGLSADTDKLLTDLKGKGIDGIIVDLRNNGGGALTEATALTGLFIEKGPVVQVRDSYGRVKVNADTDGQISYSGPMTVLVNRYSASASEIFAAALQDYGRAIILGENSFGKGTVQQHRSLNHIYDLFDKEIGYVQYTIQKFYRIDGGSTQNKGVVPDIPFPTAIDPEETGESVEDNALPWDSIEKADYQVLQRNDSLIEQLRVKHDERIANELEFKFIAEDIAKYKAEKDDNTLSLNEKVRKQESEQADKQRLDRINQRQALAGKEAFKTLDDVPKDYETPDAYLDESVAIMVDMLKKPS

SEQ ID NO: 2731 - protein, 422 aa, Schizosaccharomyces pombe
MDRRHRVYRVFNQEMYVEPNFKVVKELGQGAYGIVCAARNVASKDQEAVAIKKITNVFSKSILTKRALREIKLLIHFRNHRNITCIYDLDIINPYNFNEVYIYEELMEADLNAIIKSGQPLTDAHFQSFIYQILCGLKYIHSANVIHRDLKPGNLLVNADCELKICDFGLARGCSENPEENPGFMTEYVATRWYRAPEIMLSFSSYHKGIDVWSVGCILAELLGGTPLFKGKDFVHQLNLILHQLGTPDEETLSHISSSRAQEYVRSLPKQRPIPFETNFPKANPLALDLLAKLLAFDPNRRISVDDALEHPYLAVWHDPSDEPVCDSVFDFSFEYIEDANELRRVILDEVLNFRQKVRRRSHPTNPTVNIPQPAQTVPSNDNGSFNVSSSSSSQTSNKKRHDHSYNETAAIDHKSDDNRHN

SEQ ID NO: 2732 - protein, 326 aa, Triticum aestivum
  misc_feature (255)..(255): Xaa can be any naturally occurring amino acid
  misc_feature (263)..(263): Xaa can be any naturally occurring amino acid
  misc_feature (266)..(266): Xaa can be any naturally occurring amino acid
  misc_feature (270)..(270): Xaa can be any naturally occurring amino acid
  misc_feature (286)..(286): Xaa can be any naturally occurring amino acid
  misc_feature (290)..(290): Xaa can be any naturally occurring amino acid
  misc_feature (301)..(301): Xaa can be any naturally occurring amino acid
MGVAHASSSAGEAVYSTFSSRYVREELPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKMLNDLLVAKNKETGWDVPIHVDAASGRFIAPFXQPELEWDXRLXLVRXHVSGHSMACVPGVGWXIWRXKPNLPETYFHXNYLGTIAHGHTNFPGGYQNMAQIIT

SEQ ID NO: 2733 - protein, 470 aa, Arabidopsis thaliana
MKQLSTKVTSNGHGQDSSYFLGWEEYEKNPYDEIKNPNGMIQMGLAENQLCFDLIESWLTKNPDAASLKRNGQSIFRELALFQDYHGMPEFKKAMAEFMEEIRGNRVTFDPKKIVLAAGSTSANETLMFCLAEPGDAFLLPTPYYPGFDRDLKWRTGAEIVPIHCSSSNGFQITESALQQAYQQAQKLDLKVKGVLVTNPSNPLGTALTRRELNLLVDFITSKNIHLISDEIYSGTMFGFEQFISVMDVLKDKKLEDTEVSKRVHVVYSLSKDLGLPGFRVGAIYSNDEMIVSAATKMSSFGLVSSQTQYLLSALLSDKKFTSQYLEENQKRLKSRQRRLVSGLESAGITCLRSNAGLFCWVDMRHLLDTNTFEAELDLWKKIVYNVKLNISPGSSCHCTEPGWFRVCFANMSEDTLDLALKRLKTFVESTDCGRMISRSSHERLKSLRKKTVSNWVFRVSWTDRVPDER

SEQ ID NO: 2734 - protein, 486 aa, Bacillus firmus
MNSGVHVGNSDSLKAVWFRRDFRLHDHTALKHAIEAIEKHGGKWLAFFYLDPKTASVEPVHHDYFFQTVMQFKQMLKTNGGDLYIITGTIEGGQLSKLLQAFPEIDAVYANDDRVGDGRLRDEAAEHFLAKQSIPFYTFEDAYLTEPDQVLKKDGTPYKVFTPYYKAWAKERKRTPAVIKRDVLLGSVHKGTAPDREAETLFNNLIKKCSYDWSAIGEEHAIKRLQMFTKKRLSGYKANRDFPSITGTSRLSPYIKTGAVSSRSIYYHILNAEADSYSAETFLKELAWRDFYRMVHFYEPDCKDREIMEGYRELNWSHDQDDLTSWKRGETGFPIVDAGMRQLLNEGWMHNRLRMITASFLTKDLLIDWRLGERYFERMLIDYDPSSNIGGWQWAASVGTDAVPYFRIFNPVTQSKRFDENGTYIRTYIPELNHVPDHYIHEPWKMSEEEQVKYKCRLDEDYPLPIVDHSKQRKKALSFFKGDDEE

SEQ ID NO: 2735 - protein, 484 aa, Zea mays
  misc_feature (377)..(377): Xaa can be any naturally occurring amino acid
  misc_feature (439)..(439): Xaa can be any naturally occurring amino acid
  misc_feature (460)..(460): Xaa can be any naturally occurring amino acid
  misc_feature (463)..(463): Xaa can be any naturally occurring amino acid
  misc_feature (470)..(470): Xaa can be any naturally occurring amino acid
MAATVAVDNLNPKVLKCEYAVRGEIVIHAQRLQQQLQTQPGSLPFDEILYCNIGNPQSLGQQPVTFFREVLALCDHPDLLKKEEIKTLFSADSISRAKQILALIPGRATGAYSHSQGIKGLRDAIASGIASRDGFPANADDIFLTDGASPGVHLMMQLLIRNEKDGILVPIPQYPLYSASIALHGGSLVPYYLNESTGWGLEISDVKKQLEDARSRGIDVRALVVINPGNPTGQVLAEENQYDIVKFCKNEGLVLLADEVYQENIYADNKKFHSFKKIVRSLGYGEEDLPLVSYQSVSKGYYGECGKRGGYMEITGFSAPVREQIYKIASVNLCSNITGQILASLVMNPPKASDESYASYKAEKDGILASLARRAKXALEAAFSKLEGITCNKAEGAMYLFPQICLPQKAIEAAKAANKAPDAFYALRLLESTGIVVVXPGSGFGQVPGTWHFRCTILPXEEXIPAIISXFTVFHEAFMAEYRD

SEQ ID NO: 2736 - protein, 473 aa, Aeropyrum pernix
MAADDIKSRLDRVLRELFLLSSRDINPWTGRVFTHVYDPGMDEVRKAASKALELYRDKTMLDFTVYPSIIELEKQLLGFAGHLFHAPEGYSGTFTYGGTESIILAVLAARERWRRAGKSGAGKIVMPITAHPAFAKAAYLLGLKVERVPVDSVTLQADPAIIEEKIDRDTVMIVASAVDYPYGSLDPVEDLGDIAAARDVWLHVDACIGGMVLAFASDAGEEVGKFDFGVEGVRSFSVDMHKYGYAPKGSSILLFRRARDKKPTIFVDSSWPGYPLVNQAILSTRSAGTLAAAWAVARTLGVEGYRELAGMVLEARRRIQKGLESLGLEVLGRPKAGILSFTDSDIDVVEVATRLGRAGWVVQLQPGNKHLGFPTSIHLTISPIHARVVDSFLAAVEESIRGAPEPESRFEPALIEEGFKAVEDLLRRIENAGFDDKAVRVVNEMIYLLKPDVVAELIKEAMLEIFKPSWPGW

SEQ ID NO: 2737 - protein, 221 aa, Cupriavidus necator
MIPMTQKLTFTRFVIAEQHGSKTVDSDLIALLLDVSIACRKIASSIAKGSPLALGGEAAGRDVPGEIQSKTDMATPCFFARSEALARHLAGMASEGMEGAYPVPLRSPQGRYLLVCDPLDGSANIDVNVSGGIIFSVLRCPEGISAPEERDLLQAGSAQMAAGYALYDAPALLVLKTGSGIHGFTLDADSGQYVLTHPNAKIPQVPAGSRSALRPSTSGQS

SEQ ID NO: 2738 - protein, 817 aa, Ostreococcus tauri
MRHIHALSTRRARFVDPPVRLTRARAVDDADAHARSTHPRAMHPSASSTVRARVTRTGGRTTRARRVFHAASPSTGAAPACPPKRSATRPRASSETEVETSTTTARSMEAADGSEAVALDEQLAPHVEHLRYRYATFRERKSAIEAAEGSLDAFSRGYERFGFTTDASGEITFREWAPAASHVALIGDFNDWNGDATPLRRSEFGTWEVTLPKGAIAHGSRVKVRVYNDQGQFDRIPAWIRRATVEPGVMGAGYDGVYWAPEEKYEFKNAKPKKPVASRIYEAHVGMSSNDPKINSYREFADDVLPRVAAGGYNTVQLMAVMEHAYYGSFGYHVTNPFAVSSRSGTPEDLKYLVDKAHGLGVRVLLDVVHSHASSNTNDGIAGFDLGQRDVDSYFGTGEAGYHWLWDSRLYKYDNWEVMRYLLSNLRYWVDEYNFDGFRFDGVTSMLYHHHGLQMEFSGDYEQYFSTSTNVDGVVYLMLANELLHSLYPEIEVIAEDVSGMPTLCLPVDKGGVGFDARLAMSIPDFWVKYLKTKPDEQWSTFEMVSTLCNRRYTEKAIAYVESHDQSIVGDKTTAFWLMDAEMYDGMSTLNEPSVVIERGIALHKMLRLVTASLGGEGYLTFMGNEFGHPEWVDFPREGNGWSHDYCRRRWDLADADHLRYQHLLNFDKGMLALDDQYSYIAAAHQHVSTADDNRQILVFERGPLVFVFNFHPHQTYEGLEIGVPEPGKYQLAFDTDAREFGGKSRCGFSVDHFTSPDGPESWVGPYEQPPRAAKMLVLSPARSAQVYFKVPEPAPSAEPSVSDIVREIDADAGAAR

SEQ ID NO: 2739 - protein, 439 aa, Vigna radiata
MAASVSTVGAVNRAILNLNGSGAGASAPTSAFFGTSLKKAVASRVPNSKVTNGSFKIVAAEKEIEESQQTNKDRWKGLAYDISDDQQDITRGKGMVDPLFQAPMDAGTHYAVMSSYEYLSTGLRQLDNIKDGFYIAPAFLDKLVVHITKNFMTLPNIKVPLILGIWGGKGQGKSFQCELVFAKMGINPIMMSAGELESGNAGEPAKLIRQRYREAADLIAKGKMCALFINDLDAGAGRLGGTTQYTVNNQMVNATLMNIADNPTNVQLPGMYNKEENARVPIIVTGNDFSTLYAPLIRDGRMEKFYWAPTRDDRVGVCKGIFRTDGVPEEDITKLVDTFPGQSIDFFGALRARVYDDEVRKWISGVGVDATGKKLVNSKEGPPTFDQPKMSLDKLLQYGNMLVQEQENVKRVQLADKYLNEAALGNANEDAIKSGSFFK

SEQ ID NO: 2740 - protein, 236 aa, Gibberella zeae
MASSSTPSTPLLYSCIAHNTTILSECTTSASSQTSSLASLILPKIEHTNPQKLTYTHGQHQIHYVAESPSEHRDYPSAGGLTFLVIADSSLGRRVPFGYLFEIRKRFLQQFPESTDFSDMPNYGAASFNSELKNLMVDYGTTTGGRDDAIGNAKREIDDVRGIMTKNIESLLERGERLDLLVDKTDRLGGSAREFRVRSRGLKRKMWWKNVKLMGLLALVIFLIIMAIVIAVKNGS

SEQ ID NO: 2741 - protein, 547 aa, Desulfovibrio vulgaris
MASKEILFDTKAREKLSRGVDKLANAVKVTLGPKGRNVVIEKSFGSPVITKDGVSVAKEIELEDKFENMGAQMVKEVASKTSDIAGDGTTTATILAQAIYREGVKLVAAGRNPMAIKRGVDKAVESLVRELGNLAKPTRDQKEIAQVGTISANSDSTIGNIIAEAMSKVGKEGVITVEEAKGLETTLEVVEGMQFDRGYLSPYFVTDPEKMVCELDEPFILCNEKKISTMKDMLPVLEQVAKMQRPLVIIAEDVDGEALATLVVNKLRGALQVVAIKAPGFGERRKAMLQDIAVLTGGQVVSEDMGIKLENISVADLGTAKRVVIDKENTTIVDGAGKGDDIKARVKQIRAQIEETTSDYDREKLQERLAKLVGGVAVIHVGAATETEMKEKKDRVEDALNATRAAVEEGIVPGGGTALVRVAKVLDDIKPADDDETAGVNIIRRAIEEPLRQIASNAGFEGSIVVERVREGKDGFGFNAATGEYEDLIGVGVIDPKKVTRIALQNAASVASLLLTTECAIAEKPEPKKDMPMPGGMGGMGGMGGMY

SEQ ID NO: 2742 - protein, 545 aa, Bacteroides fragilis
MAKEILFNIEARDQLKKGVDALANAVKVTLGPKGRNVIIEKKFGAPHITKDGVTVAKEIELTDAYQNTGAQLVKEVASKTGDDAGDGTTTATVLAQAIIAEGLKNVTAGASPMDIKRGIDKAVAKVVDSIKHQAEKVGDNYDKIEQVATVSANNDPVIGKLIADAMRKVSKDGVITIEEAKGTDTTIGVVEGMQFDRGYLSAYFVTNTEKMECEMEKPYILIYDKKISNLKDFLPILEPAVQSGRPLLVIAEDVDSEALTTLVVNRLRSQLKICAVKAPGFGDRRKEMLEDIAVLTGGVVISEEKGLKLEQATIEMLGTADKVTVSKDNTTIVNGAGAKENIKERCDQIKAQIAATKSDYDREKLQERLAKLSGGVAVLYVGAASEVEMKEKKDRVDDALRATRAAIEEGIVAGGGVAYIRAIESLDGLKGENDDETTGIAIIKRAIEEPLRQIVANAGKEGAVVVQKVSEGKGDFGYNARTDVYENMHAAGVVDPAKVTRVALENAASIAGMFLTTECVIVEKKEDKPEMPMGAPGMGGMGGMM

SEQ ID NO: 2743 - protein, 312 aa, Magnaporthe grisea
MADKDFTLNTGAKIPAFGLGTWQGDKGVIKEAVLTAIKSGYRLIDGAYVYGNEEEVGQGIREAISSGIVKREDLFVVSKCWATYTTRCELGLDQSLKLLGLDYVDLYLVHWPILMNPEGNDEKFPKHADGSRDIIHTHNHVDTWKLMEKLPATGKTKAVGVSNYSKAWLEQLLPHATTVPAVNQVENHPQLPQQELVDFCKEKGIHIMAYSPLGSTGGPLLTAEPVVKIAEKHSISPAAVLLGYQIARGITVIPKSVNPDRIKANAQLKDLDAEDMKLLNDYSEQLAKDGKLNRYVFPPFGTDFGFPDKVGQ

SEQ ID NO: 2744 - protein, 440 aa, Burkholderia fungorum
MWRKNFLLGAATASYQIEGAVNEDGRLPSIWDTFSAIPGKVLAGDTGAVACDHYHRWEADVDMLAGLGFEGYRLSIAWPRVMDTAGVPNRKGLEFYKRLLARLKEKGIATFVTLYHWDLPQHLEDRGGWLNRDTAYRFADYADLMSRELAGSVDGWMTLNEPWCSAYLGYGNGHHAPGLADARYATQAMHHLLLAHGLAMPVLRANDPASQKGVVANIGRGTANSGSAADQRAAHLFEVQHNAWILDPLLEGRYPRDLFELWPGTEPLVLDGDMQTVAAPLDFLGINYYFRTNVASDGAHGFREVPLQGVERTQMGWEVYPDGLRDLLIGFKATYRNLPPIYITENGMASDDKVIDGRVDDMQRISFLKRHLAAVDEAIKAGVEIRGYFLWSLMDNFEWAFGYERRFGVVHVDYATQKRTVKRSAELVSKFLKERKARRE

SEQ ID NO: 2745 - protein, 709 aa, Pseudomonas aeruginosa
MSEQNNEQRSQAAGTDTVDRGNSNAKLEQLEAYREDATGEALSTNTGTRIADNQNTLKAGERGPSLLEDFIMREKITHFDHERIPERVVHARGSAAHGYFEAYEDLSDLTKAGFLAEAGKRTPVFVRFSTVQGPRGSADTVRDVRGFAVKFYTDEGNFDLVGNNMPVFFIQDAIKFPDFVHAVKPEPHNEIPTGASAHDTFWDFVSLTPESAHMVMWLMSDRAIPIAYRNMQGFGVHTFRLVNAAGESVLVKFHWRPKSGTCSLVWDEAQKLAGKDPDFNRRTLWEDIEKGDYPEWELGLQVIPENQQDSFDFDLLDPTKLVPEELVPVRVVGRMVLNRNPDNFFAETEQVAFHVGHLVPGIDFTNDPLLQGRLFSYTDTQLLRLSGPNFNEIPINRPLCPFHNNQRDAPHRQTINRGRASYEPNSIDGGWPKETPPAARNGGFSSYHEPVSGSKLRKRADSFADHFSQAALFWHSMSEAEQAHIVAAYSFELSKVERQSIREREVNQILLNIDPQLAARVAANVGVQLAAPANPAPQPKPSPALSQMNLLSGDIRSRKVAILIADGVAESDVSDLRDALRQEGADAKLIAPSASPVQAENGAELNPEGTWDGLPSVAFDAVFVPGGAASSQAIGADGRGLHYLLEAYKHLKPVAFAGDAQALASQLSLPGDPGVLLGATATDVFPGLRQALMQHRIWQREAATKAIPA

SEQ ID NO: 2746 - protein, 732 aa, Pseudomonas aeruginosa
MSEPMSERERWQLELDKLQRGLQGDPFAFLGPQRDPGGEGGVLRAYLPGAQRVELLDEDGATLAELEQSDPGSGLFQRRLERLPPRYRLRVHWPDGVQESEDPYAFGPLLGELDLYLFAEGNHRQLASCLGAQLTRHEGVEGVRFAVWAPNAVRVSVVGDFNGWDGRRHPMRRRYPSGVWELFVPRLGEGELYKYELQGHDGLLPLKADPLALACETPPGTASKTCAALRHEWRDQDWLARRAERQGYAAPLSIYEVHAGSWRHRDGRPPHWSELAEELIPYVRQLGFTHIELMPVMEHPFGGSWGYQPLGLFAPTARYGTPEDFAAFVDACHQAGIGVILDWVPAHFPTDAHGLGRFDGTALYEYEHPFEGFHQDWDTYIYNLGRSEVHGFMLASALHWLRTYHVDGLRVDAVASMLYRDYSRKEGEWLPNRHGGRENLEAIDFLHHLNQVVASETPGALVIAEESTAWPGVSRPVAEGGLGFSHKWNMGWMHDSLAYIGEDPLHRRYHHHQLTFGLLYAFSEHFILPISHDEVVHGKHSLLDKMPGDRWQKFANLRLYLSFMWSHPGKKLLFMGCEFGQWREWNHDGELDWYLLRYPEHQGVQDLVAALNRLYRDLPALHARDGEALGFEWLIGDDQANSVYAWLRHAAGEPSLLAVHNFTPVPRQGYRIGVPQGGDWDVLLNSDAQAFAGSGSGSQGRVSSESCGAHGQAQSLLLDLPPLGTLLLRPAG

SEQ ID NO: 2747 - protein, 112 aa, Glycine max
  misc_feature (68)..(68): Xaa can be any naturally occurring amino acid
ARVPFVDKEFIRVAGNIDPEGKMINKDEGRIEIWTLQMTFDDEDHPYMAKHILYNHNEQSSDGVGYGXIDGLKAYDEQHATDRFMLNTGHTITCNTYTANELYHYRMISERV

SEQ ID NO: 2748 - protein, 251 aa, Salmonella enterica
MNLNSIPAFQDNYIWVLTNDEGRCVIVDPGEAAPVLKAIAEHKWMPEAIFLTHHHHDHVGGVKELLQHFPQMTVYGPAETQDKGATHLVDDGDTIRVLGEKFTLFATPGHTLGHVCYFSHPYLFCGDTLFSGGCGRLFEGTPSQMYQSLMKINSLPDDTLICCAHEYTLANIKFALSILPHDSFINEYYRKVKELRVKKQMTLPVILKNERKINLFLRTEDIDLINEINKETILQQPEARFAWLRSKKDTF

SEQ ID NO: 2749 - protein, 381 aa, Debaryomyces hansenii
HTPSGLELEYYEERSKYRGSLLIAEATFVSEQAGLNGTVPTTWNSEPAGYVPGIWNDKHAQAWKKITDRVHENGSYMSSQFWFLGRVGDPQLLKDRGLGYVAPSAIYPDEEFKKKAETAGNPIRALTGDEIHDLIYKTYPNAARKAIAAGFDYIELHAAHGYLLDQFLQPTNNQRTDKYGGSIENRARVVLELVDHLSTVVGAKKLAIRISPWATFQGMKADQDSTHAVTTFSYLLHELQKRADDGNEIAYVSLVEPRVQGGDDVEKSQQVGDNTFVGQIWKGIILKSGNYTYDAPDFKTLLNDISDNRTMVGFARYYTSNPDLVKRLYEGWDLTPYERLTFYGSSNWGYNTFDNYNGKRQFTKDIESGKLPKAIEEIEVK

SEQ ID NO: 2750 - protein, 446 aa, Zea mays
MAEPAAAGRKTRVGPYEVGKTIGEGSFAKVKHAHDSRTGAVRAIKVLDRNHVLRHKMVEQIKREISTLKLIKHPNVVQLHEVMASRTKIYMVLEFVDGGELFDKIVNSGRLGEDEARIYFHQLINAVDYCHSRGVYHRDLKPENLLLDSHGTLKVSDFGLSAFAPQTKEDGLLHTACGTPNYVAPEVLADKGYDGMAADVWSCGIILFVLMAGYLPFDDANLMRLYKLICHATFSCPPWFSSGARKFIKRILDPNPDTRITIAEILEDEWFKKGYKPPHFEQGEDVNLDDVDAAFNDSEDRLVAEKREKPESMNAFALISRSQGFNLGNLFEKEMMGMVKRETSFTSQCTAQEIMTKIEDACGPLGFNVRKQNYKMKLKGDKSGRKGHLSVATEVFEVAPSLHMVELRKTGGDTLEFHNFYKNFSSELKDIVWKAESDANNKQTNK

SEQ ID NO: 2751 - protein, 254 aa, Lycopersicon esculentum
AREKAHLEFVEVLNVKEQVVAGMMYYITLAVTDAGKKKIYEANIWVKEWEHFIKVVEFKPVSDDSVKTGDIVDVPDPNIPPLQDLARFAVQDYNKAQNAHLEYVENLNVKEQLVAGTLYYITLVATDAGKKKIYETKIWVKEWEDFKKVVEFKLVGDDSPNPGGITNVPFPNLPEFKDLARFAVQDYNKKENAHLEFVENLNVKEQVVAGIIYYITLVATDAGKKKIYETKILVKGWENFKEVQDFKLVGDAIK

SEQ ID NO: 2752 - protein, 204 aa, Chloranthus spicatus
LCDAEVALIVFSNRGKLYEFCSSSSMLKTLERYQKCNYGAPDTTVSTREMQSSQQEYLKLKARVEALQRSQRNFLGEDLGPLSGKELEQLERQLDMSLKQIRSTRTQYMLDQLTDLQRREQMLCETNKALKRRLDEVTPANPHQGWDPNPHGVSYGRQAAQQQGDGFFHPLECEPTLQIGYQHDQITIAAPGPSVSNYMPGWLA

SEQ ID NO: 2753 - protein, 459 aa, Streptococcus pneumoniae
MLRFPKDFVWGSSTSGPQTEGRVAGDGKGDNLWDYWFQVEPNRYYNGIGSDKTSTFYENWERDIELLLETGHTVFRTSIQWSRIFPQGCGKVNPQGVDFYRKVFEAIKAKGIRLLVNLYHFDLPFALQEDGDGWENKATVSAYEDYARFCFETYGDLVDQWITFNEPIVPVEFGYFYDAHYPHKVDAEAAVKVAYHTQLASSRAVKACHELLPDSKIGIVLNLTPAYPRSQHPADVKAARIAALFQAQSFLDPSVLGTYPQELVEILHEHGLLPDATEEELELIRDNTVDFLGVNYYQPLRVMAPRFAKHPESPLLPEHFYEPYVMPGRKINSHRGWEIYEQGIYDIAQNIKENYGNIEWMLTENGMGVEGEEKFRQDGMIQDDYRIDFVKGHLRELHRAIEDGANCKGYLIWTFIDCWSWLNSYKNRYGLVELDLETQERRLKKSGHWFKELSDNNGF

SEQ ID NO: 2754 - protein, 328 aa, Ostreococcus tauri
KMTTIAEDVSGMPTLCRPVKEGGVGFDYRLQMAIADKWIEVLSEWGPDENWDMGNLVFTMENRRYGEKCISYAESHDQALVGDKTTAFWLMDAEMYTNMSTLVPDTPTISRGIALHKMIRQFTMGLGGEGYLNFMGNEFGHPEWIDFPRDDRVEASTGKFIPGNGNSYHLCRRRFDLTDMDHLRYKYLNAFDGAMNKVAGAFKYLASSHQYTSCKSDADKVIVFERGDLVFVFNWNPTQSFSDYRIGCKEKTTYKLVLSSDNPEFGGYSNLWTYTAPEFIAEDYAFNGRPASFLAYVPSRTVAVYAPADLADKLLGYSSESTAADTAA

SEQ ID NO: 2755 - protein, 851 aa, Ostreococcus tauri
MATRAIASARSRAPARAREGTSLARARRWTRSPHRGVSGRRSRATRWTLDAVSTEDAEGWRRETSKAKETRPTRTTVADAGRGVDDVHARTRVAREAKRRTAPRGVPGVCDTPRRGDASALGATRVVGCPDDTVNFAVYTSAATAVSLVLWTPEGLARGEIAGEIELDETTNKTGSVWHVALPRCAEDVLYGYRVDGPYEPEAGHRFDKSKILLDPYAKFTVSRPEYGVASKKEDGTEDCWPQYAGGVPKKLRSDGKEDFDWEGVTSPKRPMRDLVVYEAHARGLTADLETKAKPGTYAAIEEALPYLKQLGVNAIELMPCHEFNEMEYHSLNHVTGEFRRNFWGYSTVNFFSPMTRYAEAGADDCGREAAREFKRMIRECHRAGIEVIMDVVFNHTAEGNEQGLTLSFRGLDNRVYYMVAPEGQFYNYSGCGNTMNCNHPVVREFILECLRYWVLEYHIDGFRFDLASILTRASSMWDRANIFGEPTAETPMLEEVVIGTPLQDPPLIDAISNDPVLAGTKLIAEAWDAGGLYQVGSFPHYGVWSEWNGKFRDDVRNFIKGVDGYAGLFAERLCGSPNLYADRSPSASINFVTAHDGFTLRDCVSYNEKQNHANGEENRDGEEHNASWNCGLSCDDDGECWDPEIVALRDRQMRNFVVALFVAQGVPMMYMGDEYGHTKCGNNNTYCHDNALNWIDWSEASSPLAGDGLARFTKQVIALRKKHSAFRLDSFPSADNIQWHGHLPDTPMWDEESRFVAFTLQDKPETDKFYIAFNSHHEPAMLKLPSPPERCKWKLILDTSLESPFDVLSAEDIAEADSYTAEAMFLPGLRKNTYLCADRSAVIFRAVSLA

SEQ ID NO: 2756 - protein, 492 aa, Mesembryanthemum crystallinum
MDPYKYRPSSAFNSPYFTTNSGAPVYNNNSSLTVGTRGPILLEDYHLVEKLANFDRERIPERVVHARGASAKGFFEVTHDVSHLTCADFLRAPGVQTPVIVRFSTVIHERGSPETIRDPRGFAVKFYTREGNFDMVGNNFPVFFIRDGMKFPDMVHALKPNPKSHIQENWRVLDFFSHHPESLHMFTFLFDDVGVPTDYRHMEGSGVNTYTLISKSGKVHYVKFHWKPTCGVKCLLEEEAVKIGGANHSHATQDLYDSIAAGNYPEWKLYIQTIDPADEDKFDFDPLDVTKTWPEDILPLQPVGRLVLNKNIDNFFAENEQLAFCPGIVVPGVYYSDDKLLQTRIFSYADTQRHRLGPNYLQLPVNAPKCAHHNNHYDGQMNFMHRDDEVDYFPSRYDPVRHAERYPIPPNVLNGNRDRQIIQKENNFKQPGERYRSWDPARQERFICRWVDALSDPRITHEIRNIWISYWSQADKSVGMKLASRLNVRPTM

SEQ ID NO: 2757 - protein, 1256 aa, Streptococcus pneumoniae
MRKTPSHTEKKMVYSIRSLKNGTGSVLIGASLVLLAMATPTISSDESTPTTNEPNNRNTTTLAQPLTDTAADSGKNESDISSPRNANASLEKTEEKPATEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWHLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDIFEDLEPNYYHFMDADGTPRTSFGGGRLGTTHHMTKRLLVDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGSVGIANPKGLEWTEKGLKLNALTATVLRVSQNGTSHESTAEEKPDSTPSKPEHQDPAPEARPDSTKPDAKVADAENKPSQATADSQAEQPAQEAQASSVKEAVQNESVENSSKKNIPATPDRQAELPNTGIKNENKLLFAGISLLALLGLGFLLKNKKEN

SEQ ID NO: 2758 - protein, 493 aa, Mesembryanthemum crystallinum
MDPYKYRPSSSYNTSFMTTKTGQPVWNDDSSLTVGARGPILLEDYHLLEKIASWDRERIPERVVHARGASAKGFFEVTNDITHLTCADFLRAPGVQTPVIVRFSTVIHERGSPETMRDPRGFALKFYTREGNFDLVGNNFPVFFNRDAMKFPDVVRAFKPNPKSHIQEMWRILDFCSHLPESLHTFAWFFDDVGIPINYRHMEGFGVHTFTMLNRAGKETYVKFHWKPTCGVKSIVTEEEAIQVGGANHSHATQDLYDSIAAGNYPEWRLFIQTMDPADEDKFDFDPLDITKTWPEDILPLQPVGRLVLNKNIDNFFTENEMLAFNPASIVPGIHFSHDKMLQARTFAYADTQRHRLGVNFLLLPVNAPKCAHHNDHHDGFMNFMHRDEEVNYFPSRSNVCHHAERFPIPSHTLTGRRERRIIPKENNFKQPGDRYRSWDPARQERYLARWVKALSDPKVTPEIRGVWVSWLSQSDRSLGMKLANKLNVRPTM

SEQ ID NO: 2759 - protein, 540 aa, Streptococcus pneumoniae
MSKEIKFSSDARSAMVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVAAAVEALKNNAIPVANKEAIAQVAAVSSRSEKVGEYISEAMEKVGKDGVITIEESRGMETELEVVEGMQFDRGYLSQYMVTDSEKMVADLENPYILITDKKISNIQEILPLLESILQSNRPLLIIADDVDGEALPTLVLNKIRGTFNVVAVKAPGFGDRRKAMLEDIAILTGGTVITEDLGLELKDATIEALGQAARVTVDKDSTVIVEGAGNPEAISHRVAVIKSQIETTTSEFDREKLQERLAKLSGGVAVIKVGAATETELKEMKLRIEDALNATRAAVEEGIVAGGGTALANVIPAVATLELTGDEATGRNIVLRALEEPVRQIAHNAGFEGSIVIDRLKNAELGIGFNAATGEWVNMIDQGIIDPVKVSRSALQNAASVASLILTTEAVVANKPEPVAPAPAMDPSMMGGMM

SEQ ID NO: 2760 - protein, 331 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKSSIVLGSKGEVEKYLKHVPK

SEQ ID NO: 2761 - protein, 789 aa, Ralstonia eutropha
MRVLCIGGGPAGLYFGLLMKLQDPANEVIVAERNRPYDTFGWGVVFSDATMDNLKVADPVSAAEINEAFNHWDDIDVHIGGRTIRSGGHGFIGIGRKRLLNILQARCEALGVKLVFETDVSDDQALAMQYQADLVIASDGLNSRIRTRYAGTFQPDIDTRQCRFVWLGTHKLFDAFTFAFEKTEHGWFQAHAYRFDDNTSTFIVETPQEVWSAAGIEQMSQEEGIAYCEKLFAKYLDGNKLISNATHLRGSANWIRFPRVICKHWVHWNTLPDGRRVPVVLMGDAAHTAHFSIGSGTKLALEDAIDLATEIAASGPSAHDALPAALERYAATRSVEVLKIQNAARNSTEWFENVERYASLAPEQFAYSLLTRSQRISHENLRVRDAGYVRKFEHWLAGEAGVPAESLRLREDKPVPPMFTPYRVRGVTLKNRVVVSPMAMYSSVDGVPGDFHLVHLGSRALGGAGMVVAEMTCVSPDARITPACPGLWNDAQRDAWKRIVDFVHANSDARIAMQIGHAGRKGSTQLGWEKMDHPLPHGNWPLFSASPIPYLPGESQVPREMTREDMDRVRDDFVGAARRAAEAGFDWLELHCAHGYLLSSFISPLSNQRTDEYGGTLANRLRYPLEVFAAVREVWPADKPMSVRISAHDWVEGGITPDDAVEIARAFKAVGADMIDCSSGQVSPDQAPVYGRMYQTPFADRIRNEADIPTIAVGAIFEADHVDSIIAAGRADLCAVARPHLADPAWTLHEAAKLGYRDVSWPRQYEAGKRQLETNLERAAALARAVVEH

SEQ ID NO: 2762 - protein, 130 aa, Leptospira interrogans
MTNAVLNEKNHSVTSEETKKERVRILAPRVDIYSDEENIYLLADLPGVEEKDVQVQLEKDQLIISGKTSNKDIQGELRYSEFRTGEYKRTFTLTESVEEDRISAVYKNGVLNLTLPKRKPLTKKIEVRSE

SEQ ID NO: 2763 - protein, 557 aa, Schizosaccharomyces pombe
MCGILAVHHVAEDIEAFKPKALHLSKQLRHRGPDWSGKAIRNQTILCHERLAIVGVESGAQPLVSDDGKLVLTVNGEIYNHLKLRENLKGNYKFKTYSDCEVILYLYREHGPACANMLDGMFSWVLYDQDKDKVVAARDPIGITTLYQGFSSDSPDTAYFASELKALHPVCDKIIAFPPGHYYDSETKQTVRYFKPSWWDENKIPSNPVDYKLLRETLEASVRKRLMAEVPYGVLLSGGLDSSLIASIAARETEKLANSTSQSEEARTITAWPKLHSFAIGLPGSPDLLAARKVADFLHTFHHEHTFTIDEGLDALRDVIYHLETYDVTTIRASTPMYLLSRKIKAQGVKMVLSGEGSDEIFGGYLYFGNAPSREAFHSECVRRVKNLHLSDCLRANKSTMAWGLEARVPFLDKDFLEVALNIDPEEKMYINGRKEKYILRKAFDTTHDSSLQPYLPQDILWRQKEQFSDGVGYSWIDALKDTAELCISDDEFALPRREWGDDIPTTKEAFWYRKLFDEIFPRQCADTVMRWVPKAEWGCPEDPSGRYQAGHVAALK

SEQ ID NO: 2764 - protein, 243 aa, Oryza sativa
MGQSKKKFRGVRQRHWGSWVSEIRHPLLKRRVWLGTFETAEEAARAYDEAAILMSGRNAKTNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 2765 - protein, 308 aa, Oryza sativa
MGINVYTTGVLIFLESTCVLMDPQLQVKALCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 2766 - protein, 266 aa, Ralstonia eutropha
MLKVEPIPAFQDNYIWAIHDGRNAAVVDPGEAAPVERFLKDKGLALGAIVITHHHGDHQGGVAELLSAYPTTHDGAPMPVIGPAGERIGGRTQAVREGDTVTLPAPALQFRVLDVPGHTAGHVAYAGDLPGVGPVVFCGDTLFATGCGRLFEGTPAQMLASLDKLASLPGETRVYCAHEYTRSNVRFARAVEPGNTALADWEARVESLREAGQPTVPSTIGLERQVNPFLRSREPTVREAVKAQGGSVAGDAEAFGALRGWKDNFR

SEQ ID NO: 2767 - protein, 235 aa, Arabidopsis lyrata
  misc_feature (96)..(96): Xaa can be any naturally occurring amino acid
  misc_feature (144)..(145): Xaa can be any naturally occurring amino acid
MEEGRSSHDGESSKKIGRGKIEIKRIENTTNRQVTFCKRRNGLLKKAYELSVLCDAEVALVIFSTRGRLYEYANNSVRGTIERYKKACSDAVNPPXVTEANTQYYQQEASKLRRQIRDIQNSNRHIVGESLGSLNFKELKNLEXXLEKGISRVRSKKNELLVAEIEYMQKREMELQHNNMYLRAKIAEGARLNPEQQESSVIQGTTVYESGVSSHDQSQHHNRNYIPVNLLEPNQ

SEQ ID NO: 2768 - protein, 254 aa, Sinapis alba
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSSKELQNLEQQLDTALKHIRSRKNQLMHDSINELQRKEKAIQEQNSMLSKQIKEREKILRAQQEQWDQQNHGHNMPPPPPPQQIQHPYMLSHQPSPFLNMGGLYQEEDPMEMRRNDLDLSLEPVYNCNLGCFAA

SEQ ID NO: 2769 - protein, 692 aa, Gloeobacter violaceus
MREALALSTAQICINNYQNFAVDPLLRRQPPVQVLRVLSSAELEACFSRSPWKFVAAVPIFCNGTLAGNLWICDEQERLLSAAQSALLEHAAGLVGERLEAEERLDEIHQRNLMYEKYIEMAPDQIGLLDSELRTLTVNAALSRFSGMPKEWILGKSLWEMGIPESILAQMADWEQLIRRVFETGEPGTTSFAYSVGDASCKLYCYSLAVPQFNCRGEVVAVLNITYDRAALEMPFNPEDWAGMGEQLMREVAAHRVTQEELARLNAELEERVRERTVRYKLLNQKLRAEIGERQRIEVELQAAQARAEAAARAKSDFLAAASHELRTPMHGIISMTDLLLESDLGAEQRELAAIIGYCGETMLSLINNILDISKIEAGRMELDVVPFELPRLIDSVVAMFAEQLRSKDLRLQVLIDPEVPAQLEGDPVRLAQVLTNLVGNSLKFTPRGQIAIRVHPAAQGGDDLRLRFEVVDTGIGMAPETTGRLFQSFFQADTSTTRKYGGTGLGLAISRQLVELMGGQIGVESRLEQGSTFWFVLPLKVSAPVEPPPPSAPMTVRLPQYGPILIVEDNAVNQKVLLRHLERLGCGAEVAETGAEALTVLASRSFALVLMDCQMPVMDGFQATAEIRRREDSARRTPIVGITANASAGVYDLCLAAGMDDCLIKPVRRDQLTAAIERWALPVVGTEWATG

SEQ ID NO: 2770 - protein, 215 aa, Debaryomyces hansenii
MSGRKKTLLKVIILGDSGVGKTSLMQQFVNNKFSHQYKATIGADFLTKEITIDNNKQVTLQIWDTAGQERFQSLGVAFYRGADCCVLCYDVTNEKSLNNLSSWKDEFLIQSNVSNPQDFPFIIIGNKIDVDDSKKIPSLQKKLNNITNNQLGGLNYPVFETSAKDSINVELAFEVVAKMALQQEELNDANGNDVSDDYNDAINIHLENDAGGCAC

SEQ ID NO: 2771 - protein, 547 aa, Klebsiella pneumoniae
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIVNEGLKAVAAGMNPMDLKRGIDKAVLAAVEELKALSVPCSDSKAIAQVGTISANSDETVGKLIAEVDKVGKEGVITVEDGTGLEDELDVVEGMQFDRGYLSPYFINKPDTGAVELESPFILLADKKISNIREMLPVLEAVAKAGKPLVIIAEDVEGEALATLVVNTMRGIVKVAAVKAPGFGDRRKAMLQDIATLTGGTVISEEIGMELEKATLEDLGQAKRVVINKDTTTIIDGVGEESAIQGRVAQIRKQIEEATSDYDREKLQERVAKVAGGVAVIKVGAATEVEMKEKKARVDDALHATRAAVEEGVVAGGGVALVRVAAKLAGLTGQNEDQNVGIKVALRAMEAPLRQIVSNAGEEPSVVANNVKAGDGNYGYNAATEEYGNMIDFGILDPTKVTRSALQYAASVAGLMITTECMVTDLPKSDAPDLGAAGGMGGMGGMGGMM

SEQ ID NO: 2772 - protein, 578 aa, Arabidopsis thaliana
MCGILAVLGCVDNSQAKRSRIIELSRRLRHRGPDWSGLHCYEDCYLAHERLAIVDPTSGDQPLYNEDKTIAVTVNGEIYNHKALRENLKSHQFRTGSDCEVIAHLYEEHGEEFVDMLDGMFAFVLLDTRDKSFIAARDAIGITPLYIGWGLDGSVWFASEMKALSDDCEQFMCFPPGHIYSSKQGGLRRWYNPPWFSEVVPSTPYDPLVVRNTFEKAVIKRLMTDVPFGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSETMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 2773 - protein, 1124 aa, Mougeotia scalaris
MSSSKRSQSSGRSSTQTRIQNRVTQASADAKLSTAFEVSSSSGGDSFDYTKSVTASLNPTEPLAAKSVTAYLQRMQRGSIIQSFGCMMAVEPGTFRIIAYSENVSEMLGVTPQSVPTGDHQNAIGIGTDVRSLLSPSSVSVVEKAVAANDVSMMNPIAVYSLATQKLFFAILHMNDVGLVIDLEPISSSSDSAMFSAGAVQSHKLAAKAISRLQSLPGGDICGLCDVVVEEVRELTGYDRVMAYKFHDDEHGEVVAEIRRSDLEPYLGLHYPATDIPQASRFLFIKNRIRMICDCTSPQVKVVQDSRIPQEMSLAGSTMRGVHGCHTQYMMNMGSTASLVMSVTINDTNEIAGGPGMKGRKLWGLIVCHHSTPRHIPFPIRSACEFLMQVFGLQLNMEVELAAQHREKHILRTQTLLCDMLLRDAPMGIVSQSPNVMDLVKCDGAALLFGGRCWLLGISPTQEQVKDIATWLISSHTDTTGLSTDSLVDAGYPKARELGVDVCGMAAARITENDFLFWFRGHAQKEVKWAGAKDGGSEEDGSRMHPRSSFKAFLEVVKQRSLPWEDVEMDAIHSLQLILRGSFQDIEDKEDRKIVHARLKEMHLQGMEELSSVASEMVRLIETATAPILAVDTAGCVNGWNFKISELTGLSIPEVMGKSLVKDLTHPSSKDTVEKLLYMALNGEEEQNVEIRLKTWGMQQGKGPVILMVNACASRDVSEKVVGVCFVAQDVTGEKIVQDKFTRIQGDYTTIVRSHNSLIPPIFGSDESGFCVEWNPAMERLSGVKREEAIGKMLTRELFGGILRLKNVDGLTKFMIVLNAAMSSHDTDKFPFTFYDRSGKIVEVLLTTSKRCNSEGVVTGVFCFLHTASSELQQALTVQKAAERVAEVKAKELAYIRQEIQNPLDGIHFARSFMEHTVLSEDQKQLIETSATCEKQLRRILADMDLASIEKGYLELETGEFSMATVMNSVVSQGMIQSTQKNLQLYCDTPPDFKSLSVFGDQVRLQQVLADFLLNAVQFTPPSGWVEIKVEPVVKKLPGGVSVANVDFRVSHPGEGLPEDLIDQMFDRADARVKSQEGLGLSICRKLVRLMNGEVQYRREGERNFFLLQLELPLAQRDDQASMK

SEQ ID NO: 2774 - protein, 492 aa, Lycopersicon esculentum
MDPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKCMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPSCVLNGRRTNCVIPKENNFKQAGERYRSWEPDRQDRYINKWVESLSDPRVTHEIRSIWISYLSQADKSCGQKVASRLTVKPTM

SEQ ID NO: 2775 - protein, 547 aa, Actinobacillus pleuropneumoniae
MAAKDVKFGNDARVKMLKGVNVLADAVKVTLGPKGRNVVLDKAYGAPTITKDGVSVAREIELEDKFENMGAQMVKEVASKANDAAGDGTTTATVLAQAIVNEGLKAVAAGMNPMDLKRGIDKAVVAVVEELKAISKPCETSKEIEQVGTISANSDETVGKLIAQAMEKVGKEGVITVEDGTGLDDALDVVEGMQFDRGYLSPYFINKPEAGTVELENPYIILVDKKISNIREILPVLEAVAKAGKPLLIVAEDIEGEALATLVVNTMRGIVKVAAVKAPGFGDRRKAMLQDIAILTAGTVISEEIGMELEKATLEELGQAKRVVITKDNTTIIDGIGDEAQIKARVAQIRQQIEDSTSDYDKEKLQERVAKLAGGVAVIKVGAATEVAMKEKKDRVDDALHATRAAVEEGIVPGGGVALVRAASKVATTLTGDNEEQNVGIKLALRAMEAPLRQIVTNAGEEASVVARNVKDGNGNYGYNAGTEQYGDMLEMGILDPPKVTRSALQFAASIAGLMITTECMITDLPKEEKLDPAAAMGGMGGMGGMM

SEQ ID NO: 2776 - protein, 545 aa, Bacteroides thetaiotaomicron
MAKEILFNIDARDQLKKGVDALANAVKVTLGPKGRNVIIEKKFGAPHITKDGVTVAKEIELADAYQNTGAQLVKEVASKTGDDAGDGTTTATVLAQAIVAEGLKNVTAGASPMDIKRGIDKAVAKVVESIKAQAETVGDNYDKIEQVATVSANNDPVIGKLIADAMRKVSKDGVITIEEAKGTDTTIGVVEGMQFDRGYLSAYFVTNTEKMECEMEKPYILIYDKKISNLKDFLPILEPAVQTGRPLLVIAEDVDSEALTTLVVNRLRSQLKICAVKAPGFGDRRKEMLEDIAILTGGVVISEEKGLKLEQATIEMLGTADKVTVSKDYTTIVNGAGVKENIKERCDQIKAQIVATKSDYDREKLQERLAKLSGGVAVLYVGAASEVEMKEKKDRVDDALRATRAAIEEGIIPGGGVAYIRAIDSLEGMKGDNADETTGIGIIKRAIEEPLREIVANAGKEGAVVVQKVREGKGDFGYNARTDVYENLHAAGVVDPAKVARVALENAASIAGMFLTTECVIVEKKEDKPEMPMGAPGMGGMGGMM

SEQ ID NO: 2777 - protein, 552 aa, Anabaena variabilis
MAKPIEFTLFAPYNKGAALIASFSDWQEIPMKKGDDGYFRTTVELEDGTYQYKFRVQTRSWFFEEDQWVDVTDPYATDIDESSGKDNSIARIKDGEKIVDTYVWQHDDKPLPADHELVIYELHVGDFSGGEDDPYARGKYKHVIEKLDYLCELGINAIELLPVKEYPGDYSWGYNPRYFFATESSYGSTADLKKLVDECHQRGIRIIMDGIYNHSEASSPLTQIDHDYWYHHEPRDPDNNWGPEFNYEHYDENLETYPARKFIGDTVRYWVGEYHLDGIRYDAARQIANYDFMHWIAQEAKKTAGAKPFYNVAEHIPETTSITNLDGPMDGCWHDSFYHTIKAHICGDTFDLENLKDVIDPKRQGFLGATNVVNYLTNHDHDHIMVELGNREIFHDEAFRRAKLGTAILMTAVGVPLIWMGEEFGEYKPKQQDQSKIDWTLLGNDLNRSLFDYHKGLIGLRKNNHALYTENIDFIHENPEAKVLAYSRWNDEGSRVVVVTNFSEDFLAGYHVPNFPSGGTWHEWTGDYDVEAGDDGIITDIGPYEAKVFVWQ

SEQ ID NO: 2778 - protein, 373 aa, Datisca glomerata
MASSAVSTIGAVNRSPLNLNNNGTGGLLPNTAFFGSSLKKMNSRLTNPRIAAGNIKAVADDDEEKQTSKDRWGGLAFDTSDDQQDITRGKGMVDSLFQAPMQTGTHYAVMSSYEYLSTGLRQYLDNNMDGFYIAPAFMDKLVVHITKNFMTLPNIKVPLILGIWGGKGQGKSFQCELVFAKMGINPIMMSAGELESGNAGEPAKLIRQRCREAADIIKKGKMSCLFINDLDAGAGRLGGTTQYTVNNQMVNATLMNIADNPTNVQLPGMYNKEENPRVPIIVTGNDFSTLYAPLIRDGRMEKFYWAPTREDRIGVCTGIFRSDNVAKEDIVKLVDTFPGQSIDFFGALRARVYDDEVRKWISGVGVQDVGKSL

SEQ ID NO: 2779 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2780 - protein, 153 aa, Thermobifida fusca
MALPVTRRRERLIPTQWGAFPEFEELYDRMGRLLESAFGEPIISPTTWTPFADLLEDDKSYIVEAEVPGMSKDDINIQVSGNELIISGKVEEQEKEGVRAHRRMRRYGEFEYRTVLPGEIDAEGVRAKLDNGVLTVTAPKSAHERPRHVAIES

SEQ ID NO: 2781 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASLELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2782 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMEFQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGQVVGKMLVGEVFGSCCRLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVKLHREGMVPKIQFQGLSVCQGRLIWLSFPENTTVALYPLTIWFLLLHRHQSRSITHT

SEQ ID NO: 2783 - protein, 520 aa, Oryza sativa
MGNSLGCSASGERLVSAARDGDAVEARMLLELSPALARYSTFGGLNSPLHFAAAKGHLDIVTLLLEKGADVNVRNYCGQTALMHACRHGHWEVVQMLLLFRCNVTRADYLSGRTALHFAAHDGLVRCVRLLLADFVPSAPLEDGASSTVDGGECQTNSGSSPCSSLGLKFNESARLRYINKPADGGVTALHMAALNGHFDCMQLLIDLGANVSAVTFPYGTTANLIGAGSTPLHYAAGGGNAECCQLLLSKGASKLTLNCNGWLPIDVARMFGRRFLEPLLSPNSNSSIPAYQPSNYLALPFMSILNIAREFGLLHTVASVDDSDLCAVCLERSCSVAAEGCCHEFCIKCALYLCSTSNTRVEFTGPPGSIPCPLCRNGIMSFTKLPSTPTEGLKSSSALTFCNPCMLNTRSVDSPATISKAEIRRNRVAAVSSELVCPLTCSPFPSSALPTCRCSDDDPCDAIETQDGSEVQSPQPSHCASMEMDKREQQDLDRTSCSGMFWSRRSCHREEQCNAEINA

SEQ ID NO: 2784 - protein, 539 aa, Gibberella zeae
MNSNQLDPRQHPLEAIGAAIGAEEQTELQTRSSNFQGADEGPASVIAKVSGAQSGGKREDGSSDLPNNKGTPRPNPTYSKTVGGLPLVSDTFLLQKQQHFNRSKTLERVVHSCGAGAFGYFECTRDVTELTKANFLSSVGEKTPVFVRFSTATLGREFPDASRNPRGFAIKFYTKEGNYDIVGLNFPVFFCRDPIQGPDVIRSQSRNPSNFLLDHDALFDFLANNPEANHAGIMLFSDHGTPQGWRFSHGYGCHTFKWVNADGEFMYVKYHFIAKHGQKQFADSEAMQMCGEDPDYSKRDLWEAIEKGEDIEWMVHVQIMDPRQADPDTLGFDPFDATKIWPRSEFRMKELGRLVLNKNPENFHRDVEQAVFSPGSMVPGIEDSPDPLLQFRMFLYRDAQYHRVGTNLHQIPVNCPFMAKSYASPFDGPMHVDTDRAGSKQYPLNSFAHKFRPDTDEAPYEVNDNFIKYLAQVYIISVDYAQGIYNLLDEPRFEFSKVKKLGETKFAEAADDWYKEPKFRDKPGSKLVGYPPEIAVYQP

SEQ ID NO: 2785 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2786 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKHNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVKLHREGMVPKIQFQGLSVCQGRLIWLSFPENTTVALYPLTIWFLLLHRHQSRSITHT

SEQ ID NO: 2787 - protein, 420 aa, Thermus thermophilus
MGPLLVWHRGDLRLHDHPALLEALARGPVVGLVVLDPNNLKTTPRRRAWFLENVRALREAYRARGGALWVLEGLPWEKVPEAARRLKAKAVYALTSYTPYGRYRDAKVQEALPVPLHLLPAPHLLPPDLPRAYRVYTPFARRFLGVEAPLPAPEALPKGPEEGEIPREDPGLPLPEPGEEAALAGLRAFLEAKLPAYAEERDRLDGEGGSRLSPYFALGVLSPRLAAWEAERRGGEGARKWVAELLWRDFSYHLLYHFPWMAERPLDPRFQALPWQEDEALFRAWYEGRTGVPLVDAAMRELHATGFLSNRARMNAAQFAVKHLLLPWKRCEEAFRHLLLDGDRAVNLQGWQWAGGLGVDAAPYFRVFNPVLQGERHDPEGRWLKRWAPEYPSYAPKDPVVDLEEARRRYLRLARDLARG

SEQ ID NO: 2788 - protein, 377 aa, Pseudomonas putida
MPDTSFSNPGLFTPLQLGSLSLPNRVIMAPLTRSRTPDSVPGRLQQIYYGQRASAGLIISEATNISPTARGYVYTPGIWTDAQEAGWKGVVEAVHAKGGRIALQLWHVGRVSHELVQPDGQQPVAPSALKAEGAECFVEFEDGTAGLHPTSTPRALETDGIPGIVEDYRQAAQRAKRAGFDMVEVHAANACLPNQFLATGTNRRTDQYGGSIENRARFPLEVVDAVAEVFGPERVGIRLTPFLELFGLTDDEPEAMAFYLAGELDRRGLAYLHFNEPDWIGGDITYPEGFREQMRQRFKGGLIYCGNYDAGRAQARLDDNTADAVAFGRPFIANPDLPERFRLGAALNEPDPSTFYGGAEVGYTDYPFLDNGHDRLG

SEQ ID NO: 2789 - protein, 311 aa, Arabidopsis thaliana
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKFSNIPQEKFCRATEFAHETHGFYKTIEELWDGEI

SEQ ID NO: 2790 - protein, 285 aa, Mycoplasma penetrans
MKYIKLANGLHMPIIGLGVYKAEGENCENTIIKAIDDYGYRMIDTAQVYFNEEFVGNAIKQTKIKREDIFITTKVWISNYGYNNTMYSISKSLKKLQTNYIDLVLLHQPFGDYYSAWKALEVLYKKGIVKAIGVSNFEADRLVDFCLHVDVKPVINQIELHPLRQRIEDLHWNNKYGVAVESWASFGRATSEIMENPILVSLAEKYNKTVPQIILRWLIQQNIVVIPKTVTESRLKENMDIFDFEISDDDMDLIKTINQNKTVSKHHHDPSTAEEIFSKFPEIRR

SEQ ID NO: 2791 - protein, 492 aa, Brassica napus
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLVSKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPIPNKSYTGIRTKCIIKKENNFKQPGDRYRSWAPDRQDRFVKRWVEILSEPRLTHEIRSIWISYWSQADRSLGQKLASRLNVRPSI

SEQ ID NO: 2792 - protein, 281 aa, Ostreococcus tauri
SHRGHLEYRWNKFKGLRQAIEDNEGGLEKFSRGYEKMGFTRTAEGITYREWAPNASAACLRGDFNGWDLGENGKWMTKNDFGVFEVFLPNNEDGSPAIPHGSRVKIHLQIPNAEPVDKIPAWIKYAVQQPGEIPFNGIYYDPPVEEQYNFKFERPDAPSELRIYEAHVGMSSTEPKINSYVEFADDVLPRIKDLGYNAVQLMAIQEHAYYASFGYHVTNFFAVSSRCGTPDELKYLVDKAHSMGISVIMDLVHSHASSNSMDGLNMFDGSNGQYFHSGPEG

SEQ ID NO: 2793 - protein, 389 aa, Chlamydomonas reinhardtii
MADPGAQPVPAPQSAEEPVTGGLQESVEVTASGKLDSYNREYNQFLVCGSLFECPAKYLPIKPIGKGAYGVVCSAKNLDNQEKVAIKKIANAFDNVIDAKRTLREIKLLRHLQHENIVQIKDIIPPTNRDAFKDLYVVYELMDTDLHQIIRSPQALSNDHSQYFLYQLLRGLKYIHSANILHRDLKPSNLLVNANCDLKICDFGLARTSTSNEREFMTEYVVTRWYRAPELLLSCSGYTTAIDVWSVGCIFAELLGRKPLFPGKDYVHQLSLITKVIGSPSEEELGFITSEKAKRYIRSLPRSERVDFGQLWPHVTKTALDLIDKMLVFDPTKRITVEQALEHPYLASLHDVSDEPVCPTPFTFDFDSEHLTPDVVREVILQDMAELHT

SEQ ID NO: 2794 - protein, 106 aa, Oryza sativa
MAEEAQSHAREGGRHPRQPAGRENDLTTVELARFAVAEHNSKANAMLELERVVKVRQQVVGGFMHYLTVEVKEPGGANKLYEAKVWERAWENFKQLQDFKPLDATA

SEQ ID NO: 2795 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAHYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2796 - protein, 366 aa, Methanosarcina acetivorans
MVIMAEDTDLFSQYRMGDLTLPNRMVMAPMTRSRAGDDDIPVPLTATYYVQRASAGMIITEGSQVSPQGVGFMHTPGIYSAAQAASWKKITDAVHKAGGRIFIQLWHVGRVSHSDLLGGALPVAPSALPVEGYIHTPGGKKPIPVPRALKTDEVPDIVRQFRQAAENARAAGFDGVEIHGANTYLLDQFLRSGSNKRTDKYGGSLENRARLPLEVTKAVIEVWGGDRVGYRISPHNIAHSMSDANPGETFSYFAKELNKTGLGYLHLIEPIGGRSGFVPPEARLGPILRRIFERTFILNGGYGLQSGNEAIDSGEADLIAFGVPFLANPDLPERFRQNAPLNEPKLDTFYVGGEKGYTDYPALVNR

SEQ ID NO: 2797 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGCINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSYPENTTVALYPLTIWFLLLHRHQSRSITHT

SEQ ID NO: 2798 - protein, 686 aa, Pseudomonas syringae
MAFEAMFQPIQIGKLTIRNRVLSTAHAEVYATDGGMTTDRYVKYYEEKAKGGIGLAICGGSSSVAIDSPQGWWKSVNLATDRIIPHFQNLADAMHKHGAKIMIQITHMGRRSRWDGDHWPTLLSPSGIREPVHRATCKTIEPEEIWRVIGNYASAAARAKAGGLDGVELSAVHQHMIDQFWSPRVNKRTDEWGGSFENRMRFGLEVIKAVRKEVGPDFCVGLRICGDEFHPDGLSHEDMKQIARYYDDTGMIDFIGVVGSGCDTHNTLANVIPNMSYPPEPFLHLAAGIKEVVKAPVLHAQNIKDPNQATRILEGGYVDMVGMTRAHIADPHLIAKIKMGQIDQIKQCVGANYCIDRQYQGLDVLCIQNAATSREYMGVPHIIEKSAGPKRKVVVVGAGPAGMEAARVSAERGHDVTLFEKKDFIGGQITTASKAPQRDQIAGITRWFQLELARLKVDLRLGTAADAATILDLRPDIVVLAVGGHPFLEQNEHWGAAEGLVVSSWDVLDGKVAPGKNVLVYDTICEFTGMSVADFLADKGCQVEIVTDDIKPGVAIGGTSFPTYYRSMYPKEVIMTGDMMLEKVYREGDKLVAVLENEYTGAKEERVVDQVVVENGVRPDEAIYYALKEGSRNKGQIDIDALFAIQPQPSLSQPGDGYLLFRIGDCVAQRNTHAAIYDGLRLCKDF

SEQ ID NO: 2799 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSTRCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGCINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGNCCRLKGPDALTKFMIALHNAIGGIDTDKLPFSFFDRNEKNVQTLLTANKRVNMKGDIIGAFCFFRIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFKYLERVLQTRMLGLQHPLRSFLNCKLTLVMLHREGMVPKIQFQGLSVCQGRLIWLSYPENTTVALYPLTIWFLLLHRHQSRSITHT

SEQ ID NO: 2800 - protein, 624 aa, Methylococcus capsulatus
MCGISGLVQLEGVADTSAMRRSVETMVKALAHRGPDDSGVAGDGSAVFGMARLAIRGCHDGRQPMVDAETGVMMVCNGEIDNHAELRGWLAERGRAVEHATDVAVIPGLYLELGDGFVERLVGAFALAVWDPRRGRLLLARDRAGERPLFYACRDGRVSFASQAAALVAGSPEPYPADEAAVQAFLKAGYFEAPASPFAGMRKVLPGERIAIDVKGVERSRYWRLNFTRGPARKNPLDEFDAVFREAVRRQSEVEVDFGAFLSGGVDSSLVTAVMRSVHPDRKLKAFGLRFSESSYDEGVFAERVAESLGVDYTPIWVRPEDFPETLADLVRQSGEPLADPAWVPTALLARRASDEVRVALVGEGADELFGGYPTYFGARLAERYSRLPGGLRALIRKAVEAWPVSDKKVTVSFLLKRFVQGDELDFLARHVLWTSSIPPALLRRLGVTPPETPHVAGPQETMLDRLQQHDLETSLAEGLLTKADRASMRSALELRAPFLDKDVIEFAATLPERERVQGLETKVFLKRVALRYLPKDIVYRKKRGLSVPLSAWLRGPLHDWAEARISSPRLEELGINRAAALELLREHERRSADHARALWTLIVVSEWLEWKAGMEAHPAAFTA

SEQ ID NO: 2801 - protein, 1243 aa, Agrobacterium tumefaciens
MRRHPEIFDSTGMDCRGVEYRLTEGCGLLEKACRAVAALELPACIKDGELRYVVVNEAYGRVMGRAPSAFEGQTSLSLSGDIRDAEREDRERRSLVFATDEAIACHAALSAQSHMLRCERFIGDDGSLFLFEVFEEMPSAVSRKSAAVGGASDILFSSGVMDFIDAGIVVYDRDNQLVYCNARFAEFYSDLDIELKPGIRLEALMKTLYSSSVYRCAKNDGPSFEDWMQKQLHDFSLPYLERVEQFADGRWVRMVNKRLENGMLVGLRVDVTEFKAHETLLSTQIRETWLLRAALEQLPVGVFLRDQDRRLTYANAAYNTFLGGNLADHIGKTETEMFPQNGPRFRQENERILQTGEAIERTGNMPWRDGGAVPVITRLGRVATPDDEYYLVGSVTDVSLLQDREKALIAAQAEAEALHRQLQAVLRALPVGVLLLNADLVIEYVNPFFYQVWGEIGGEKSLVGKSYREFMEMNFDSGLYDYGDRPFDDVYEERVQRLLKADAFAPREVRSKSGKVTVISKTRLEGGKILSTYADVTDVRMRDAEISKARAELERVGEYMQGATRAMAQGLVLVEQGTIIMSNEAMARMFDVPPHLLEKGRNWAGFFAHCAGRGDFGTAAEAGETLRIWRENIAANRPFSWLVHVAGKSWLNLEATNSSGNYWLIIVTDVTEMKVREEELQRLLSRAEAADRAKSEFLANMSHEIRTPMNGVLGMAELLAKSKLDTRQKTFTDIIVKSGNALLTIINDILDFSKIEAGQMKLRSVPFDPAEAVEDVVSLLSSAALEKDIELIVRIDASVSGKVIGDAGRFRQIVTNIVGNAVKFTETGHVLVELSAQSAEASESIFSLRVEDSGIGIPVDKLETIFDKFSQVDGSATRRHEGTGLGLAITVGLVGLFDGKINVVSEVGRGSAFEVDIPFQVMERRRDVPLLSVAIDDIRVLVIDDNDVNRRILTEQLRSWGIDGHAVENGPSGIAVLQEAASLGFAIDAIILDYHMPVMNGLDVVERIRADKRFDDIAIVFLTSMDVVGDETLFTDLSVQAHLMKPARARLLRSTLFDVVRDVRLKRIRQHPLAQGTGGEKARPESRPAEKKQRAEAPATVPERSRPCLLDVLVAEDNDVNQIVFSQILQQAGLRFLIVGNGKRAVQAWEEYNPALILMDVSMPVMNGHQATQAIRAAEQAAGDSRHVPVIGVTAHTQEADRERCLEAGMDDYLSKPISPESLEDKIAQWLGENVLRRDAPGV

SEQ ID NO: 2802 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVKLHREGMVPKIQFQGLSVCQGRLIWLSFPENTTVALYPLTIWFLLLHRHQSRSITHT

SEQ ID NO: 2803 - protein, 469 aa, Bacillus cereus
MVVAFLIGAGGMFAGMSLFGVNPAEVTQTISSGNVSTAQGNLAKINEAYALIDSRYVEDVKDEKLVEGAIQGMLSTLKDPYSTYMDKETAKQFSESLDPELEGIGAEVNKTDGKLIIVSPIKGSPAEKIGIKPNDQILSVDGNSVKDLSREEAVLKIRGKKGTTVAIEIKRAGVADPIVFKIKREKIPIFTVFSSVKQESGKDIGYMQITSFAENTAKEFKDQLKELEKKNIKGLVIDVRGNPGGYLNSVEEILGEIMTDKKPMLQVEQRNGEKKKFSTELKERKSYPISVLIDNGSASASEILAGALKEGEGYDLIGEKTFGKGTVQQAVPFKDGSNIKLTMFKWLTPDGNWIHKKGIKPTVEVKQPDYYHATPIQIEKTLSYNANDVQVKHAQEMLKSLGYVPGREDGYFSKETESALKAFQNANKMEATGQLDKKTAEAIQTKIIEKIRSGENDLQLQSALKLMAK

SEQ ID NO: 2804 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2805 - protein, 461 aa, Oryza sativa
MEKKASILMNRYELGRMLGQGTFAKVYHARNLASNQSVAIKVIDKEKVLRVGMIDQIKREISIMRLVRHPNIVQLHEVMASKSKIYFAMEYVRGGELFSRVARGRLKEDAARKYFQQLIGAVDFCHSRGVYHRDLKPENLLVDENGNLKVSDFGLSAFKECQKQDGLLHTTCGTPAYVAPEIINKRGYDGAKADIWSCGVILFVLLAGYLPFHDSNLMEMYRKISKGDVKFPQWFTTDVRRLLSRLLDPNPNIRITVEKLVEHPWFKKGYKPAVMLSQPNESNNLKDVHTAFSADHKDNEGKAKEPASSLKPVSLNAFDIISLSKGFDLSGLFENDKEQKADSRFMTQKPASAIVSKLEQIAETESFKVKKQDGLVKLQGSKEGRKGQLAIDAEIFEVTPSFFVVEVKKSAGDTLEYEKFCNKGLRPSLRDICWDGQSEHPSLAQSSTLTQSSKSISRHAI

SEQ ID NO: 2806 - protein, 69 aa, Zea mays
MVVDQVQILDRHHLFGKFASVDGGVSTRTDQNLAFFGGYNMVTTHIVLLHKNPSEDIHALVEQYYDHFH

SEQ ID NO: 2807 - protein, 492 aa, Zantedeschia aethiopica
MDPYRQRPSSAFNSPFWTTNSGAPVWNNNNSLTVGARGPILLEDYHLLEKLAQFDRERIPERVVHARGASAKGFFEVTHDVSHLTCADFLRAPGVQTPVIVRFSTVIHERGSPETLRDPRGFAVKFYTREGNFDLVGNNFPVFFIRDGIKFPDMVHALKPNPKTHIQENWRILDFFSHHPESLHMFTFLFDDIGIPTDYRHMDGSGVHTYTLVSKEGKAHYVKFHWKPTCGVKSLLDDEAVVVGGANHSHATKDLTDAIAAGNYPEWKLYIQIMDPDHEDRFDFDPLDVTKTWPEDILPLQPVGRMVLNKNIDNFFAENEQLAFCPAIIVPGIYYSDDKLLQTRIFSYADTQRHRLGPNYLMLPANAPKCAHHNNHHEGFMNFMHRDEEVNYFPSRYDPVRHAEQFPIPPRILNGGREKCCIQKENNFKQPGEKYRSWAPDRQERFIKRWIDALSDPRVTHEIRTIWITYWSQCDKFLGQKLASRLNIKPTL

SEQ ID NO: 2808 - protein, 511 aa, Unknown
  Burkholderia sp. 383
MSSTSHRVLRHAVAAICVALSASPHAAELTRDTGAPVGDNENSQTAGPAGPVLLQDSALIEKLQRFDRERIPERVVHARGTGAFGEFVPTADISNLTKAKVFTPGTRTPVFVRFSTVMGYRGSPEQARDPRGFAVKFYTQQGNWDMVGINWPVFFIRDGIKFPDFVHANKPSAVTGVQDPNLAFDFFANTPEATNMLTMLYTNAGMPDSYRHMDGFAVHAFKFVNAHGDVHYVKFHWKSQQGVHGLRPQDIDASIGRDWNMMTNDLYGALKQGDFPKWDLYVQVLTPQDLNRFDFDALDDTKVWTGVPERKIGTMTLNRVPDNYFQSTEESAFAPSRLVPGIEPSEDRMLQDRLFAYADTQMYRLGANYMDLPINRPVVPVVNNNQDGKMNAGDRKGEVNYEPSTLHELAPNPQYKSVRMALGGTTQQEAIHKKLRFRQAGEYYRGLSQQDRDDLITALSGDLGKVTNAHNQYAMLSYFYKADADYGTRLAQAVHADVGQVQALAAKLSEN

SEQ ID NO: 2809 - protein, 213 aa, Brassica napus
  misc_feature (22)..(22): Xaa can be any naturally occurring amino acid
  misc_feature (161)..(161): Xaa can be any naturally occurring amino acid
RRVGSFKKVARSMGYGEKDISXVSFQSISKGYYGECGKRRGYMEVTGFTSDVREQIYKVASVNLCSNISGQILASLVMSPPKPGDESYESYIAEKEGILSSMARRAKTLEEALNKLEGITCNRAEGAMYLFPCINLPQKAIAAAEAAKTAPGAFYCKRLLXATGIVLVPGSGFRQVPGTWHFRCTILPQEDKIPAIVNRLTEFHKSFMDEFRN

SEQ ID NO: 2810 - protein, 455 aa, Picrophilus torridus
MLKRFPERGIPLDEINSILDGYGKNDIKNSRGRLFTYFYDPGLKDLDDLSSILLKFYNRNGMDYHAFPSTLKIENDLISMMSDLMHGNDDTSGTFTTGGTESILLAMKAARDLFLEKKEYVPEIVAPVTAHPAFSKAAKYLGMKITRVPVNEDYIADDTINEYINDRTAAVIASAPSFPYGGIDNIKDISEIALDKNTWFHVDACVGGMILPFLKGLGLNIKDFDFKLPGVSSMSIDLHKYGFTPKGSSVVLYKNHDLRKRQIYVNADWPGYPMSNMGMQATKSAGPLAGSWATLNYLGLDGYKKLAEKTLKAYRMIRSGITDLGYKIIGRPDATIFAFTHNDKDIIDLGIKMIENGWYPQIQPGNVFIDMPDSVHLNISPVHLDVADEFLEFFNELDKNVKPRDKNSYNVNSVEKALEMIKMEKSMLFRIIRYSRPEVSEKIFLEMTDEDFTYS

SEQ ID NO: 2811 - protein, 428 aa, Oryza sativa
MAAAGAGSSEVAARVLLQRYQPFAPPPGEYHQFGSGGAAAAGDMTEAVLIRTPLKRKHDREENEAAESNDWMMSPGYTNPAGSPVPTPLSGKGSKAFAKSKAAKGQKSCPQTPLCASSPGNPVTPVGGCRYDSSLGLLTKKFLNLLKGAPGGIVDLNNAAETLEVQKRRIYDITNVLEGIGLIEKKLKNNIRWKGIDDSRPGEVSDDMSILQADIEALSLQEHSVDQQISEMRDKLRGLTEDENNQKWLYVTEDDIKSLPCFQNQTLIAIKAPHGTTLEVPDPDEVNDYPQRRYRIVLRSTMGPIDVYLVSQFEEMSGMETPPRTVQPVSMDSLENPRTPLAAEPNKAAESQPNIQDGLLMPSDAPSSSQDIGGMMKIVPSELDTDADYWLLSDAGVSITDMWKTARILFQTVYHSCILPFWLSSIIM

SEQ ID NO: 2812 - protein, 215 aa, Glycine max
NRQEDSLSRARNGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 2813 - protein, 410 aa, Bacteroides fragilis
MNTHSASKLFTPVTIGPLTLRNRTIRSAAFEGMCPGNAPSPMLLDYHRSVAAGGVGMTTIAYASVTRSGLSFPRQLWLRPEIIPGLREVTAAIHAEGAAASIQIGHCGNMSHKSICGVTPISASSGFNIYSPTWVRGMKREELPEMAKAYGRAVCLAREAGFDAVEVHAGHGYLISQFLSPYTNHRKDEYGGSLENRMRFMTMVMNEVMKAAGKDLAVFVKMNMRDGFRGGMEIEETLEVARRLESLGAHALVLSGGFVSKAPMYVMRGAMPIKTLTHYMDCWWLKFGVKLAGRMMIPTVPFKEAYFLEDALKFRSEIKIPLIYVGGLVSREKIDEVLNEGFEAVQMARALLNEPGFVNRMRREEKARCNCGHSNYCIGRMYTIEMACHRHLTEELPLCLKKEIEQLENK

SEQ ID NO: 2814 - protein, 457 aa, Oryza sativa
MMELEKNGNILLRRYEIGKLLGQGTFAKVYHGRNIVTSQSVAIKVIDKDKIFKVGLMDQIKREISVMKLVRHPNIVQLYEVMATKSKIYFVLEYVKGGELFNKVAKGRLKEDAARKYFQQLVSAVDFCHSRGVYHRDLKPENLLVDENGNLKITDFGLSALAESRRQDGLLHTTCGTPAYVAPEVISRKGYDGVKVDTWSCGVILFVLMAGYLPFQDSNLMEMYRKIGKAEFKCPAWFSSDVRKLVSRILDPNPRSRMPITKIMETYWFKKGLDSKLILKNVETNEPVTALADVNVVFSSMGSSSSKKTEEKQDAGKLTNLNAFDIISLSEGFDLSGLFEETDKKKEARFTSSQSASAIISKLEDVASCSKLTVKKKEGGVLKMEGASEGRKGVLAIDAEIFEVTPSFHLVEIKKNNGDTLEYQHLWKEDMKPALKDIVWAWQGERQDQQPEDHGQP

SEQ ID NO: 2815 - protein, 482 aa, Candida albicans
MGSNSSKSAPTLQRSDTNNSTRSTRSNRSIRSRRSISSIKDSQQQQSDSQQQQEEEEEQSQSQQRPQPILSRNNSATSENPILIRRNTNETLQTPNFSDTLSPHSHSQQQQQQPGSPLSTSMNGNTISRTSTNHSIISTTSHKSSSQQSNLPLKKETTTSSLSTNSNTIDIDSLIDKLLNAGFSGKRTKNVCLKNTEIELICASAREIFLSQPSLLELAPPVKVVGDVHGQYHDLIRIFSKCGFPPKTNYLFLGDYVDRGKQSLETILLLLCYKIKYPENFFLLRGNHECANVTRVYGFYDECKRRCNIKTWKLFIDTFNTLPIAAIVAGKIFCVHGGLSPVLNSMDEIRNIARPTDVPDFGLLNDLLWSDPADTINEWEDNERGVSYVFSKVAINKFLSKFNFDLVCRAHMVVEDGYEFFNDRTLVTVFSAPNYCGEFDNWGAVMGVSEDLLCSFELLDPLDSAALKQVMKKEKQERKKST

SEQ ID NO: 2816 - protein, 594 aa, Gluconobacter oxydans
MRHAVRPMIHFMPRSREAACRPALCLAFCMFILIAPTGPAKAQTPADTAGTAGQAAPAISAASPVPQPALSVSLTREVLVAALGFLEPRTLEAHSARDFCLWGLDGLTAIDPTLSVTETRPEVSGPAPSPGGAMAAEKTSGDASAQGPTILNVLQGQTVVFSRIMPASDSNGAWADLVTAAMQAAWQHSATLREAGSDALLQGFFDELFNHLDPYSRYLGPSPASSDRTRRTGNTGTVGLSLGQSGRMIMITAVNANGPAWEAGVDTGERLVSVNGRSTRGQDVTTVQGWLEGDEHTSVTLGIAAKGHRTTTLRLERTQVPPETVFASTDGPFTVLRVTSFSTQTAEEISQYIDQVVDEPTPDTPAPSASKNKTAGIILDLRGDRGGVLQQAVTTAALLLDHGVAVTTHGRNPLANHIWAVQGGDMTNGTPVVILVDGRTASAAEILASALADHRRAVVIGSETLGKGLVQVIGQMPNGGELFVTWSRNQAPLGWPIQGLGVMPQVCTSLGAESLQAQLSALKQGNTLQGEAVQMARAARYPVPVTKILDIRKHCPAAIGSDADMDAARVLLSSPAAYRAALESVPDENSAPIH

SEQ ID NO: 2817 - protein, 492 aa, Oryza sativa
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 2818 - protein, 476 aa, Unknown
  Acinetobacter sp. ADP1
MSQKKSVIFKNLLPVIKQYQQAGFTHEKIVALLKDQHDLDLVTTETFKSYLYRYAKVTPTPSESLKMTNTIQTPREIKKSSKLEHVCYDIRGPVLRAANEMEEQGHKIIKLNIGNPAPFGFEAPQEIINDVALNLPNAIGYTDSKGIFPARKAICQYYQQKGIRDMHVNDVYVGNGVSELIVMAMQGLLNDGDEMLVPMPDYPLWTAAVNLSGGTAIHYKCDEENSWYPDIVDMESKITPNTRGIVVINPNNPTGSVYPRHVLQQIVALAKKHDLILFADEIYDKIIYDGIEHVALASLAGDQLCISFNGLSKSYRVAGYRSGWMAITGDKSRAKDYIEGLDMLASMRLCANHQAQYAIQTALGGYQSINDLIRPSGRLYEQRNIAWEMLNEIHGVSCVKPEGAMYCFPKLDPNIYQVEDDEQLMLDFLRAEKVLLVQGTGFNWPTHDHFRLVFLPAENELREAITRLSRFLATRR

SEQ ID NO: 2819 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSHTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVKLHREGMVPKIQFQGLSVCQGRLIWLRFPENTTVALYPLTIWFLLLHRHQSRSITHT

SEQ ID NO: 2820 - protein, 468 aa, Streptococcus agalactiae
MTKTLPKDFIFGGATAAYQAEGATHTDGKGPVAWDKYLEDNYWYTAEPASDFYHKYPVDLALAEEYGVNGIRISIAWSRIFPTGYGEVNLKGVEFYHKLFEECHKRHVEPFVTLHHFDTPEALHSNGDFLNRDNIEHFVNYAAFCFEEFPEVNYWTTFNEIGPIGDGQYLVGKFPPGIQYDLAKVFQSHHNMMVSHARAVKLYKDKGYKGEIGVVHALPTKYPLDPENSADVRAAELEDIIHNKFILDATYLGYYSEMTMAGVKHILKENGGELDLREEDFQALEAAKDLNDFLGINYYMSDWMQAFDGETEIIHNGKGEKGSSKYQIKGVGRRVAPDYVPKTDWDWIIYPQGLYDQIMRVKNDYPNYKKIYITENGLGYKDEFVDNTVYDDGRIDYVKQHLEVLSEAISDGANVKGYFIWSLMDVFSWSNGYEKRYGLFYVDFETQERYPKKSAHWYKQVAKTQIIE

SEQ ID NO: 2821 - protein, 154 aa, Brassica napus
  misc_feature (124)..(124): Xaa can be any naturally occurring amino acid
  misc_feature (139)..(139): Xaa can be any naturally occurring amino acid
  misc_feature (150)..(150): Xaa can be any naturally occurring amino acid
MSVTSTVEENHRKKPSSSEKEAEKRRQRWAFWGRKWRRLDYFKLTASLFVHSMALLAPFYFSWSALWVTFLFYTIGGLGITVSYHRNLAHRSFKVPKWLEYLLAYCALLAIQGDPIDWVSIIRXHLQDIITKSRIHSEXFSHLLWIYDSXYLVS

SEQ ID NO: 2822 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLTFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2823 - protein, 246 aa, Arabidopsis thaliana
MEDGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 2824 - protein, 244 aa, Datisca glomerata
GFYIAPAFMDKLVVHITKNFMTFPNIKVPLILGIWGGKGQGKSFQCELVFAKMGINPIMMSAGELESGNAGEPAKLIRQRCREAADIIKKGKMSCLFINDLDAGAGRLGGTTQYTVNNQMVNATLMNIADNPTNVQLPGMYNKEENPRVPIIVTGNDFSTLYAPLIRDGRMEKFYWAPTREDRIGVCTGIFRSDNVAKEDIVKLVDTFPGQSIDFFGALRARVYDDEVRKWISGVGVQDVGKSL

SEQ ID NO: 2825 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEHSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAHYMENMGSIASLAMAVIIYGNDEEAIGGRNSMRLWGLVVCHHTSTRCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFERNEKNVQTLLTANKRVNIKGDIIGPFCFFQIASPEFQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2826 - protein, 370 aa, Cucumis melo
QMGLAENQLSFEFVEKWMKNNPQASICSVEGIDEFKDIAIFQDYHGLPEFRNAVANFMGKVRGNRVKFDPDRVVMSGGATGAHETMAFCLADPGEAFLVPVPYYPGFDRDLRWRTGVEIVPVKCESSNNFKLTREALETAYEEAEKSNIRIKGLLITNPSNPLGTVYDRQTLETAVSFINEKNIHLVCDEIYAATVFSEPGFISISEVIDNMNDVECDRNLIHVVYSLSKDMGFPGFRVGIIYSYNDAVVACARKMSSFGLVSSQTQYLIASMLLDDVFVDNFLAGSAEKLAVRHRNFTKGLAQVGIGYLKGSGGLFLWMDLRHLLKEKTLEAEMALWKVVINQVKVNVSPGSSFHCSEPGWFRVCFANM

SEQ ID NO: 2827 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSITGAVQSQKLAVRAISQLQSLPGGDIKLLCDTVVDSVRGLTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSHTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCKLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVIYTQSSAGWVEIHVCPTLKQISDGHTLVHTEFRYLERVLQTRMLGLQHPPRSFLNCKLTLVKLHREGMVPKIQFQGLSVCQGRLIWLSFPENTTVALYPLTIWFLLLHRHQSRSITHT

SEQ ID NO: 2828 - protein, 682 aa, Escherichia coli
MNMFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNALWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRQEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLPKDYQEPDPYLDETVNIALDLAKLEKARPAEQPAPVK

SEQ ID NO: 2829 - protein, 680 aa, Escherichia coli
MFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNALWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRQEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLPKDYQEPDPYLDETVNIALDLAKLEKARPAEQPAPVK

SEQ ID NO: 2830 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSTTCIPFPLRYACEFLMQAFGLQLNMELQLASQLLEKHVLRTQTLLCDMLLRDSHTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNIKGDIIGPFCFFQIASPEFQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVSQGRLIWLSFPENTTVALYPLTIWFLLLHRHQSRSITHT

SEQ ID NO: 2831 - protein, 590 aa, Leptospira interrogans
MAIFILFCEPTSGKSPVKADFTLKDFDNVVSHVSRYYIDKNIDKNRAYREAAIYALLSLPHSIYLYPESYFKERDKYEEKDEIFPGKTFKISTDDSFILFDPDYAEVEKIRDRKLKEDANKSKVSDEEVKKIVEREKIRKNVLASKWERTGFNKKDFDRVLAFIETNLDKYKDSPLKDPFGESEEKSKEPFTMNDVILAAANGYLSSLDPHSNVFLRSAWEESMAKIQDGSFEGIGAILSGGGNKEVVVENPLEGRPAVNAGIRSGDVILAVDGKSIKGILLDKVVEKIKGKKGSKVALTIQRKGVPGTLHIEVVRDTIEIKNLSSKLIEGHEHIGYIKLTGFVKSEEGPSVDREIIEKYKELDKEAQAKGTRLKALILDLRNNAGGYLDLAIDIADMFIEKGLIVSTKSPNRSPEDAYAKNKDITNLPLAVLINAKSASASEIVASAIKHHGRGILLGERTFGKATVQKLMPLGNDYLIKLTQARYYSPSGNTIQVVGVKPDIDISSEEDGSFPFRFREENMWNHLSELPPEAEEKSSFDVKKLEAWVQKNGKASDFIASHKNDPIKPDYQLIRSLDYIEALLSTQKKK

SEQ ID NO: 2832 - protein, 838 aa, Unknown
  Malus x domestica
MMMLAPTGLVLRHPTHTPLSFTFTSTNDEYPSRLGLGLRGKEQQAVRLLRFGTSQNSSSLLRRRGSPSTTTASGCSKAEPTSKSKAVFIDDSPIITDTDQGMENLGILSIDQSLQPYKDHFNYRINRYLDQRRLIETYEGGLQEFAQGYLKFGFNREEGGIVYREWAPAAQEAQLIGDFNGWDGSKHKMDKNQFGVWSIKIPDSGENSAIPHNSRVKFRFKHGGGVWVDRIPAWIQYATVDPARFAAPYDGVYWDPPPSERFQFKYPRPPKPKAPRIYEAHVGMSSSEPRISSYREFADDVLPRIQANNYNTVQLMAVMEHSYYASFGYHVTNFFAVSSRSGTPEDLKYLIDKAHSLGLRVLMDVIHSHASNNITDGLNGFEVGQSSQESYFHTGDRGYHKLWDSRLFNYANWEVLRFLLSNLRWWLEEFKFDGFRFDGVTSMLYHHHGINMAFSGDYHEYFSEATDVDAVVYLMLANYLIHKVLPDATVIAEDVSGMPGLGRPVSEGGIGFDYRLAMAIPDKWIDYVKNKSDEEWSMKEISWNLTNRRYTEKCISYAESHDQAIVGDKTIAFFLMDREMYSGMSCLVDASPTIERGVALHKMIHFLTMALGGEGYLNFMGNEFGHPEWIDFPREGNGWSYEKCRRQWNLVDTDHLRYKFMNAFDKAMNLLDEKFSFLSSTKQIVSSTNEEDKVIVFERGDLVFVFNFHPRNTYEGYKVGCDLPGKYRVALDSDAWEFGGHGRVGHNVDHFTFPEGIPGVPETNFNNRPNSFKILSPAQTCVVYYRVDESEEADAEETLIEEEVGVGQENFEEQTGPINEDNAVGPRAQESDQGSSSD

SEQ ID NO: 2833 - protein, 101 aa, Arabidopsis thaliana; identical to SEQ ID NO: 156

SEQ ID NO: 2834 - protein, 461 aa, Debaryomyces hansenii
MSDSMATKEEATKVFNKLRQQPANQVCFDCSNKNPTWTSIPFGILLCLECSAAHRNLGVHISFVKSSNLDSWQRIQLRHFKFGGNQVAKEFYTKNGGSKFLGNKDGIDINAKYTAPVALKYKEKLKQKAQQDEAKHPDEVSIDDLEESGGLLTDSSNNVSTDDFFSNWTKPINSTPSPLSSKNITPNASNDDLSVKKPVTTRTTSRLVNNSSGANQPKGSILSSKGNGPRSSRLANKRINKEAEEIDFEEIERKAKQEAEEAKALGYNPTTESTSDTSNAKPAKSEPKKPGLPLGSRKQDTEGSEDLSAKNVPIKEATQKFQKLGFGMTAGSNEVVNEKSKNYKPVKYTGEVSNKFGTQKGISSDEYFGRGPRFDENANAEARDKLQSFNGAQSISSSSYFGEDESAQNNTQGAGLTDIESSAREFASRFSGNANQDLDVLKDAFEEGANKLGSYLRDFLR

SEQ ID NO: 2835 - protein, 764 aa, Unknown
  Nostoc sp. PCC 7120
MSMTTIAPEQVNRIVWNQHHDPFEILGSHPIEQNGKTVWVVRAYLPNASAAWVVLPEQRQEYPMQTVHDPHFFECIIETSELSNYQLKTKEGEHERVSYDPYAFRSPRLTDFDLHLFAEGNHHRIYEKLGAHFTEVGGVKGVYFAVWAPNARNVSVLGDFNLWDGRKHQMRKGATGVWELFIPEIGVGEHYKYEIKNFAGHIYEKSDPFGFQQEPRPKTASIVSNLNSYNWSDEDWLEQRRHTDPLTQPISVYEVHLGSWLHAASAEPAQLPNGETEPVVIASELNPGARFLTYRELASRLIPYVKELGYTHIELLPIAEHPFDGSWGYQVTGYYAPTSRFGTPEDFMYFVDQCHQNNIGVLVDWVPGHFPKDGHGLAFFDGTHLYEHADPRKGEHKEWGTLVFNYSRNEVRNFLVANALFWFDKYHIDGIRVDAVASMLYLDYCRKEGEWLPNQYGGRENLEAADFLRQVNHLLFSYFPGVLSIAEESTDWPMVSWPTYTGGLGFNLKWNMGWMHDMLDYFSMDPWFRQFHQNNITFSMWYNHSENFMLALSHDEVVHGKSNIIGKMPGDKWQKLANVRCLFAYMFAHPGKKTMFMSMEFGQWSEWNVWADLEWPLLQFEPHQQLKKFFTELNKLYRSEPALYTLDFAREGFDWIDCSDNRHSVVSFIRREKDTENFVVVICNFTPQPHSHYRIGVPEKGFYTELFNSDARQYGGSNMGNLGGKWTDDWSMHNRPYSLDLCLPPLGVLILKMDKEKTAKALGS

SEQ ID NO: 2836 - protein, 544 aa, Unknown
  Mesorhizobium sp. BNC1
MAAKDVKFSRDARERMLRGVNILADAVKVTLGPKGRNVVLDKSFGAPRITKDGVTVAKEIELEDKFENMGAQMVREVASKTNDIAGDGTTTATVLAQAIVQEGAKAVAAGMNPMDLKRGVDLAVAEVVDYLAKAAKKIKTSEEVAQVGTISANGEKEIGQMIAEAMQKVGNEGVITVEEAKTAETELEVVEGMQFDRGYLSPYFITNPEKMVAELEDVYILLHEKKLSNLQAMLPVLEAVVQSGRPLLIIAEDVEGEALATLVVNKLRGGLKIAAVKAPGFGDRRKAMLEDIAVLTGGQVISEDLGIKLENVTLDMLGRAKRVSIAKETTTIVDGAGQKSEIEGRVAQIKSQIEETTSDYDREKLQERLAKLAGGVAVIRVGGATEVEVKEKKDRVDDALNATRAAVEEGIVPGGGTALLRASSEIKAKGENADQEAGVNIVRRAIQAPARQIASNAGAEASIVVGKILDNNAVTFGYNAQTGEYGDMIGMGIVDPMKVVRTALQDAASVAGLLITTEAMIAELPKKDSPAPAMPGGGMGGMDF

SEQ ID NO: 2837 - protein, 458 aa, Arabidopsis thaliana
MSLKIKFLLLLVLYHHVDSASIVKFLPGFEGPLPFELETGYIGIGEDENVQFFYYFIKSENNPKEDPLLIWLNGGPGCSCLGGIIFENGPVGLKFEVFNGSAPSLFSTTYSWTKMANIIFLDQPVGSGFSYSKTPIDKTGDISEVKRTHEFLQKWLSRHPQYFSNPLYVVGDSYSGMIVPALVQEISQGNYICCEPPINLQGYMLGNPVTYMDFEQNFRIPYAYGMGLISDEIYEPMKRICNGNYYNVDPSNTQCLKLTEEYHKCTAKINIHHILTPDCDVTNVTSPDCYYYPYHLIECWANDESVREALHIEKGSKGKWARCNRTIPYNHDIVSSIPYHMNNSISGYRSLIYSGDHDIAVPFLATQAWIRSLNYSPIHNWRPWMINNQIAGYTRAYSNKMTFATIKASVDTRQSIDQTRPLSCSKGGSVANPCNKRLMTFTYNYLPTNIHVKRSCLC

SEQ ID NO: 2838 - protein, 552 aa, Coxiella burnetii
MAAKVLKFSHEVLHAMSRGVEVLANAVKVTLGPKGRNVVLDKSFGAPTITKDGVSVAKEIELEDKFENMGAQMVKEVASRTSDDAGDGTTTATVLAQAILVEGIKAVIAGMNPMDLKRGIDKAVTAAVAELKKISKPCKDQKAIAQVGTISANSDKSIGDIIAEAMEKVGKEGVITVEDGSGLENALEVVEGMQFDRGYLSPYFINNQQNMSAELENPFILLVDKKISNIRELIPLLENVAKSGRPLLVIAEDIEGEALATLVVNNIRGVVKVAAVKAPGFGDRRKAMLQDIAVLTGGKVISEEVGLSLEAASLDDLGSAKRVVVTKDDTTIIDGSGDAGDIKNRVEQIRKEIENSSSDYDKEKLQERLAKLAGGVAVIKVGAATEVEMKEKKARVEDALHATRAAVEEGVVPGGGVALIRVLKSLDSVEVENEDQRVGVEIARRAMAYPLSQIVKNTGVQAAVVADKVLNHKDVNYGYNAATGEYGDMIEMGILDPTKVTRTALQNAASIAGLMITTECMVTEAPKKKEESMPGGGDMGGMGGMGGMGGMM

SEQ ID NO: 2839 - protein, 636 aa, Vigna radiata
MMESCDCIDTQYPPDELLVKYQYISDVLIALAYFSIPVELIYFVQKSAFFPYRWVLMQFGAFIVLCGATHFINLWTFSPHSKAVAVVMTIAKVSCAIVSCATALMLVHIIPDLLSVKTRELFLKNKAEELDREMGLILTQEETGRHVRMLTHEIRSTLDRHTILKTTLVELGRTLGLEECALWMPSRNGLNLQLSHTLTYHVQVGSTVQTNNPIVNEVFNSPRAMRIPPTCPLARIRPLVGRYVPPEVVAVRVPLLNLSNFQINDWPDISAKNYAIMVLILPTDSVRRWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLATLINDVLDLSRLEDGSLELEMGKFNLHGVLGEIVELIKPIASVKKLPITLILAPDLPTHAIGDEKRLTQTLLNVVGNAVKFTKEGYVSIRASVAKPESLQDWRPPEFYPTSSDGHFYIRVQVKDSGCGIPPQDIPHLFTKFAQSRSGPARPSSGAGLGLAICKRFVNLMGGHIWIESEGPGKGSTATFIVKLGICGNPDPSDHQATTRSQAYSGSGGLARFKPFIKDEDDSGFSTRRNQRSF

SEQ ID NO: 2840 - protein, 162 aa, Triticum aestivum
MEGRMFGLETPLMTALQHLLDVPDGEAGGPGNAAGEKQGPTRAYVRDARAMAATPADVKELPGAYAFVVDMPGLGSGDIKVQVEDERVLVISGERRREEKEDAKYLRMERRMGKMMRKFVLPENADMEKISAVCRDGVLTVSLEKLPPPETKKPKTIQVQVA

SEQ ID NO: 2841 - protein, 416 aa, Arabidopsis thaliana
MSLKIKFLLLLVLYHHVDSASIVKFLPGFEGPLPFELETGYIGIGEDENVQFFYYFIKSENNPKEDPLLIWLNGGPGCSCLGGIIFENGPVGLKFEVFNGSAPSLFSTTYSWTKMANIIFLDQPVGSGFSYSKTPIDKTGDISEVKRTHEFLQKWLSRHPQYFSNPLYVVGDSYSGMIVPALVQEISQGNYICCEPPINLQGYMLGNPVTYMDFEQNFRIPYAYGMGLISDEIYEPMKRICNGNYYNVDPSNTQCLKLTEEYHKCTAKINIHHILTPDCDVTNVTSPDCYYYPYHLIECWANDESVREALHIEKGSKGKWARCNRTIPYNHDIVSSIPYHMNNSISGYRSLIYSGDHDIAVPFLATQAWIRSLNYSPIHNWRPWMINNQIAGYTRAYSNKMTFATIKARRWTHGRV

SEQ ID NO: 2842 - protein, 267 aa, Zea mays
MATHASDNGSGHAEWRFARAAKEGALAVAGDKMSIRAARFKISASVDGRDPRPVLPLAHGDPSVFPAFRTAAEAEDAVAAALRTGKFNCYPAGVGLPEARRALAEHLSSDLPYKLSTDDIFLTAGGTQAIEVVVSVLAQPGANILLPRPGYPNYEARAGLHNLQVRHFDLIPERGWEIDIDSLESIADKNTTAMVAEVARKLGILVIADEVYGNLVFGDTPYVPMGVFGHIAPVLSIGSLSKRWIVPGWRLGWVAVCDPNKILQETK

SEQ ID NO: 2843 - protein, 547 aa, Pseudomonas fluorescens
MAAKEVKFGDSARKKMLTGVNVLADAVKATLGPKGRNVIIEKSFGAPTITKDGVSVAKEIELKDRFENMGAQLVKDVASRANDDAGDGTTTATVLAQSIVNEGLKAVAAGMNPMDLKRGIDKATIAIVKELKGLSKPCADSKAIAQVGTISANSDNSIGDIIAEAMEKVGKEGVITVEEGSGLENELSVVEGMQFDRGYLSPYFINKPDTMVAELDGPLILLVDKKISNIREMLPVLEAVAKAGRPLLIVAEDVEGEALATLVVNNMRGIVKVAAVKAPGFGDRRKAMLQDIAVLTGGTVISEEIGLSLESTTLEHLGNAKRVILSKENTTIIDGAGVEADIQARVTQIRQQVADTSSDYDREKLQERLAKLSGGVAVIKVGAGSEVEMKEKKARVEDALHATRAAVEEGVVPGGGVALIRALQGINDLKGDNADQDVGIAVLRRAIEAPLRQIVANSGDEPSVVVDKVKQGAGNFGYNAATSEYGDMIEMGILDPTKVTRSALQAASSIGGLILTTEAAVAEIVEDKPAAGGMPDMGGMGGMGGMM

SEQ ID NO: 2844 - protein, 377 aa, Carboxydothermus hydrogenoformans
MSRKKIIALVVVVFLLWGIFSLAGLFWKKSGDKIETLLTVIALIKSQYYQPVSTEKLINGAIKGMVEGLDDPYSTYLDPEQFKHLNEQITGTFGGVGLIVTMEENHIVVVKPIPDTPAAKAGIKAGDIIVNISGRDTKGMDLDTAVSLMRGPVGTRVEVGILRPGEKETRMFTLVRENITIPTVESKMLDDKIGYIMLSQFTENSPQAVRKAIGDLKKKGMKGLIFDLRDNPGGELKAAVEIADIFVPRGKTIVYVDYRNQPDEEEKAEVPELGIPVVVLVNGGSASASEIVAGALKDWGVAVLVGEKTFGKGVVQSIFRLPGNAGLKLTVARYLTPKKHDINKKGIMPDVVVKQPAGSKEDRQLLKAKEILAEKIK

SEQ ID NO: 2845 - protein, 484 aa, Lactobacillus plantarum
MTEKLTTETGQPWANNEHSQTAGARGPVLMQDYNLLEKLAHFDRERIPERVVHAKGAGAKGFFELENDMGEYTKADLFNGVGKKTPVILRFSQVAGEKGYPDTVRDVRGFALKFYTQQGNYDLVGNNTPVFFVNDPLKFPDFIHSQKRDPKTNRRTQNMQWDFWAHSPESLHQVTYLMGDRGLPASYRTMNGYGSHTFKWVNQNGEQFWVKYHFISDQGVKNMTAQAAEKAMSQDLDYLQDDLYDAIQEKNYPSWTMYVQILPYEEGLNYKWDIFDVTKVISHKDYPLIKVGKLTLNENPTNNFTDIEEAAMSPANFVPGIEPSPDKLLQGRLFSYKDAQRYRLGANFEDLPVNKPVVPVHNYERDGYMKINNQGAEVNYEPNALHGPEEVPDAALSPDSVRGETRAQPYRYQVDYTTQAGDLYRLMSEPEQERLINTIKDALGQVTLPGVKELEIKQFYEADKNYGTRVANALGMNIADIISD

SEQ ID NO: 2846 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAVGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLTFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVKLHREGMVPKIQFQGLSVSQGRLIWLSFPENTTVALYPLTIWFLLLHRHQSRSITHT

SEQ ID NO: 2847 - protein, 612 aa, Carboxydothermus hydrogenoformans
MCGIAGMISFSKDLSPFVPLLEKMTQSLTHRGPDALGIWHSENIILGHRRLAVIDPERGRQPMIRTFGDWQYVIVYNGELYNTKELRDELEARGHHFYTTCDTEVLLVSYIEWGKECLSKLNGIFAFAIFDEKENQLFLARDRLGVKPLFYALVNDTLIFASEIKTLLLHPDIPSRLSTDGLKEVLFLGPARTPGMGVFAHISELLPGDYAVFNPEGLFIKPYWRLTSNPHPDDFPTTVKKTRELLEDAVIRQLVSDVPICTLLSGGLDSTVITAFAASHLHSRGETLNTFSVDYAENELYFTESAFQPNCDAMFIPLVAKEFNTLHRNIVLTQEELFEALFPALIARDLPGMVDIDSSLWLFSREIKKEATVGLSGECADEIFGGYPWFFRKEALEAKTFPWALSLDRRKTLFRQDLIAELKPDEYVQKRYHEALEEIPEISGLSPEEKRLREITYLTLTRWMPILLDRKDRMTMAWGLEVRVPYCDHRLVEYLWNVPWHFKTAGGQEKGLLRQAVADLIPDYILKRKKSPYPKTHHPLYTKLVREALTQILAENSSPINFLIDENEVRKLITNPSPPNARPWFGQLMGDTQIMAYLIQLNYWFKKYHISF

SEQ ID NO: 2848 - protein, 727 aa, Physcomitrella patens
MAACTIVWFRRDLRLEDNPALIAAARAGTVVPVFVWSPAEDGQFHPGRVSRWWLKQSLTHLELSLKKLGSPLILRKSPDTLSVLLEIAEATGATQVFYNHLYDPVSLVRDHRVKQGLSQRGIVVHTFNGDLLYEPWEVYDEEGQAFTVYEAFWKKCMSMPFEPEAPLLPPRRLTGPIGKIVGCNAEELGLEDEFEKSSNALLARAWCPGWGFANKSLDSFLRSPLIDYARDRQKADGASGTPTSLLSPHLHFGELSVRKIFHEVRKRQITWAREGNAGGEASVNMFLRALGFREYSRYLSFHFPFTHERSLLANLKSFPWRADEGYFKAWRQGRTGYPLVDAGMRELWATGWAHNRIRVVVASFSVKFLQLPWRWGMKYFWDVLLDADLECDVLGWQYISGSLPDGHELDRIENPEVEGYRFDPDGDYVRRWIPELARLPNEWVHHPWDAPPSALRAAGVELGTNYPRPIVEIGAARERLQASLAEMWERDAAMKAALANGLEEGLGETVEVAGTGGPEHERMDVPRVMVHMQRDADMSCNSSRRDQLVPEIVPNQFHIRAHESIMNRSAAMVEDGEEAGRAAVPMVFASVRRGMGGNYGGHHVEGNGGEVAQASAPIQWPTVTAVDYELDSTAESASVTGRGGSEGGTVPVWSQSVSARTPIQVREGLVPEVRRGPGLSRRQLQASVQRVNLEGMTSNKQAEEEDFYVPKLVKWTQPRKRRVKQDG

SEQ ID NO: 2849 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKHNRVRMIVDCHAIPVSVIQDEGLMQPLCLVGSTLRAPHGCHAHYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFERNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2850 - protein, 520 aa, Arabidopsis thaliana
MAQALAQPPLVVTTVVPDPPPPPPPPHPKPYALRYMADLLGRIGIMDTDKDGNISPQSPRSPRSPRNNILMGKYELGKLLGHGTFAKVYLAQNIKSGDKVAIKVIDKEKIMKSGLVAHIKREISILRRVRHPYIVHLFEVMATKSKIYFVMEYVGGGELFNTVAKGRLPEETARRYFQQLISSVSFCHGRGVYHRDLKPENLLLDNKGNLKVSDFGLSAVAEQLRQDGLCHTFCGTPAYIAPEVLTRKGYDAAKADVWSCGVILFVLMAGHIPFYDKNIMVMYKKIYKGEFRCPRWFSSDLVRLLTRLLDTNPDTRITIPEIMKNRWFKKGFKHVKFYIEDDKLCREDEDEEEEASSSGRSSTVSESDAEFDVKRMGIGSMPRPSSLNAFDIISFSSGFDLSGLFEEEGGEGTRFVSGAPVSKIISKLEEIAKIVSFTVRKKEWSLRLEGCREGAKGPLTIAAEIFELTPSLVVVEVKKKGGDREEYEEFCNKELRPELEKLIHEEVVVEEALYLPSDTE

SEQ ID NO: 2851 - protein, 477 aa, Enterococcus faecalis
MEHHQLKAFPQDFLWGSASAAYQVEGAWNEDGKGASVWDEFVRLPGKTFKETTGDLAVDHYHRFKEDVALMKQQGLKAYRFSIAWTRILPEGRGRVNQAGLKFYSDLIDELLAAGIEPMVTLYHWDLPAVLQKEYGGWESRKIIDDFVAYAKILFDAFRGKVRYWISLNEQNVFTSLGYQLAVHPPGVTDNKRMYEANHIANLANAAVINAFHELEMPGKIGPSFAYTPVYAVDAHPANVLAAENAEDLLSHFWLDVYLWGEYPIAALNYLQEQGVAPTIKEGDLALLRSAKPDFLGINYYRTDTVAANPLDGVGIGKMNTTGEKGSETESGVPGLFKKVNNPYVERTNWDWAIDPQGLRIALRRLASRYQVPILITENGLGEYDTLTEDKQIHDTYRIDYLRSHIQAIQEAITDGVSVIGYCTWSYTDLLSWLNGYQKRYGFVYVDQDETQKGSLERIPKDSYYWYQKVIETNGLI

SEQ ID NO: 2852 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQAPRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNIKGDIIGPFCFLQIASPEFQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2853 - protein, 1146 aa, Populus tremula
MASQSQRQSNQPAHNQVQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKHNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCKLKGPNSLTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVIYTQSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2854 - protein, 152 aa, Zea mays
MSLVRRSNVFDPFSMDLWDPFDTMFRSIVPSAASTNSETAVFASARIDWKETPEAHVFKADLPSVKKEEVKVEVEDGNVLVISGQRSREKEDKDDKWHRVERSSGQFVRRFRLPENAKVDQVKAGLENGVLTVTVPKAEEKKPEVKAIEISG

SEQ ID NO: 2855 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLTFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVKLHREGMVPKIQFQGLSVCQGRLIWLSFPENTTVALYPLTIWFLLLHRHQSRSITHT

SEQ ID NO: 2856 - protein, 679 aa, Oryza sativa
MDRTWSRSFRNPKPFFPSKTLSLSSRIEIAKPQAKPPEEGAIASTRHHVPGGGGGGVVDFEVLVGAAEAGNRRATSASSSFPPDASLPGDANGRGLLLARQLSRGGCGEQRLWARGYAAKEVAFGVGARAALLQGVNDLADAVKVTMGPKGRNVIIERSHRAPKVTKDGVTVAKSIEFEDSAKNVGANLVKQVAEATNKVAGDGTTCATVLTQAILTEGCKAVAAGVNVMDLRNGINKAISSITTHLKSKAWIINSSEEINQVATISANGEKEIGDLISKAMEKVGKDGVITITDGKTLDNELEAVQGMKLSRGYISPYFVTDQKTQKCEMENPLILIHDKKISTMNSLLPVLEMSIKNRRPLLIIAEDVEGEALSMLVLNKHRAGLKLKCKLLTFFKLELWIVDILICAVKAPGFGENRRANLDDVAVLTGGEVVSEDQGLDLGKVELQMLGTAKKVTVSLDDTIILDGGGDKQQIEERCQQLRESMDKSTAVFDKEKAQERLSKLSGGVAVLKIGGASEVEVGEKKDRVTDALHAARAAVEEGIVPGGGVALLYATKELDKIITANEDEKIGVQIIKNALKAPLMTIAANAGIDGGVVIGKLIEQDNLNMGYDAARGEYVDMIKAGIIDPVKVIRTALQDASSVSLLMTTTEAAVAEPPAAKARMASRMPQMSGMDF

SEQ ID NO: 2857 - protein, 536 aa, Methanosarcina barkeri
MASKQIMFDENARKALLNGVDKVANTVKITLGPKGRYVVLDKSTKPVVTNDGVTIAKEIELHDKFENMGAKLVKEVASKTQDNTGDGTTTATLLAQSMIREGLKNISAGANPIDVKKGIEMATENVVGYLKSKSSEVKGKEKIVQVATVSANNDEEIGNLIADAMERVGYNGVITVEDSKTMETNLDVVEGMQFDRGFVSPYMATDSEKMVCEFEDPYILITDKKINSMKQIVPVLEKVASEGRSLLIIAEDVDGDAQAALILNIIRGALRVCAVKAPGFGNERKEMLEDIAVLTGGQVISEDKGMKLEEFDDYMLGSARKVTIDNNKTIIVEGKGDKAKIKERVSLIEAQINIADVEYKKTELKKRQAKLGGGVAVIKVGAATETELKEKKMRIDDALNATKAAVEEGVVIGGGISLFRAAAILDSLKLEGDREIGVKIVQRAIEEPVRQIAENAGKEGAEVVATIRAEPRELFGYNAKKDVFEDLFEAGVIDPTKVVRSGLQNAASIAGMVLTTEALVTDFNDEKDEKAATIII

SEQ ID NO: 2858 - protein, 404 aa, Photobacterium profundum
MHNIGMSSKLNNVCYDIRGPVLKHAKRMEEEGHKILKLNIGNPAPFGFDAPDEILVDVIRNLPTSQGYCDSKGIYPARKAIVQHYQKRGLLDLDVEDVYIGNGVSELIVMAMQALLDNNDEILVPSPDYPLWTAAVSLSGGNPVHYICDEESDWYPDLDDIKKKITPNTRGIVLINPNNPTGAVYSRDFLLEIVEIARKHKLIIFADEIYDKILYEGAQHTSIAPLAPDVFCITFNGLSKSYRVCGFRAGWMVLSGPKHEAKGYIEGLEMLSSMRLCANVPMQHAIQTAIGGYQSINELILPGGRLLEQRDKAYDLITQIPGVSCVKPKGALYLFPKLDQKKFNIVDDQRMALDFLQQEKVLIVHGTGFNWEKPDHFRIVTLPRVDDLEMAIGRLERFLHNYRQ

SEQ ID NO: 2859 - protein, 508 aa, Xylella fastidiosa
MSVASRIIRHCSVVPGAVFFPECCMRVVGLSLAISVVLLSFSLSAKNPSGVVMSPPVEEMEMPESNDANVPLDEIRRFVSVYNAIKQAYVDPVNDRKLMHSAVRGLLSDLDPHSTYFDKEDADAFDEQTNGVYDGIGVELQEQSDNTLKVIAPIDDTPAARAGLRPGDLIVAINGKPLANVDAMKPLRGAPGSQVTLTIVRDKNGKPFDMTIKRETIHIASVRSRMLEPGYGYIRISVFQADTGNDFHKHLGQLKQQAGGKLRGLLLDLRSNPGGLLTAAVQVADALLDKGNIVSTRGRISASDTRFDATPGDLLDGLPLVVLVDAGSASASEVLVGALSDNHRARVIGSCTFGKGSVQTLLPLDNGDSVKLTTARYYTPSGRSIQARGIVPDLLLKPDGVGAADLSGSGIDRSEAGLPGHLRGTDEGVPGCTSSDPLPGDTPIMTALLELKQPGSAVQAKKAIPVKVVSDVKSATKSPLSVFGKGRAVKRVPVVSPTSEQVDGQPSK

SEQ ID NO: 2860 - protein, 741 aa, Unknown
  Malus x domestica
  misc_feature (699)..(699): Xaa can be any naturally occurring amino acid
  misc_feature (702)..(702): Xaa can be any naturally occurring amino acid
  misc_feature (728)..(728): Xaa can be any naturally occurring amino acid
  misc_feature (738)..(738): Xaa can be any naturally occurring amino acid
MEACNCIEPQWPADELLMKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVVNQVFSSNCAVKISPNSPVARLRQLAGKHIPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILKSSNLLATLINDVLDLSRLEDGSLQLDIATFNLHSIFREVHNLIKPVASVKKLSVALNIATDLPVYAIGDEKRLMQIILNVVGNAVKFSKEGSISITAYVAKSESLRDFRAPDFFPVQSDNHFYLRVQVKDSGLGINPQDIPNLFTKFAQTQTSASQNSGGSGLGLAICKRFVNLMEGHIWIESEGLGKGCTATFIVKLGFPERSNEFKQPFAPKLQANHVQTNFPGLKVLVMDDNGVSRSVTKGLLVHLGCDVTTVSNLDEFLHVISQEHKVVFVDVCMPGIDGYELAVRIHEKFAKRHERPVLVALTGSIXKMXKENCMRVGMDGVILKPVSVDKMRSVXSELLEHRVLXEAM

SEQ ID NO: 2861 - protein, 630 aa, Shigella dysenteriae
MCGLAGFLESNLNDNNSAKVLHSMGESIYRRGPDGTGIWFENIENKINVGFVHTRLAIIDLSDAGQQPMHSHCGRYVIAFNGEIYNHLELRYLLESNNHISWRGHSDTETLLACFGIWGIDKTLQACVGMFAIALWDKKEHRLTLARDRVGEKPLYWGWQDDALLFGSELKALKTHPAFSAEINRDALCLLLRHNYIPAPHTIYRGIQKLQPGHYLSVELSNDERKETLHQYWSYEKVVQEGLVNPFMGSPIQAVEHLESLIAQSINGQLISDVPLGAFLSGGIDSSLIVSIMQSLSSSPVKTFSIGFDDKKYDEAIFAVEVARHLGTDHTEMYVNDKDIQDVIPLLPEVYCEPFADSSQLPTFLVSKMAQQHVTVALSGDAGDELFGGYTPYSFTPKYWNYARNIPLQIRKFASRYIDKLPVNPKFKKLIECMAVQNPQLFYRNIISHWLNPEELVKNSSEPSTAFSSSTTFPVNGGYVDWMMSVDAQVYMTDDILVKVDRAAMYNSLETRVPLLDHRIIEFAWQLPVSLKINNGVGKWPLREILYKRVPKSMIERPKKGFSVPLSSWLRGPLRDWAEELIAYKRLADEGYFNVAAVRSCWNLHIQGQADYSRKLWSILMFQSWLENQK

SEQ ID NO: 2862 - protein, 492 aa, Arabidopsis thaliana
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLNMFTFLFDDIGIPQDYRHMDGSGVNTYMLINKAGKAHYVKFHWKPTCGVKSLLEEDAILVGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 2863 - protein, 106 aa, Glycine max
TRFSAEVREQIYKVASVNLCSNISGQILASLVMSPPKVGDESYESFNAEKENILESLARRAKTLEDAFNKLEGVTCNKAEGAMDLFPQIRLSQKAIKAARDANTAP

SEQ ID NO: 2864 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAANEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQAPRFLFKQNRVRMIVDCHAIPVSVIQDEGLMQPLCLVGSTLRAPHGCHAHYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCKLKGPNSLTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2865 - protein, 246 aa, Arabidopsis thaliana
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTAYESGVTSSHQSGQYNRNYIAVNLLEPNQNSSNQDQPPLQLV

SEQ ID NO: 2866 - protein, 344 aa, Saccharomyces cerevisiae
MSSSVASTENIVENMLHPKTTEIYFSLNNGVRIPALGLGTANPHEKLAETKQAVKAAIKAGYRHIDTAWAYETEPFVGEAIKELLEDGSIKREDLFITTKVWPVLWDEVDRSLNESLKALGLEYVDLLLQHWPLCFEKIKDPKGISGLVKTPVDDSGKTMYAADGDYLETYKQLEKIYLDPNDHRVRAIGVSNFSIEYLERLIKECRVKPTVNQVETHPHLPQMELRKFCFMHDILLTAYSPLGSHGAPNLKIPLVKKLAEKYNVTGNDLLISYHIRQGTIVIPRSLNPVRISSSIEFASLTKDELQELNDFGEKYPVRFIDEPFAAILPEFTGNGPNLDNLKY

SEQ ID NO: 2867 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKHNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCKLKGPDALTKFMIALHNAIGGIDTDKLPFSFFDRNEKNVQTLLTANKRVNMNIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2868 - protein, 521 aa, Triticum aestivum
MGNQNGTPGNDYYNRFPREHPASRPTAAGILRQGLDPTSISVLGRKTADLREHYILGRKLGQGQFGTTYLCTEISTGCDFACKTILKRKLITKVDVEDVRREIQIMHHLSGHKNVVSIKDVYEDAQAVHIVMELLPGGELFDRIQGNGRYSEMKAAEITRIVVSIVAMCHSLGVMHRDLKPENFLLLDKDDDLSIKAIDFGLSIYFKPGQVFSELVGSPFYVAPEVLHKRYGPESDVWSAGVILYVLVSGVPPFWADTQKGIFDAVLKGHLDLESDPWPKISDSAKDLIRKMLCNCPSERLKAHEVLRHPWICQNGMATDGVLDPSVISRLKRFSAMNNLQKLALRVIAERLSEEEIAGLRELFKTVDIKNRGVITFGELRKGLTRYGNELVDTEICDIMEAADTDTDVTINYEEFIAATMPLNKIEREEHLKAAFTYFDKDGSGYITVDKLQRACAEYNMEGTLLEEIILEADQNNDGQIDYAEFVAMMQGNANGGNIGLGRPTMETSLNVTLRDAAQVH

SEQ ID NO: 2869 - protein, 233 aa, Arabidopsis lyrata
  misc_feature (96)..(96): Xaa can be any naturally occurring amino acid
  misc_feature (144)..(145): Xaa can be any naturally occurring amino acid
MEGGASNEVAESSKKIGRGKIEIKRIENTTNRQVTFCKRRNGLLKKAYELSVLCDAEVALVIFSTRGRLYEYANNSVRGTIERYKKACSDAVNPPXVTEANTQYYQQEASKLRRQIRDIQNLNRHILGESLGSLNFKELKNLEXXLEKGIGRVRSKKHEMLVAEIEYMQKREIELQNDNMYLRSKITERTGLQQQESSVIHQGTVYESGVTSSHQSEQYNRNYIPVNLLEPNQ

SEQ ID NO: 2870 - protein, 379 aa, Arabidopsis thaliana
YSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 2871 - protein, 1146 aa, Populus tremula
MASQSQRQSNQPAHNQAQSSGTSNMRQHHHPTESVSKAIAQYTVDAQLHAVFEQSGGTGKSFDYSKSVKTPNQSVPEEQITAYLSKIQRGGHIQPFGCMIAANEQSFRGIAYSENAKNMLGLTPQSVPSLEKQEILFVGGDVRIFFRPSSAVLLEKTFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNIKGDIIGAFCFLQIASPELQQSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVIYTQSSAGWVEIHVCPTLKQISDGHTLVHTEFRYLERVLQTRMLGLQHPPRSFLNCKLTLIKLHREGMVPKIQFQGLSVCQGRLIWLSFPENTTVALYPLTIWFLLLHRHQSRSITHT

SEQ ID NO: 2872 - protein, 384 aa, Thermococcus kodakarensis
MFPERGASEEEVLRELEEKTREDLTFDSGKILGSMCTYPHPFAVKVVMKYIDRNLGDPGLHIGSQKIEKEAVDMLANLLGLEKGYGHIVSGGTEANILAVRAMRNLAGIEKPELILPESAHFSFIKAAEMLGVKLVWAELNDDYTVNVKDVEKKITDRTIGIVGIAGTTGLGVVDDIPALSDLALDYGLPLHVDAAFGGFVIPFAKALGYEIPDFDFRLKGVKSITIDPHKMGMVPIPAGGIIFREKKFLDSISVLAPYLAGGKIWQATITGTRPGANALAVWAMIKHLGFDGYKEVVKEKMELARWFASELKKIPGIYLIREPVLNIVSFGSEKLEELEKELKARGWGVSAHRGYIRIVVMPHVKREHLEEFLRDLREIAKRL

SEQ ID NO: 2873 - protein, 1146 aa, Populus tremula
MASQSQRQSNQPAHNQVQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQAPRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNIKGDIIGPFCFLQIASPELQQSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 2874 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRGIAYNENAKNMRGLTPQSVPSLEKQEILFVGGDVRILFRPSSAVLLEKTFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGCINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2875 - protein, 132 aa, Brassica napus
MCGILAVLGCVDNSQATRSRIIKLSRRLRHRGPDWSGLHCYEDCYLAHERLAIIDPISGDQPLYSEDKTVVVTVNGEIYNHKALRESESLKSHKYHTGSDCEVLAHLYEEHGEEFINMLDGMFAFVLLDTKD

SEQ ID NO: 2876 - protein, 681 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYQPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENRIGGGSTTSSYLQNHHEILNWRRLSQTG

SEQ ID NO: 2877 - protein, 514 aa, Brassica napus
MKFPLLGLLLLVTLVGSPTRAEEGPVCPKTETLSRASFPEGFMFGTATASYQVEGAVNEGCRGPSLWDIYTKKFPHRVKNHNADVAVDFYHRFREDIKLMKKLNTDALRLSIAWPRIFPHGRMEKGNSKEGVQFYHDLIDELLKNDLTPLVTIFHWDMPADLEDEYGGFLSERVVPDFVEYANFTFHEYGDKVKNWITFNEPWVFSRSAYDVGKKAPGRCSPYIKDFGHLCQDGRSGFEAYVVSHNLLVSHAEAVDAFRKCEKCKGDKIGIAHSPAWFEPEDVEGGQRTVDRVLDFIMGWHLDPTTYGDYPQSMKDAVGARLPKFTKAQKAKLKGSADFVGINYYSSFYAKASEKPDYRQPSWATDSLVEFEPKTVDGSVKIGSQPSTAKMAVYAAGLRKLVKYIKDRYGNPEIIITENGYGEDLGEKDTDHSVALNDHNRKYYHQRHLLSLHQAICEDKVNVTSYFVWSLMDNFEWLDGYTARFGLYYIDFQNNLTRMEKESATCSLNSSNRA

SEQ ID NO: 2878 - protein, 664 aa, Unknown
  Piromyces sp. E2
MKTLSIFTTLLAVSAAKKCVVRNPTDSAKTNDVKAPVTDDIPSDNETPVNVDENTPLDKEEDSGIENSDIENSEDKPKGKLPADFKWGAATAAYQVEGAWNEGGRGESVWDHFTHLYPKNVESGDRSNPNSTNGNVACDSYHKLGEDIKMMKIMKGNHYRFSMSWSRLFPDGQAKKVKGKWNVNKEGVEYYDMVIDTLLENNITPMATLYHWDFHTLSMKSMVVGRLPFTRRFAKYAEFCFEHFGDRVKNWITTNEPWVNCVSGYRLGPGKAPYRCTGEAPRKLANDTAGLDLLGGCSYEIGPSQYTKNHEALTANRPPQRLEDVWCSHNILIAHAKAVNVYRKKFQKKQKGLIGITIDGEAQIPWQDDKTTPEELENNKKYANLAAEFRIGWYSDPPMIGDYPESVKQRMSKDMPVFTDEEKALLKGSSSDFLGWNTYTAHWAEQVKNEDGTYVQPPTDEEANFENSKRDMWDDNCRGRGEGWTCIPPTLGSQAGSSWNTKYGPTIRVGLNWFADRHKGLIKIGIVITENGCAQPNYKVSRANDEVTKKYFESIGQPEYADVYDESIIEDEKNIEGSILHDEYRIDWYKQYLENLRLAYVEDKVDVRGYMAWSLVDNFEWENGYETRFGMTYIDFYNDKNLTRVPKDSLTFLGQWYLENVEQA

SEQ ID NO: 2879 - protein, 146 aa, Legionella pneumophila
MKYLHTMVRVSNLEQSLDFYCNKLGLIEVKRTENAKGRFTLVFLAAPADIEQVQTSYGPMLELTYNWDPEDYTEGRNFGHLAYHVDDIYKICQHLQECGVVINRPPRDGHMAFIRSPDNISIELLQKGGPLPKQEPWLSAPNIGHW

SEQ ID NO: 2880 - protein, 659 aa, Aspergillus nidulans
MLPSSHTAVEPGRPIPGVQDHHSNYFVAEHAQTSILRLSHSLLENAVDVKLYPIYFSTYSSGFSCALMPKRIARGGNGLNAELPSCRGRPISQDSIPLDSHTASCAMSSHRADFDSIPIVDLSTLNSPHIQNARNSQSPSGRPALRLGSSTSSPLYGEKPSNPELEKPAEGALSEAFDIGYELAGDIRKGPGDPPPQDEYGLYGDNQWPDERLLPGFRKIYLEYFSQTLELSRKLIKMNALALGQEEHLFDSAVEYPGVLSRMLHYPPQPVEGQEIPGQAAHTDHVPALQVRNNQGHWVAAPPIPGTLVVNIGDCLATWSNNRFKSTIHRVVNLTGEERLGGHRLRRQLPFQRAIHGGRIGNRAPQGQGRNPCSDTPAYEVIPVSTPNRTGKGNNYAYLVTDEPTKQSVIIDPANPPEVVPELEAQTKAGKINLTAIVNTHHHWDHAGGNNEVLKTFKVPVIGGKDCQSVTKTPAHGEVFKIGDRISVTALHTPCHTQDSICYFMQDGEQKAVFTGDTLFIGGMTEWINAESSAAAGCGRFFEGTAPEMHKALNETLASLPEDTKVYPGHEYTKGNVKFCLAVSQSEPVKKLQAFAEANQQTQGMFTIGDEKLHNVFMRVTASHPTTTSRPKAYGSRTPRFRRKQARPIPSRSWLLCAR

SEQ ID NO: 2881 - protein, 216 aa, Glycine max
  misc_feature (204)..(204): Xaa can be any naturally occurring amino acid
SYVGPPPPHELSVLCDAEVALIIFSNRGKLYEFSSTQSMPKTLEKYQKCSFAGPETALQNRENEQLKSSRNEYLKLKARVDNLQRTQRNLLGEDLESLGIKELEHLEKQLDSSLKHIRSTRTQHMVDQLTELQKKEQMFCEANKCLRRRLEESNQVIWQHAWEQSERHSEVQPQQLNGNNFFHPLDGAGEPTLQIGYPSEALTXSCMTTFLPPWLP

SEQ ID NO: 2882 - protein, 488 aa, Zea mays
  misc_feature (185)..(185): Xaa can be any naturally occurring amino acid
MARGREGEVRNLVLGKYELGRMLGQGSFAKVYYGRDLRDGQSVAIKVIDKARLRQTDGMVEQLRREISIMRMVRHPNVVGIREVLASRQRVFVVMEYARGGELFAKVARGRLTEDAARKYFQQLVAAVAFCHSRGVAHRDLKPENLLLDEEGRLKVTDFGLAALPEQLRHDGLLHTQCGTPAYVXAPEVLRKRGYDGARADLWSCGVVLYVLLCGFLPFQHDNYVKLYQKIFKADYQVPPWVSGDARRLIARLLVVDPAKRASIAEIMCTPWFRKGFVPPVLSPPVTPKKQQLDEGGALFDNDDDDNSNSNHSGATSPRSGNAFQLISSMSSGFDLSGLFESEQKTATVFTARAPAATVVEKRESVARPLGFEVTRGKGWKVRMEAKAEGTNGRLAATAEVLEVAVDGAVVEFVHDAGDALDFNKFCAVDVPPGLTEIVWGGQGDSPPPPVGPGGTSVLGGPRLGRGSGSNFGWELNTAARPPPFCTR

SEQ ID NO: 2883 - protein, 240 aa, Zea mays
MGRGKIVIRRIDNSTSRQVTFSKRRNGIFKKAKELAILCDAEVGLVIFSSTGRLYEYSSTSMKSVIDRYGKAKEEQQDVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 2884 - protein, 672 aa, Shigella flexneri
MSYPSLFAPLDLGFTTLKNRVLMGSMHTGLEEYPDGAERLAAFYAERARHGVALIVSGGIAPDLTGVGMEGGAMLNDASQIPHHRTITEAVHQEGGKIALQILHTGRYSYQPHLVAPSALQAPINRFVPHELTHEEILQLIDDFARCAQLAREAGYDGVEVMGSEGYLINEFLTLRTNQRSDQWGGDYRNRMRFAVEVVRTVRERVGNDFIIIYRLSMLDLVEGGGTFAETVELAQAIEAAGATIINTGIGWHEARIPTIATPVPRGAFSWVTRKLKGHVSLPLVTTNRINDPQVADDILSRGDADIVSMARPFLADAELLSKAQSGRADEINTCIGCNQGCLDQIFVGKVTSCLVNPRACHETKMPILPAVQKKNLAVVGAGPAGLAFAINAAARGHQVTLFDAHSEIGGQFNIAKQIPGKEEFYETLRYYRRMIEVTGVTLKLNHTVTADQLQAFDETILASGIVPRVPPIDGIDHPKVLSYLDVLRDKAPVGNKVAIIGCGGIGFDTAMYLSQPGESTSQNIARFCNEWGIDSSLQQAGGLSPQGMQIPRSPRQIVMLQRKASKPGQGLGKTTGWIHRTTLLSRGVKMIPGVSYQKIDDDGLHVVINGETQVLAVDNVVICAGQEPNRALAQPLIDSGKTVHLIGGCDVAMELDARRAIAQGTRLALEI

SEQ ID NO: 2885 - protein, 446 aa, Rhodopseudomonas palustris
MRKIVVRSLAVLGVVAVPVVSALALQREQTAPADLDLIGGVIQLVQRAYVHPIPSDELTKDALKGLLNRLDPHSDYMDEKEFKDMQTDMSGQFGGLGMQITAQGGIPRIVSPIDGTPAARAKLEPGDLIIKVGTATTQGMSLRNVVDMLRGAPGTKVTITVLRGKDEPFDVTLTREIIRVASVKSEIKPDGVGYIRISQFGADTADGFTAALTKLKSDAKDGGLKGLVIDLRNDPGGLLNAAVSVAGDLLDGGTVVSIRGRQADDQRVFSAPSKGDKLPGVPIVVLINGASASASEIVAGALQDRKRATVMGTTSFGKGSVQTVIPIKGHGAVRLTTALYYTPAGRSIQDEGIVPDVIEEAPKDQQISGGPLIRESALHGAIANPGQLGKSDASATKATPKTGEPTDDKTKSATSAPIKADLIGKPEDAQLNAALALVLKKDAAPK

SEQ ID NO: 2886 - protein, 441 aa, Oryza sativa
MEGGRGGKRWRFATPNLAVAAAGERSIQRYLLQLHACLDENGPRPVIPLSHGDPSSSACFRTAPEAEEAVAAAVRSGDYNGYSSPATSLPARRAIAEYLSCDLPYKLCTDDIFLTSGGTQAIEIVMSVFGQPGANILLPKPGYPKHEAHAVFHRMEVRLYDLVPERGWEINVEAVEALADENTVAIVITNPNNPCGNVYTYEHLSKIADTASKFGLLVIADEVYGHLVYGSTPFVPMGVFGETVPVLTLGAISKRWVVPGWRFGWIAICDPKGILKETKVVDSLRSFRNLTTGPATFIQGAIPHIMKNTNDEFFRKTLELLKETAEICFGEIKEIKCITCPHKPEGSFFMMVKLDISQLSDICDDIDFCSKLVKEESVVLLPGRALGMENWLRITFALDPPRLKQGLERVKSFCRRHQSHANMLNISASAKVEPHFGMSKS

SEQ ID NO: 2887 - protein, 407 aa, Rheum australe
MDGVAQISDTDMAEAAPPPSDPSQPQPAAPDPSQHQPLPQQPQQINIPATLSHGGRFIQYNIFGNIFEVTAKYKPPIMPIGKGAYGIVCSALNSETSEHVAIKKIANAFDNKVDAKRTLREIKLLRHMDHENVVAIRDIIPPPLRDSFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTTAIDVWSVGCIFMELMDRKPLFPGRDHVHQLRLLMELIGTPSEAELGFLNENAKRYIRQLPQYTRQSIPGKFPHVHPLAIDLVEKMLTFDPRQRITVEDALAHPYLNSLHDISDEPVCMTPFSFDFEQHALSEEQMRELIYREALAFNPEYQQG

SEQ ID NO: 2888 - protein, 469 aa, Bacillus subtilis
MSSNEKRFPEGFLWGGAVAANQVEGAYNEGGKGLSTADVSPNGIMSPFDESMTSLNLYHNGIDFYHRYKEDIALFAEMGFKAFRTSIAWTRIFPNGDEEEPNEEGLRFYDDLFDELLKHHIEPVVTISHYEMPLGLVKNYGGWKNRKVIEFYERYAKTVFKRYQHKVKYWMTFNEINVVLHAPFTGGGLVFEEGENKLNAMYQAAHHQFVASALAVKAGHDIIPDSKIGCMIAATTTYPMTSKPEDVFAAMENERKTLFFSDVQARGAYPGYMKRYLAENNIEIEMAEGDEELLKEHTVDYIGFSYYMSMAASTDPEELAKSGGNLLGGVKNPYLKSSEWGWQIDPKGLRITLNTLYDRYQKPLFIVENGLGAVDKVEEDGTIQDDYRINYLRDHLIEAREAIADGVELIGYTSWGPIDLVSASTAEMKKRYGFIYVDRDNEGNGTFNRIKKKSFNWYQQVIATNGESL

SEQ ID NO: 2889 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRGIAYNENAKNMRGLTPQSVPSLEKQEILFVGGDVRILFRPSSAVLLEKTFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGCINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCKLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 2890 - protein, 154 aa, Thermus thermophilus
MTLVRRDARPMELTPFRTWSPFTLVDEVNRLFEEAFSDLVRPAAAYVAPADLYETDEALILEMAVPGMTPEDLEVSLEGNKLTIRGQVKPVADERVRRYYLQEMAHGSFVRTFTLPVEVDASGVKAEFRNGILRLTLPKVAEARARRIPIEVVQ

SEQ ID NO: 2891 - protein, 220 aa, Arabidopsis thaliana
MGQQSLIYSFVARGTVILAEYTEFKGNFTSVAAQCLQKLPSSNNKFTYNCDGHTFNYLADNGFTYCVVVIESAGRQIPMAFLERVKEDFNKRYGGGKASTAKANSLNKEFGSKLKEHMQYCADHPEEISKLSKVKAQVTEVKGVMMENIEKVLDRGEKIELLVDKTENLRSQAQDFRTQGTKMKRKLWFENMKIKLIVFGIIVALILIIILSVCHGFKCT

SEQ ID NO: 2892 - protein, 387 aa, Glycine max
MDSEGEGVRTPKMGVEAEGALNSKMKGAGNVSSKDMIFRADKIDLKSLDAQLEKHLSRVWSRSIETKRPREEWEIDLAKLDLRYVVAHGAYGTVYRGTYDTQDVAVKVLDWGEDGVATAAETAALRASFRQEVAVWQKLDHPNVTKFVGASMGTSNLKIPPKNPMNADEESLPSRACCVIVEFVSGGTLKQYLFKSRRRKLAYKIVIQLALDLARGLNYLHSKKIVHRDVKTENMLLDTSRNLKIADFGVARVEAMNPSDMTGETGTLGYMAPEVLDGKPYNRRCDVYSFGICLWEIYCCDMPYPDLSFADVSSAVVRQNLRPDIPRCCPSALANIMRKCWDANPNKRPEMEEVVRMLEALDTSKGGGMIPEDQSSGCFCFAPTRGP

SEQ ID NO: 2893 - protein, 315 aa, Oryza sativa
MEGGRGGKRWRFATPNLAVAAAGERSIQRYLLQLHACLDENGPRPVIPLSHGDPSSSACFRTAPEAEEAVAAAVRSGDYNGYSSPATSLPARRAIAEYLSCDLPYKLCTDDIFLTSGGTQAIEIVMSVFGQPGANILLPKPGYPKHEAHAVFHRMEVRLYDLVPERGWEINVEAVEALADENTVAIVITNPNNPCGNVYTYEHLSKIADTASKFGLLVIADEVYGHLVYGSTPFVPMGVFGETVPVLTLGAISKRWVVPGWRFGWIAICDPKGILKETKVVDSLRSFRNLTTGPATFIQVILWTHKSHIKLSVPW

SEQ ID NO: 2894 - protein, 131 aa, Brassica napus
  misc_feature (117)..(117): Xaa can be any naturally occurring amino acid
  misc_feature (122)..(122): Xaa can be any naturally occurring amino acid
  misc_feature (128)..(128): Xaa can be any naturally occurring amino acid
MFVAVHGVPVLVESSWRLPLSDVVVVRKKSAFLERSWNSKDVRKLVRVVGVHLLILLAPFHFNWSAFKLCLWLSVIIGICITLSYHRNLSHRSFNLPKWLEYLFAYGGVLAFQGAPXEWVSXHRYHHXHCD

SEQ ID NO: 2895 - protein, 98 aa, Brassica napus
YEQRLSDGSVIPVNTFSYDKCRRRFDLGDADYLRYHGLQEFDRAMQHLEEKYGFMTSEHQFISRTDERDIVIVFERCDLVFVFNFHWTSSYFDYRIGC

SEQ ID NO: 2896 - protein, 150 aa, Agrostis stolonifera
MSIVRWSNVFDPFSLDLWADPFDAFRSILPAASGNHDTAAFVNARMDWKETPEAHVFKADLPGVKKEEVKVEVEGGNVLVVSGERKGEGGQERQVATLERSSGKFVRRFRLPENAKVEEVKAGLENGVLTVTVPKAEVKKPEVKAIEISG

SEQ ID NO: 2897 - protein, 374 aa, Glycine max
  misc_feature (226)..(226): Xaa can be any naturally occurring amino acid
  misc_feature (353)..(353): Xaa can be any naturally occurring amino acid
MSQPKIKRRVGKYEVGRTIGEGTFAKVKFARNSETGDPVALKILDKEKVLKHKMAEQIRREVATMKLIKHPNVVRLCEVMGSKTKIYIVLEFVTGGELFDKIVNHGRMSENEARRYFQQLINAVDYCHSRGVYHRDLKPENLLLDAYGNLKVSDFGLSALSQQVRDDGLLHTTCGTPNYVAPEVLNDRGYDGVTADLWSCGVILFVLVAGYLPFDDPNLMNLYKKXRKLITRILDPDPTTRITIPEILDDEWFKKDYKPPVFEENGETNLDDVEAVFKDSEEHHVTEKKEEQPTAMNAFELISMSKGLNLENLFDTEQGFKRETRFTSKSPADEIINKIEEAAKPLGFDVQKXNYKMRLANVKAGRKGNLNVAT

SEQ ID NO: 2898 - protein, 336 aa, Triticum aestivum
  misc_feature (257)..(257): Xaa can be any naturally occurring amino acid
MRMFSKACSLVVSSLPRCSSSAPAIRGQPSLIPRVSRKWLGKPLMYGIGTLLVMPLRTIHGVGRMFGAARYLCNMTSVSSSLQIELVPCLQDNYAYILHDVDTGTVGVVDPSEAVPIINALEKRNQNLTYILNTHHHYDHTGGNLELKAKYGAKVIGSEKDKDRIPGIDITLSEGDTWMFAGHQVLVMETPGHTSGHVSFYFPGSGAIFTGDTLFSLSCGKLFEGTPEQMHSSLQKIVALPDVTKVYCGHEYTLSNXSRFALSIEPGNEELQEYAASTADLRHKNTPTVPTTIAREKPGNPFWGPSGPELKKGGPIPIHLNNPGFFKFSAGGGIIF

SEQ ID NO: 2899 - protein, 295 aa, Candida albicans
MPAQLQVNTDYFTLNNGNKIPAVGLGTWQATNEDEAYRAVLAALKNGYKHIDTAAIYGNEEQVGKAIKDSGVPREELFVTTKLWNADHKNIEEALETSLKKLGLNYVDLYLIHWPASIDKSTNKPYTDFDYVDTYRGLQKVYKNSKKIRAIGVSNFTKKKLERLLSSEGVDVVPAVNQIEAHPLLTQPELYDYLKEKGIVLEAYSPLGSTNSPLFKNETIVKIAEKNGVEPAQVLVSWAIQRKTVVLPKSVTESRVISNLKTFTLPSEDFETLNKLSEKDGVVRTCNPAFNNFDD

SEQ ID NO: 2900 - protein, 564 aa, Xanthomonas campestris
MCSIFGIFGLQPGDDLQALRRQALECSQRQRHRGPDWSGVYVDAGAILVHERLAIVDPAGGSQPLLSEDGSLALAVNGEIYNHRELKAELLQPYAFQTGSDCEVINALYREDAPASYLNRLNGIFAFALWDKAAGRVIIARDPIGVVPLYWGHDREGRLRVASELKSLVDDCADAAQFPPGHWYDSATGALSRYYERSWREYSEVENVQVPLQELREAFERAVHRQLMTDVPYGVLLSGGLDSSLVAAVAARYARHRIEENDTTEAWWPRLHSFAIGLTGSPDLAAAEVAAAALGTVHHGFEYSFEEGLDALPEVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDARFKMIDKTSTGATRIEKGILREAFAGYLPESILWRQKEQFSDGVGYGWIDGLKAHAAAHVSDRELAAADRRFPVNPPQTKEAYFYRSLFEQFFPSQAAAETVPGGKSIACSSPTAIAWDASFAAMADPSGRAIAGVHAQALAS

SEQ ID NO: 2901 - protein, 289 aa, Candida albicans
MSAQLKTNNDRIALNNGNKIPVIGLGTWESNKDAFLTALKLGYRHIDTATIYKNEEQVGQAIKESGIPREELFITTKVWNNDHKNVEQALETSLKKLGLDYVDLYLVHWPVSIDKTTKEPYPDYDYVDTYKELQKIYKTTTKIKSIGVSNFTKSQLERLLSADGVDVVPAVNQVEAHPLLPQPELYEYLKEKGITLEAYSPLGTSSSPLIKNKTIVEIADKNGVDPAQVLISWAVQRKTVVLPKSVTESRLVSNLKTFELSAEDFDTLNKLSEKEGITRIINPFKNFQD

SEQ ID NO: 2902 - protein, 207 aa, Thermus thermophilus
MRVFPVTLGPLQENAYLVETGEGPVLIDPGDEPEKLLALFQTTGLTPRAILLTHAHFDHVGAVAPLVEALDLPVYLHPLDLPLYEGADLAARAWGLAIPKPPLPVRPLEEGMGLFGFQVLHLPGHSPGHVAFYDPEGAQVFSGDLLFRGSIGRYDLPGADPKALFASLKRLLSLPPETRVHPGHGPGTTLGLEARTNPFLTGLEWEA

SEQ ID NO: 2903 - protein, 335 aa, Mannheimia succiniciproducens
MKTLDEFIVDRQAEYPNAKGALTGILSSIRLVAKVIHRDINRAGLTNNILGFSGIDNVQGEHQMKLDLFAHNMMKQALMAREEVAGFASEEEENFVAFDTERGRNARYVILTDPLDGSSNIDVNVSVGTIFSIYRRVSPIGSPVTLEDFMQPGNRQVAAGYVVYGSSTMLVYTTGNGVNGFTYDPSLGTFCLSHENMQIPATGKIYSINEGQYLKFPMGVKKYIKYCQEEDAATNRPYTSRYIGSLVADFHRNLLKGGIYIYPHATNYPQGKLRLLYEGNPIAFLAEQAGGIASDGYNRVLDIQPSQLHQRVPLFVGSKQMVEKAQDFMHQFKED

SEQ ID NO: 2904 - protein, 330 aa, Unknown
  Shewanella sp. ANA-3
MQTLAQHLTSKAVNESLSQLILTLADTSKAISHAVRHGALAGVLGATEQENVQGETQKKLDIITNDMLKDALKADGTVRGLASEEEDHVVEVCANGQYLVCFDPLDGSSNIDINSLVGTIFSVLPAPQGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGLDYSEEPSLD

SEQ ID NO: 2905 - protein, 202 aa, Carica papaya
FGGVYRGVYDAQDVAVKVLDWGEDGFATAAEAAALRTSFRQEVAVWHKLDHPNVTKFIGASMGTSNLKIPPKDATSDGHNPLPSRACCVVVEYLPGGTLKKFLIRNRRKKLAIKVVIQLALDLSRGLSYLHSKKIVHRDVKTENMLLDTHRTLKIADFGVARVEAQNPRDMTGETGTLGYMAPEVLDGKPYNRKCDVYSYGV

SEQ ID NO: 2906 - protein, 408 aa, Novosphingobium aromaticivorans
MAAKSGRVHLNSSWGPLNPVAKRNRALSSRGVAEVIKEPPSMHEPLFQPVRLGAIEAPNRIIMAPLTRGRANPQAVPTPIMGEYYRQRASAGLIISEATAISPEGAGWPSAPGIWTDEQTEAWKPIVDEVHAAGGRIVLQLWHMGRVVHPYFLGGEPPVSASATRAPGHAHTPEGTKDYETARPLRLDEIPRLIDDYGRAAENARKAGFDGVQLHAANGYLIDQFLRDGTNLRDDDYGGSPENRVRLMREVMERLISIWGKERVSIRLSPNGDSQGVDDSNPEATFGEAARVLEELGVGFVELRQPGPEGTFGNTDVPKQDGLIRSIYTGPLVLNSDYTPEEAAADVASGRADAISFGRPFISNPDLVERIRVGAHLNPNKGVPATWYFPGEAGYTDYPTLAEETAIA

SEQ ID NO: 2907 - protein, 931 aa, Vibrio fischeri
MKKYGLRARVITLTLAPTLIIGLLLSGFFTMNRYNDLENQLISSGTSIIEPLAISSEYGMTGKNREAVRRLISYAHRKHSNIVRSIAVFDEHHELFVTSNFHPNFESLTFPKDKPIPLLLDISFQEESLILRTPILPEGKFSANFDSSHINEPLGYIAIELDLSSLRLQQYQEIFSALLVLALGLGLSGIFAYRLMQDVTQPISHMVSVVDRIRRGHLDVRIENKLHGELDTLKNGINAMAISLSEYHVEMQQSIDQATSDLRETLEQLEIQNVELDIAKKRAQEAARVKSEFLANMSHELRTPLNGVIGFTRQMLKTSLSENQQDYLQTIERSANNLLTIINDILDFSKLEAGKLLLENLPFDFQDSLDEVVSLLAPSAHEKGLEITLKIDQRVPSGLIGDPLRIQQVLNNLVGNAIKFTEKGNIDISVELKHLTDDYVDLQFVVRDTGIGISERQQAQLFQAFSQADASISRRYGGTGLGLVITQKLISQMGGEIGLSSRLHQGSTFWFTIRMNPTDLPMLNEHDITQLERKKLLLIEPNMQSASILQQQFISHGVFVTYRSTLPEIIEPHDYALISLSSNSKPSIETIQEMTSQLSANCSTIIVGLPSTELALTDELNQFSHITCLSKPFAKKKLLDALLVEKDLQPVPELPDLMAHASEEQKLPIKVMAVDDNPANLKLISALLSEQVETVITCDNGLDAVQQATEQHFDIILMDIQMPKMDGVMACKEIRKTALNAQTPVVAVTAHAMEGERERLISEGMDDYLTKPIEEHVLQQVIIHWSPLTDNSDVEKITILADAIPELHVEEANDKVMGSIDWEAALKQSAGKEDLAQEMLQMLVDFIPEVNEWIDKALESDISEEELCHYIHKLHGSSSYCGVPRLKQLCNLIETSLRQHQTISDIEPELFELQDEMEKVTKDANLLLSNT

SEQ ID NO: 2908 - protein, 820 aa, Oryza sativa
MLCLTSSSSSAPAPLLPSLADRPSPGIAGGGGNVRLSVVSSPRRSWPGKVKTNFSVPATARKNKTMVTVVEEVDHLPIYDLDPKLEEFKDHFNYRIKRYLDQKCLIEKHEGGLEEFSKGYLKFGINTVDGATIYREWAPAAQEAQLIGEFNNWNGAKHKMEKDKFGIWSIKISHVNGKPAIPHNSKVKFRFRHGGGAWVDRIPAWIRYATFDASKFGAPYDGVHWDPPACERYVFKHPRPPKPDAPRIYEAHVGMSGEEPEVSTYREFADNVLPRIRANNYNTVQLMAIMEHSYYASFGYHVTNFFAVSSRSGTPEDLKYLVDKAHSLGLRVLMDVVHSHASNNVTDGLNGYDVGQNTHESYFHTGDRGYHKLWDSRLFNYANWEVLRFLLSNLRYWMDEFMFDGFRFDGVTSMLYHHHGINKGFTGNYKEYFSLDTDVDAIVYMMLANHLMHKLLPEATIVAEDVSGMPVLCRPVDEGGVGFDFRLAMAIPDRWIDYLKNKEDRKWSMSEIVQTLTNRRYTEKCIAYAESHDQSIVGDKTIAFLLMDKEMYTGMSDLQPASPTINRGIALQKMIHFITMALGGDGYLNFMGNEFGHPEWIDFPREGNNWSYDKCRRQWSLVDTDHLRYKYMNAFDQAMNALEEEFSFLSSSKQIVSDMNEKDKVIVFERGDLVFVFNFHPNKTYKGYKVGCDLPGKYRVALDSDALVFGGHGRVGHDVDHFTSPEGMPGVPETNFNNRPNSFKVLSPPRTCVAYYRVDEDREELRRGGAVASGKIVTEYIDVEATSGETISGGWKGSEKDDCGKKGMKFVFRSSDEDCK

SEQ ID NO: 2909 - protein, 477 aa, Oryza sativa
MSYNHSPSITAETINQKVRIFTYEPCGEIVRHARIIYCNLGNPQALGQRPINFFREVLSLCDNPSLIDRDEARALFSPCALKRARKIIESLPGRDSGSYTSSQGVRGLREAVADGIAARDGFPSKPDNIFLTDGASSAINMMMQILIRSHEDGILCPLPEYPLYSASIILHGGTMVPYNLTEDSIWGLEIFEVKRCLEDARASGLTIRAMVVINPGNPTGQVLSITNQEEIVEFCRKEGLVILADEVYQENVYTENKRFNSFKKVARSLGYDHHDLSIVSFHSVSMGYYGECGRRGGYMEICGFGDDVIDEMYKLASLTICPNIAGQILISLVMDPPKLGDEAFEIFMVEKEETYSSLLKRAKALQKAFNGLEGVSCNKFEGAMYLFPRLRLPQAAIKAAQLEGVSPDVFYAHRLLDATGIAVVPGSGFHPDLVSSCKKVSGTSHIRCTILPGEETITAMVPSLQAFHEAFMDEFRG

SEQ ID NO: 2910 - protein, 130 aa, Zea mays
MAAAGLRKGNARLPPEVNRVLYVRNLPFNISSEEMYDIFGKYGAIRQIRLGNAKDTRGTAYVVYEDIYDAKNAVDHLSGFNVANRYLIVLYYQPAKMSKKSDVKKKEDEITRLQEKYGIGSKTPGPGSTD

SEQ ID NO: 2911 - protein, 755 aa, Oryza sativa
MVTVVEEVDHLPIYDLDPKLEEFKDHFNYRIKRYLDQKCLIEKHEGGLEEFSKGYLKFGINTVDGATIYREWAPAAQEAQLIGEFNNWNGAKHKMEKDKFGIWSIKISHVNGKPAIPHNSKVKFRFRHGGGAWVDRIPAWIRYATFDASKFGAPYDGVHWDPPACERYVFKHPRPPKPDAPRIYEAHVGMSGEEPEVSTYREFADNVLPRIRANNYNTVQLMAIMEHSYYASFGYHVTNFFAVSSRSGTPEDLKYLVDKAHSLGLRVLMDVVHSHASNNVTDGLNGYDVGQNTHESYFHTGDRGYHKLWDSRLFNYANWEVLRFLLSNLRYWMDEFMFDGFRFDGVTSMLYHHHGINKGFTGNYKEYFSLDTDVDAIVYMMLANHLMHKLLPEATIVAEDVSGMPVLCRPVDEGGVGFDFRLAMAIPDRWIDYLKNKEDRKWSMSEIVQTLTNRRYTEKCIAYAESHDQSIVGDKTIAFLLMDKEMYTGMSDLQPASPTINRGIALQKMIHFITMALGGDGYLNFMGNEFGHPEWIDFPREGNNWSYDKCRRQWSLVDTDHLRYKYMNAFDQAMNALEEEFSFLSSSKQIVSDMNEKDKVIVFERGDLVFVFNFHPNKTYKGYKVGCDLPGKYRVALDSDALVFGGHGRVGHDVDHFTSPEGMPGVPETNFNNRPNSFKVLSPPRTCVAYYRVDEDREELRRGGAVASGKIVTEYIDVEATSGETISGGWKGSEKDDCGKKGMKFVFRSSDEDCK

SEQ ID NO: 2912 - protein, 358 aa, Zymomonas mobilis
MPSLFDPIRFGAFTAKNRIWMAPLTRGRATRDHVPTEIMAEYYAQRASAGLIISEATGISQEGLGWPYAPGIWSDAQVEAWLPITQAVHDAGGLIFAQLWHMGRMVPSNVSGMQPVAPSASQAPGLGHTYDGKKPYDVARALRLDEIPRLLDDYEKAARHALKAGFDGVQIHAANGYLIDEFIRDSTNHRHDEYGGAVENRIRLLKDVTERVIATIGKERTAVRLSPNGEIQGTVDSHPEQVFIPAAKMLSDLDIAFLGMREGAVDGTFGKTDQPKLSPEIRKVFKPPLVLNQDYTFETAQAALDSGVADAISFGRPFIGNPDLPRRFFEKAPLTKDVIETWYTQTPKGYTDYPLLGD

SEQ ID NO: 2913 - protein, 422 aa, Arabidopsis thaliana
MATLKCIDWQFSGSEAAKDAAAASLGSYTSALYALCDPHGKPILPPRNEILETSNTAEKAVVKAVLYGSGNAYAPSLGLAAAKSAVAEYLNQGLPKKLTADDVFMTLGCKQAIELAVDILAKPKANVLLPSPGFPWDLVRSIYKNLEVRHYNFLPEKNFEIDFDSVRALVDENTFAIFIINPHNPNGNTYSEAHLKQLAELAKELKIMVVSDEVFRWTLFGSNPFVPMGKFSSIVPVVTLGSISKGWKVPGWRTGWLTLHDLDGVFRNTKVLQAAQDFLQINNNPPTVIQAAIPDILEKTPQEFFDKRQSFLKDKVEFGYSKLKYIPSLTCYMKPEACTFLWTELDLSSFVDIEDDQDFCNKLAKEENLVVLPGIAFSQKNWLRHSIDMETPVLEDALERLKSFCDRHSNKKAPLKDVNGVK

SEQ ID NO: 2914 - protein, 255 aa, Rhodopseudomonas palustris
MPADIRIVPCLTDNFGYLVHDPATGATASIDAPEAAPLIAALDKEGWKLTDILVTHHHGDHVGGIAELKKKYQCRVHAPHDANAKIADADVRLQEGDVVRVGDLTARVLETPGHTLDHLSYVFDDDRALFAADTLFSIGCGRVFEGTYPMMWESLLKLRALPDDFKLYCGHEYTASNVKFALGIEPDNAALQARAKQVESLRAEGKPTIPVTLGEEKQANVFLRADVPSVAAAVGMPGAPAAEVFGEIRERKNNG

SEQ ID NO: 2915 - protein, 354 aa, Bordetella bronchiseptica
MTSLWDPIQIGRMNLAHRLAMSPLTRSRAQDDGTPGELAAEYYAQRASLGLLISEGTQPSADGQGFLNSPGIYSEAHVAGWRKVADAVHAAGGHLYIQVMHAGRMSHPANTPHGRQAVAPSAIAPEAQIHTPTGMQQVPAPRALSPDEIQATVRDYRHAAARAIEAGADGVEIHGANGYLIQQFLSPNANHRDDAYGGPVAHRTRFALEVAAAVAEEIGADRTGIRLSPGSRLGGIDEGPHYGDMYRHLVAGLAQLKLSYLHIAHNGDEALLKDLRQLWRGPLLVNRVNRPIELIGQDVETGLADIAPVGRWALANPDFVARLRAGQPLNPPDQATFYGGGARGYTDYPRLAMR

SEQ ID NO: 2916 - protein, 351 aa, Colwellia psychrerythraea
MTANLLKPYALNNTINLSNRILMAPLTRCMADDNLVPTQLMAEYYARRAEAGLIISEAVIIRPDGQGFPNTPGLFSPAQIEGWKIVTAAVHKNGGKIFAQLWHTGRVAHPYFYGNGDADASVLAPSAIGVEGTVPRMRELTYKIPKAVTVEEMKTLVADYGQAAENAIKAGFDGVEIHGANGYLIDQFLHHDSNRRNDEYGGSSENMVRFPLEVIDEIISKIGADRTGLRVSPGAYFNMTGDSKDRAVFDLLLPELEQRNLAFLHIGIFDDSMEFDYLGGRASSYVRENYSKTLVGVGSYSAEAASSAINDDKFDLIAIGRPFIANPDYVAKIRNNEPLTSYSDEMLTSLI

SEQ ID NO: 2917 - protein, 289 aa, Bifidobacterium longum
MTNGHINPANVPDIALKDGHSIPQVGLGVLRIDDEGVVPVVESALEAGYRHIDGAAGYNNEAGVGRALAASGYNKGAKRETLWVTTKLRDSQQGYDSALKAFDNSLKLLQLDYVDMYMIHWPTPFDWRSTDTWKAFVKLRDEGMARTLGVCNFMPADLKRLHEETGAWPAVNQIELHPTWQQREVVAFCKEHGIAVEAYSPMARGADLNAGDGTIEKIAAAHEVSPAQVILRWHIENGTIIIPKSVHADRQKENLNLFGFALTADEHAAIDALDGPTRAGHDPLTFTYA

SEQ ID NO: 2918 - protein, 450 aa, Glycine max
MGKTPFSFRRSASRRRPKKTAAPPPPPSPPQHPYAAGFAASPDDNNRLIAAAAGSSALTKAKKKTGNVRLWMRFDRSGRSELVELEKNAIVRHAAIPARDLRILGPVFSHSSNILAREKAMVVNLEFIKAIVTAEEVLLLDPLRQEVLPFVEQLRQQLPGKSQPKLLGGTEEQEGEMHVSNGRQWLPTPEAADGLQSELPFEFQVLEIALEAVCTYLDSNVADLERGAYPVLDELARNVSTKNLEHVRSLKSNLTRLLARVQKVRDEIEHLLDDNEDMAQLYLTRKWLQNQQFEEAHLGATTSNNFPNTSRSVRQLGSIRSESLVTSHYEDDNNVEDLEMLLDAYFMQLDGTRNKILSVREYIDDTEDYVNIQLDNHRNELIQLQLTLTIASFAIAIETLIAGAFGMNIPCNLYNIDGVFWPFVWTTSAACVLLFLLILAYARWKKLLGS

SEQ ID NO: 2919 - protein, 772 aa, Deinococcus radiodurans
MADFHFALLKGRWLMAPKRTLSTPLSLDDAQKQVDDLSKAQDLSANTTDPGTTLTDNMGHVVSDDQNSLRAGERGPTLMEDFLFREKITHFDHERIPERVVHARGAGAHGYFQLDKSLEKYTHAKVLTEVGVKTPVFARFSTVAGSRGSADTARDVRGFAVKMYTKEGNWDIVGNNIPVFFIQDAIKFPDLIHSVKPEPHNEIPQAASAHDTFYDFIAETPEAMHMLMWIHSDRAIPRAYNMMEGFGVHTFRLVNAQGKAHLVKFHWKPVLGVKSLVWDEAQKIAGKDADFHRRSMWETIDQGGTLEWDFGVQVFTEEEAMKWDFDVLDATKIVPEDLVPVQRVGKMVLDRNVDNFFAETEQVAFMTQNVVPGIDFTNDPLLQGRNFSYLDTQLSRLGSPNWQELPINRPIIRVSNNQRDGHMRHTINKGRVAYFPNQMAANKPAQAGAAGFVTYPDKVEGTKLRVRAESFSDHYGQARLFWNSMSPVEKEHIAKSLRFELSKCETRDVRVRMLGHLAKINEVLAAQVAKGLGEKLPSTSDAKPGGQQDSASETALLAAAISPTTASGGLQKAKGLSQEEGQPKSAKGRKVAVLVADGVDAAGVKALQDALKKADVKYDIVAPHLGEIASGVMATATLSNTDPVVYDGVVVAGGAAAVRELAQHPESFNFVVGSYRHAKPIGSLGEGAEIVTGSGIGNVLRRVAADSPAKDGATAPVQNLSEVAGVRLAAGEGGAKLAALGVIVGQDKGASAAADSFVQALAEHRFWGRPQL

SEQ ID NO: 2920 - protein, 632 aa, Bacillus cereus
MCGYVGCLYNTAKRYSETEKIQFENMTNLLYHRGPDDQGYFRDEHVQFGFRRLSIIDLDAGHQPLAYENERYILMFNGEIYNYIELREMLIKQGACFSTQSDTEVIVALYAQVKEECVNYLRGMYTFVIWDRQEKKLFGARDHFGIKPLYIAQQNDITFFASEKKSILHVMQDKGVNPTALQHYFTYQYGPEPETLTNDINKIEPGHYFIKEIGKELEVYRYWKPYFNASDKTKEDHIRAIRDVLYDSVKVHMRSDVPVGAFLSGGIDSSIIASIAKEINPNLLTFSVGFEHRGFSEIDVAKETAEKLGVKNYSVLVTPQEFMNEFPKIMWHMDDPLADPAAVPLYFVAKEARKHVTVVLSGEGSDELFGGYNIYREPNSLKMFSYIPTSGKTVLKALSGVLKEGFKGKSFLERGCTPIEERYYGNAKIFREEEKIKLIKSYNESVNYKDVTKPLYNEIKNYDDVSKMQYIDMYTWLRGDILLKADKMSTAHSLELRVPFLDKEVFDVASKIPTELKIANRTTKVILREAVRGIVPDHVLDRKKLGFPVPIRHWLKDEMYDWALNIIKESKTEHLIDKQYVLNLLEAHCADKGDYSRKIWTVIAFMVWHQIYIEHKYDTNLFSEECRVYNLV

SEQ ID NO: 2921 - protein, 249 aa, Caulobacter crescentus
MALTVHQFRCLSDNYGFLVRDEASGKVATIDTPDAGAILAELAKLGWSLDLILNTHWHPDHAGGNETLKTATGATIVGPAEVTRIAPLDRVVRDGEEVMLGDTRLTVIDTGGHTLGHVSYYDAEDAIAFVGDTLFALGCGRLFEGTAEQMWDSLGRLIALPDETTVYCAHEYTASNARFALSVDSSAALAARAEAVFAARARDEATVPTTIGVEKATNPFLRAPLLRPDAPSPAQAFAEIRAAKDSFKG

SEQ ID NO: 2922 - protein, 492 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHGRASPETMRDIRGFAVKFYTREGNFDLVGNNTPVFFIRDGIQFPDVVHALKPNRKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWTSYWLKADRSLGQKLASRLNVRPSI

SEQ ID NO: 2923 - protein, 933 aa, Erwinia carotovora
MTKYSLRARMLILILAPTLMIGLLLSSFFVIHRYNQLQAQLADSGTSIIEPLATISAYAITHRQMDTIPALINTLHRRHSAIIRTISVFDARNQLLATTNVRNSVTLQPISSDALSYNRLHLHHTNDALILHMPIVNDSEFMPGGATPVLPGTATPLGYLVIELDTSTIRLQQYQEIFIAALLLLLSLGAAVLFAYRLMRDVTTPIRNMVDTVDRIRRGQLDSRVEGYMLGELDMLKNGINSMAMSLTAYHEEMQQNIDQATYDLRETLEQMEIQNVELDLAKKRAQEAARIKSEFLANMSHELRTPLNGVIGFTRQTLKTPLNTTQTDYLLTIERSANNLLNIINDVLDFSKLEAGKLVLEDIPFSLHSTLDDVVMLLAHTAHEKGLELTLSIQNDVPEQFVGDPLRIQQIITNLLGNAIKFTEQGNIDIRVEKRRQEHHQVQLEVQIRDTGIGIAELQQSQLFQAFRQADTSISRRHGGTGLGLVITQRLVKEMGGDISFQSQLNKGSTFWFHITLPLNPHAMPTEPAYTMLQGKHLAYVEYHPIAAQATLDILSQTPLMVSYSPTFEQLPEGDFDILLLGIPVQYRNMLLDYTPRLRDICRRAPCVILALPSLAQMDAEQLKTFGVHACLSKPLAASRLLPLLQDSTLFQLSFLPDATTSHQSVVRHPARLPLSVMAVDDNPANLKLIGTLLEEQVDTIILCESGTDAISQAKMHQIDIILMDIQMPGMDGICASELIRQIPHHATTPIIAVTAQTMTGEREHLLRSGMDDYLAKPIDEQMLKSVLTRHARKDPLKRDRGNIAGLLNEHDDSQLSLDWALAQQQAANKPELARDLLQMLLDFLPEVRQKIENVLNGQTDDNIIELVHKLHGSCSYSGVPRLKRICRYLEQQLRNGVHASDLEPEWLELLDEIDNVNKAAQPHIKPLHSSL

SEQ ID NO: 2924 - protein, 627 aa, Pseudomonas aeruginosa
MCGIAGFWNITGTLLGDNARVARQMAAAIHHRGPDESGIWYEAPRAPILVHARLAVLELSPAGSQPMHSDCGRYVLIYNGEIYNHLALRARLSEAGVTHSWRGGSDTETLLACFAQWGVESTLKLTVGMFALALWDRQEKTITLARDRMGEKPLYWGWQNGVLFFASELKALKEHPLFRGDIDRDALALFLRYGYVPAPYSIYKGIGKLRAGSYLVLSERSLNETCEPAAYWSANAAIEEALSNPFQGTDAEAVDLLESQLRTSISDQMVSDVPLGAFLSGGVDSSTVVALMQQQSSRPIRTFSIGFDEPGYDEAVYAKAVAEHIGTDHTELYVNSKDALDVIPSLPKIYCEPFGDSSQIPTLIVSGLARQQVTVALSGDGGDELFGGYNPYQFTPRVWRMLERFPHSMRRFASAFAQDLPLPEKLGKLRDVFASRTAEELFYRLNSHWRNHEYPVIGAQGHTALLDTPERWPRVDSFQHWMMAMDVQGYMPDDILVKVDRAAMANSLETRVPLIDHRVFELAWRMPLHMKIRNGKGKWLLREVLYRHVSRELIERPKKGFSVPVSDWLRGPLKEWAESLLDERRLQQEGYLDSRLIRRIWNDHLAGRRDHSRRLWSVLMFQAWLES

SEQ ID NO: 2925 - protein, 539 aa, Oryza sativa
MGNSLGCSASGERLVSAARDGDAVEARMLLELSPALARYSTFGGLNSPLHFAAAKGHLDIVTLLLEKGADVNVRNYCGQTALMHACRHGHWEVVQMLLLFRCNVTRADYLSGRTALHFAAHDGLVRCVRLLLADFVPSAPLEDGASSTVDGGECQTNSGSSPCSSLGLKFNESARLRYINKPADGGVTALHMAALNGHFDCMQLLIDLGANVSAVTFPYGTTANLIGAGSTPLHYAAGGGNAECCQLLLSKGASKLTLNCNGWLPIDVARMFGRRFLEPLLSPNSNSSIPAYQPSNYLALPFMSILNIARPDYVLCRIAIISETVKLGREFGLLHTVASVDDSDLCAVCLERSCSVAAEGCCHEFCIKCALYLCSTSNTRVEFTGPPGSIPCPLCRNGIMSFTKLPSTPTEGLKSSSALTFCNPCMLNTRSVDSPATISKAEIRRNRVAAVSSELVCPLTCSPFPSSALPTCRCSDDDPCDAIETQDGSEVQSPQPSHCASMEMDKREQQDLDRTSCSGMFWSRRSCHREEQCNAEINA

SEQ ID NO: 2926 - protein, 207 aa, Kluyveromyces lactis
MSRKKNILKVIILGDSGVGKTSLMHRYVNDKYSQQYKATIGADFLTKEVIVNDDKVATMQVWDTAGQERFQSLGVAFYRGADCCVLVYDVTNGKSFDNVKSWRDEFLVHANVSSPETFPFVILANKVDVEESKKVVSSRSAQEQAKSLGNVPLFFTSAKDSINVQDAFEEIARSALQQSQSDADAYEDDLSEAINIQLDGEPSSCNC

SEQ ID NO: 2927 - protein, 345 aa, Bacillus cereus
MNSKLFSPYTIKNVTLKNRIVMSPMCMYSSGNEDGRVTNFHLIHYGTRAAGQVGLVMVEATAVLAEGRISNNDLGIWDDNLIEGLHKTTTFIHDNGAKAAIQLAHAGRKAELDTNAFAPSAIPFNDKMKIPVEMNIQQIKETILAFQRAALRSKQAGFDVIELHGAHGYLINEFLSPLTNKRTDKYGGSPENRYRFLREIIDSVNEVWDGPIFVRISANDYHPDGLTVQDYVQYTKWMKEQGIDLIDCSSGAVVPAHIDVYPGYQVQYAKHIKEHTNIATGAVGLITTGSQAEQILNNNEADLIFIGRELLRNPYFPRIAANELGFELQEPHQYKRAPGKIHTNK

SEQ ID NO: 2928 - protein, 142 aa, Bacteroides fragilis
MMPVRRSQNWLPSIFNDFFDNELMAKANATAPAINVIETDKAYKLELAAPGMTKEDFSVRIDEENNLVISMEKKAENKEEKKDGRYLRREFSYSKFQQTMILPENVDKDHISAQVENGVLNIELPKLSEEEVKKPDRTIEVK

SEQ ID NO: 2929 - protein, 435 aa, Dendrobium crumenatum
MSKEFGIEAPLSKIAVSKAHGEDSPYFAGWKAYEENPYDAVDNPNGVIQMGLAENQLSFDLLEEYLEQHPEASSWGSGMSSFRENALFQDYHGLQTFRKAMASFMEKIRGGRSKFDPDRIVLTAGATAANELLTFILADPGDALLVPTPYYPGFLRDLQWRTGVTIFPVHCHSSNGFQLTLASLESAYADAKASNFNVKGLLITNPCNPLGTVASLSLLQDIILFISDKNIHLISDEIYFGCVFSSTNLFSISDLITNAVSYQIHIVYSLSKDLGLPGFRVGALFSYNDRVVKTARRMSSFSLVSSQTQKLLAFMLSDEEFTVNYIKKNRERLRERYELVVGGLKEAGIECLKGEAGLFCWVNMEELMEDKTEEGELRLWKVMVDELKLNISPGSSCCCSEPGWFRVCFANTSRETLEVALRRLKDFARKKTKNI

SEQ ID NO: 2930 - protein, 380 aa, Yarrowia lipolytica
MLPPPRARCRHKSFRHPHPSHRHRHTPTHSRITRPTRTATMEDSDVLMRDINDDGLKPMDAMGAGGEGTFTELTPTTRGQLDAWIARLTECQPLSEDDVNELCNMAKGVLQKEENVQPVHAPVTICGDVHGQFHDLMELFKIGGPCPDTNYLFMGDYVDRGYYSVETVSYLVAMKVRYPNRLTILRGNHESRQITQVYGFYDECLRKYGNANVWRAFTSLFDYFPVTALVENQIFCLHGGLSPMIESIDNIRELNRFQEVPHDGPMCDLLWSDPDDRGGWGMSPRGAGFTFGADISEQFNHTNNLSLISRAHQLVMEGFSWAHEQQVVTIFSAPNYCYRCGNQAAIMEVDENLSNSFLQYDPCPRPGEPSVSRRTPDYFL

SEQ ID NO: 2931 - protein, 492 aa, Cicer arietinum
LHQVIKANDDLSREHHQFFLYQMLRALKYMHSANVYHRDLKPKNILANSNCKLKVCDFGLARVAFNDAPTSIFWTDYVATRWYRAPELCGSFSSKYTPAIDIWSIGCIFAEVLLGKPLFPGKSVVHQLDLITDLLGTPLPETITGVRNDNARKYLAGMRKKLPVPFEQKFPNADPLALRLLQRLLAFDSKNRPTAEEALADPYFKGLAKVEREPSCKPISKLEFEFERRRITKDDVRELIYREILEYHPQLFKDYMNGTEGANFLYPSAIDQLRKQFAYLEENDGKSGSVLPPERKHVSLPRSTVYSGSILPSNQRTPALYEKKKMVEETSKSWGAAGENSRNQLRGVQPPPRVPAKPGRVVGPVLHYEDERITKSSNDPRIVIQNTTQAVSSRDAFQTHPPNTKTTSGIHKEQGKNEFPSLQSNLHATATTDLNNNPYRRRVINNNLNDPVTTIDAKMLQAQSHLGVVGAAAVAVATHSHRYSRGIQYGLF

SEQ ID NO: 2932 - protein, 384 aa, Legionella pneumophila
MMFGFLNMTLWGYLLAGFVLTHITTTAVTIYLHRYQTHRALTLHPLVSHFFRFWLWLTTGMTTAEWVAIHRKHHANTDMEGDPHSPQVFTLKKVFWQVPELYREASKDKDMIKKYSSGTPNDWIERKLYSPHANKGIFLMLTLNLFLFGIPGLTLWAIQMMWIPLVAGVVNGIGHYWGYRNHESSDSSTNVFPWGLLIAGEELHNNHHTFASSAKFSIKWWEFDLGWFYIRCLSFLKLAKVKKLPPKLIIDKNKSHIDVDSVKAILGNRFQVISDYYKLVIFPTLRDMQYRIKNRDLKNARHLFKKPNEQLSHADQLRLKTLLKQHDNLQAVHNYRELLQQIWLKTSLSNKDLLNLIQKWCSQAEESGLHVLRQFASQLKSYSL

SEQ ID NO: 2933 - protein, 616 aa, Candida albicans
ARASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYSSVQKLMIWSAGVILGMSCCVVDYHSMTSSIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHRLVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRLRSYPLDVMGEIYRALKNLGAEWAKPTEEELWTIRVRWKYDTSAQFECGSAPNLMKMQIQLFQLEPNNYLVSFKFSGWESAHGNAGTDSPQSHRQQDLDEVGSFSAYPFLHLATRLIMELAVNSQSG

SEQ ID NO: 2934 - protein, 244 aa, Zea mays
  misc_feature (72)..(72): Xaa can be any naturally occurring amino acid
  misc_feature (186)..(186): Xaa can be any naturally occurring amino acid
  misc_feature (208)..(208): Xaa can be any naturally occurring amino acid
  misc_feature (211)..(211): Xaa can be any naturally occurring amino acid
MGRGRVELKRIENKINRQVTFAKRRNGLLKKAYELSVLCDAEVALIVFSNRGKLYEFCSGPSITRTLERYEXNSYAGPDTAVQNKENELVQNSRNEYLKLKAKVDNLQRTQRNLLGEDLGSLGVKELDQLEKQIDSSLSHIRSTRTQHMLDQLADLQRREQMMCEANKCLRRKLEETSNQVHGQVXEHGANLLLGYERHSSPQQAPAXLEXGLFFHPLEAAAEPTLQIGFAPEHMNNFMPAWLP

SEQ ID NO: 2935 - protein, 235 aa, Capsicum annuum
MACTTVTCSSTSPLVSNVGVGGTCKVTAPCSVFFPSMRRPASTLVARATGDTKTHQWTCTCQNGQGGNTKALLFEHVLGGLALDVSPFGLLDPMSPMRTMRQMMDTMDRLFEDTMTFPGRNRASGSGEIRAPWDIHDGENEIKMRFDMPGLSKEDVKVSIENDVLVIKGEHKKEEGGNDEHSWGRNISSYDTRLSLPDNIEKDKIKAELKDGVLFISIPKTKVEKKVIDRACQLN

SEQ ID NO: 2936 - protein, 568 aa, Gibberella zeae
MSLAQHSESASPVPIIETDDQGNPIKSSNGYFPSKGKSSTLVDNMAHLSVVGGAHRGDDSDAASVRSTSSRASRRPEMKLASYQDEYTTSVYGSRFAGMDLPRHHMPENEMPRDIAYRMIKDDLSLDNNPMLNLASFVTTYMEDEAEKLMAESFSKNFIDYEEYPQSADIQNRCVNMIGDLFHAPPGSSVGTSTVGSSEAIMLGVLAMKRRWKNRRIAEGKSTEHPNIVMSSAVQVCWEKATRYFEIDEKLVYCTPDRFVMDPEQAVDLCDENTIGMCAILGTTYTGEYEDIKAINDLLVERNLDVPIHVDAASGGFVAPFVVPDLEWDFRCEKVVSINVSGHKYGLVYPGVGWVIWRSPEFLPQELVFNINYLGADQSSFTLNFSKGASQVIGQYYQLIRLGKHGYRAIMSNLTRTADYLTETLENMGFVIMSERSGAGLPLVAFRFKTVDEGGDPERHYDEFALAHHLRSRGWVVPAYTMAPNSGVKMLRVVVREDFTKSRCDQLICDVKLCHGLLKETDQESIKKREEYIKNHIVTMGRGKHSHPVYKDEQHSLQGKHGKTHAIC

SEQ ID NO: 2937 - protein, 278 aa, Leptospira interrogans
MNNKENPLKQTIMLNNGISMPILGLGVWKTKSGKECKEAVLNALEAGYRHIDTARIYDNEVDVGQAIRESGIPRKEIFITTKLWNADQGSDKTRKALENSLDRLGIDFVDLYLIHFPVTSKRMDSWKELEKLYHDKLCKAIGVSNYTIIHLTELLKNSQITPAVNQVEFHPFLNQIHLLEYCKKHKIQLEAYSPLAHGQKIEDPTIAKIAQKYDKTPAQILIRWAIEQKIVVIPKSIKKERIIENSKVFDFAISEEDMKILNSLDEDFRTCWDPSEVV

SEQ ID NO: 2938 - protein, 368 aa, Pseudomonas putida
MSLLLEPYTLRQLTLPNRIAVSPMCQYSAIDGLANDWHLVHLGCRAVGGAGLVISEAVAVTADGRITAEDLGLWNDDQIVPLQRITRFITAQGAVPGIQLAHAGRKASTYRPWLGKQGSVKLEDGGWQPVGPSKIAFDPQHTPPRELSKDEIQDVIDAFVASTERALKAGFKVVEIHAAHGYLLHQFLSPLSNQRRDEYGSCFENRIRLTLQVVEAVRKVWPAELPLFVRVSATDWVEDGWNPDETVELARRLRVLGVDLIDVSSGGTSVNAEIPTGPGYQTRFAERVRKEAEIATGTVGMITEPAQAEHILRTGQADVIFLARELLRDPYWPLHADDDLGGNKATWPAQYQRATSRANPIHESDLRD

SEQ ID NO: 2939 - protein, 481 aa, Bacillus subtilis
MSSNKLTTSWGAPVGDNQNSMTAGDRGPALIQDVHLLEKLAHFNRERVPERVVHAKGAGAHGYFEVTNDVTKYTKAAFLSEVGKRTPLFIRFSTVAGELGSSDTVRDPRGFAVKFYTEEGNYDIVGNNTPVFFIRDAIKFPDFIHTQKRDPRTHLKNPTAVWDFWSLSPESLHQVTILMSDRGIPATLRHMHGFGSHTFKWTNDKGEGVWIKYHFKTEQGVKNLDVNTAAKIAGENPDYHTEDLFNAIENGDFPAWKLYVQIMPLEDANTYRFDPFDVTKVWSQKDYPLIEVGRMVLNRNPENYFAEVEQATFSPGTLVPGVDVSPDKMLQGRLFAYHDAHRYRVGANHQALPINRSRNEVKNYQRDGQMRFDDNGGRSVYYEPNSFGGPKESPEDKQAAYPVSGFADSVSYNHHDHYTQAGDLYRLMSEEERARLVANIVSAMKPVEKEEIKLRQIGHFYKADPEYGRRVAEGLGLPSPK

SEQ ID NO: 2940 - protein, 250 aa, Oryza sativa
MRVAATTRPASSSAAAPLPLFLLLAVAAAAAALFLVGSASLAMAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKGGHEPGWRDVPVHDPVVKDAADHAVKSIQQRSNSLFPYELLEIVRAKAEVVEDFAKFDILMKLKRGNKEEKFKAEVHKNLEGAFVLNQMQQEHDESSSQ

SEQ ID NO: 2941 - protein, 608 aa, Oryza sativa
  misc_feature (298)..(298): Xaa can be any naturally occurring amino acid
MAGSERTVVWFRRDLRIDDNPALASAARDGAVLPVFIWCPADEGQFYPGRCSRWWLKQSLPHLSQSLESLGCPLVLIRAESTLEALLRCIDSVGATRLVYNHLYDPVSLVRDDKIKKELSALGISIQSFNGDLLYEPWEIYDDSGLAFTTFNMYWEKCMELPIDASPSLAPWKLVPVPGLESVRSCSVDDLGLESSKDEESSNALLMRAWSPGWRNAEKMLEEFVSHGLLEYSKHGMKVEGATTSLLSPYLHFGEVSVRKVYQLVRMQQIKWENEGTSEAEESIHFFMRSIGLREYSXDEERFKSWRQGMTGYPLVDAGMRELWATGWTHNRIRVIISSFAVKFLLIPWTWGMKYFWDVLLDADLESDILGWQYISGSLPDGHELSRLDNPEVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKASNRSSICVDMIRSSKMEATSSVANSPVSRKRSFCETAFHVPSYSSSAEVHSHIQDHGGSLVGPSRYLLQEAGRNYVDEPT

SEQ ID NO: 2942 - protein, 135 aa, Brassica napus
MDARMFGLETPRVAALHHLLDVPDGDKAGGGATRTYVRDARAMAATPADVKELAGAYAFVVDMPGLSTGDIRVQVEDERVLVISGERRREEREDAKYLRMERRMGKFMRKFVLPDDADVAKAPPLGGDRVLTVTV

SEQ ID NO: 2943 - protein, 372 aa, Triticum aestivum
MSKQGGIGSTVPLLTPYKMGAFDLSHRVVLAPLTRTRSYGNVPQPHAILYYQQRTTKGGLLIAEATGVSDTAQGYKDTPGIWTKEQVEAWKPIVDGVHAKGGIFFCQIWHVGRVSNHTYQPNGQAPISSTDKPLKPMVIDKHIVADFATPRPLETDEIPMVINDFRVAARNAIEAGFDGVEIHGAHGYLIDQFFKDQVNGRTDKYGGSLENRCRFGLEVVQAVVDEIGAGKVGMRLSPFANYWESSDSNPGALGLYMAHALNKIGILYCHTVEPRMITFVDKVETPNSLRAMRDAFKGTFIVAGGYGREDGNAAVSSGYADLVAYGRLFLSNPDLPQRFEIDAPLNKYNRDTFYISDPVVGYTDYPFHLSDV

SEQ ID NO: 2944 - protein, 465 aa, Symbiobacterium thermophilum
MVARLWRSFAASLLALFLTAALWTGPAYAASDPAHWGDASAELWMVYHVVQRYHVNGADLDAFLEGAVRGGLDALGDPYTEYLGPQDYQSFLDSVDGNLTGIGVYLEKVGDYITIVRPIRSSPAEAAGLRAGDRIVAADGVSLVGESIEKTQQLVRGEPGTKVVLTIERPDEGRRFDVTITRAFIHVPQVDYRMLEDGIGYLELSGFGQQAAEEFFAAVAELKEAGATRLVLDLRYNSGGWVASALEIAEAYVPAGEPIMFEITRDERRVYRSEGSPLGLPTAVLVSEYTASAAEILAGAVQDYGTGVLIGTQTFGKGTVQELVDLPGGGAVKVTTAEYLTGRQRRVHQVGLTPDLVVEPYQPPVHLQTPLVADRVMTTGHVGLDVLGLQERLALLGYRTDRDGYFKGQTTLAVLQFARDHGLNEVPMVDKAFVEALNAAVAAKLAAAEWPDTQLEAAIRYLKEK

SEQ ID NO: 2945 - protein, 543 aa, Gluconobacter oxydans
MAAKDVKFGADARERMLRGVDILANAVKVTLGPKGRNVVLDKSFGAPRITKDGVSVAKEIELADKFENMGAQMVREVASKTNDIAGDGTTTATVLAQAIIREGAKAVAAGMNPMDLKRGIDKAVGVVVDQLKSNTKKITSPEEIAQVGTISANGETEIGEMIASAMQKVGSEGVITVEEAKGLHTELDVVEGMQFDRGYISPYFVTNPEKMTADLDSPYILIHEKKLSSLQPMLPLLESVVQSGRPLVIIAEDVDGEALATLVVNKLRGGLKIAAVKAPGFGDRRKAMLEDIAILTGGQVISEDIGIKLESVTLEMLGRAKKIHIEKENTTIVEGAGNSDDIKGRCNQIRAQIEETTSDYDREKLQERLAKLAGGVAVIRVGGSTEVEVKERKDRVDDALHATRAAVEEGIVPGGGTALARASSALKGLTFDNDDQRVGGEIVRKALQAPLRQIAFNAGEDGAVIAGKVLENEGYVFGFDAQKGEYKDLVAAGIIDPTKVVRTALQDAASVGGLLITTEAMVAERPEKKAPAAAPGGMGDMDF

SEQ ID NO: 2946 - protein, 404 aa, Yersinia pseudotuberculosis
MSPIEKSSKLDNVCYDIRGPVLKEAKRLEEEGNKVLKLNIGNPAPFGFDAPDEILVDVIRNLPTAQGYCDSKGLFSARKAIMQHYQARDIRDLTVEDIYIGNGVSELIVQSMQALLNLGDEMLVPAPDYPLWTAAVSLSSGKAVHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 2947 - protein, 334 aa, Pisum sativum
MDGREAMAFSGGPGSYYLHRGGVEAAGSGSGGFQVPPGFRALPNNGIIAQPNVRAQGGNGDTSSMFSLEPQSHADFNHDISVGASSGAPSSEPVKKKRGRPRKYGPDGSVSLKLSPMSAPANSTQDSGTPSEKRGRGRPRGSGRKQQLAALGDWMTSSAGLAFSPHVITIAAGEDIAAKLLLLSQQRPRALCILSGTGIASKVTLRQPASTNAGVTYEGKFQILSLSGSYLVSEDGGPTNRTGGISVSLSSRDGHVIGGSVAMLIAGSPIQLVVCSFVYGGGSKVKTKQGMITNGESSEPHNDNLGSPASAPPDQNYISSPTGMWPGSQPSDMK

SEQ ID NO: 2948 - protein, 347 aa, Pisum sativum
MDGREAMAFSGGPGSYYLHRGGVEAAGSGSGGFQVPPGFRALPNNGIIAQPNVRAQGGNGDTSSMFSLEPQSHADFNHDISVGASSGAPSSEPVKKKRGRPRKYGPDGSVSLKLTPMSAPANSTQDSGTPSEKRGRGRPRGSGRKQQLAALGDWMTSSAGLAFSPHVITIAAGEDIAAKLLLLSQQRPRALCILSGTGIASKVTLRQPASTNAGVTYEGKFQILSLSGSYLVSEDGGPTNRTGGISVSLSSRDGHVIGGSVAMLIAGSPIQLVVCSFVYGGGSKVKTKQGMITNGESSEPHNDNLGSPASAPPDQNYISSPTGMWPGSQPSDMKSAPAHTGIDLTRG

SEQ ID NO: 2949 - protein, 479 aa, Oryza sativa
MLRAAARALTVSSLNPKVLALADHHLGGLVARRAQLVTVTVNILIVERKKILQADTSMQQELDANPASHPFSEVLALCNHPHLLDRSEASFMFSSDAITRAREIVGFIPGKTTGGYSHCQANSIVSEFRANADKYGNELSSNLTIFDRVHMMMHLLIRGKKDGILCPIPSHSLYTDSMVLRGATLVPYYLDESRGWSVNISDLKKQLDGARAKGIDVRGLVVVNPGNPTGQVLVEENQCEIVELCKNECLVLLADEVYQENIYTDQKKFNSFKKVARSIGYGEGDISLVSFHSVSNGYYGECGRRGGYMEVTGFSSEVRGEVYKVASLSACSNISGQILMSLVMNPPKVGDESYPSYRAERDSILSSLSCCAEAMVSTFNSMEGMTCNKAEGGISVFPSVRLPPRAIEAAEAMNTEPDVFYALRLLESTGIVVVPGSVFGQVPGTWHFRCTILPQEEKTRQIISRFNVFHEAFMEEFRS

SEQ ID NO: 2950 - protein, 740 aa, Thiobacillus denitrificans
MRKLVEATQAGSEASVALAPSAPIQRLQAGLHHDPFEVLGVHVQPDGSKLVRAFLPAAEAVEVAGVRMTRVPGTDCFERLLPPGTALEAHPLLTWQDKRSGAWQRLRSPYSFAPQLGEMDLYLFGEGRHFEIWKVLGARVKTVDGVTGCLFAVWAPAVLRVSVVGDFNDWDGRRHPMRCRGVSGVWELFIPGLEAGHAYKYEILGRHGERVTKTDPYARQMFLRPETTSRVPDERPYAWGDAEWLAARTRFDWQHRPMSVYEVHPGSWRRRADGSFYSWRELTAELIPYVRDLGYTHIELLPVAEHPFDASWGYQVSGYYAATARFGSPDDLRAFVDACHQAGLGVLLDWVPGHFPKDDFALARFTGEPLYEHADPRRGEHQDWGTLVFDFGRNEVRNFLVANALYWLEEFHIDGLRVDAVASMLYLDYSRRHGEWLPNQHGGRENLEAIHFLHEVNAEVHARFPGAITIAEESTAWPAVSRPIELGGLGFSMKWNMGWMNDTLDYIEKEPVYRKYQHNQLTFSQMYAWSENFVLPLSHDEVVHLKKSLLDKMPGDRWQRFANLRLLYAWQYAHPGKKLLFMGGEFGQWNEWREAGQLDWVLLGFPEHDGIRALLRDLNRLYRDEAALHFWDFDPRGFRWIDCHDADQSVLSLVREGPDGAPPIVVLLNFTPVPRHGYRIGVPRAGAWCEVLNSDSMYYGGSNLGNGKPLYPAAVPWMGFGQSIEVTLPPLGAIFLKPCP

SEQ ID NO: 2951 - protein, 558 aa, Bacteroides fragilis
MCGIAGIFNIKIQSRELRNKALRMARKIRHRGPDWSGMYCGGSAILAHERLSIVDPQSGGQPLYSSDRKQVLAVNGEIYNHRDIRAQYAGRYEFRTGSDCEVILALYRDKGIHFLEELNGIFAFALYDEEKDEYLIARDPIGVIPLYIGKDAEGHVYFGSELKALEGFCDEYEPFLPGHYYHSKEGTMKRWYTRDWMEYKEENDKQADSRSPTRQIQDALENAVHRQLMSDVPYGVLLSGGLDSSVISAIAKKYAAKRIETDGASDAWWPQLHSFAIGLKGAPDLIKAREVAEYIGTVHHEINYTLQEGLDAIRDVIYFIETYDVTTVRASTPMYLLARVIKSMGIKMVLSGEGADEIFGGYLYFHKAPDARAFHEETVRKLSKLHLYDCLRANKSLAAWGVEGRVPFLDKEFLDVAMQLDPEIKMAPGKVIEKKVLREAFADMLPSGIAWRQKEQFSDGVGYSWIDTLKEITATAVSDEQMAHAAERFPIHTPMNKEEYYYRSIFEEHFPSESAARSVPSIPSVACSTAEALAWDTAFKNLNDPSGRAVKGVHEEAY

SEQ ID NO: 2952 - protein, 746 aa, Unknown
  Bradyrhizobium sp. BTAi1
MMGASFRIRLRLRRFTRRHHTLFTILRSAMIFMAGFGGAYGFIKASLSETSGYNPHAFAIGASFLFALACVGLATLSMRLRFMRKKMHKLALHNEVLADRNWELQEAEQRARSLFEQQGDLIVMRESDGTIIFVNDAYCRMAGLDRENLLGSQFSFDLLEQGDSALEPSGTRVHDQRIDSAIGPRWIAWREALVRSDAGHPAVQQCVGRDVTDRTETERALAEARDQANAANRAKSRFLAMASHEIRTPLNGILGMSGLLLETQLTPEQTTYAKAVRSSGEALMSLINELLDYSKIEAGKLALEAQPFALTALIEEITELLAPRAQGKQLEIAAYLDERLPTWVTGDAARLRQVLLNLAGNAIKFTSKGGVALIAEPGIWPNEISFQVRDTGIGIAADAQERIFREFEQADDSVARSFGGTGLGLAISDRIVKRMGGRIALQSQPGAGSTFEVSVPLPPALERGEQNSFRGPDLTGQSIMLIAPAGLQAELIERRLQNWGAQTCLVAETEIAAALLPERAWHAVLIDDAIGSEAARRLGEAAHHHTTRLIVLVTPTSRHELAPAAPFNGYLVKPLRAASLAARVSFDLDAGAAFAEHPIPTIAPSIAARAGTGLAILVAEDNDINALLMRSLLTKLGHHADIAVHGEAALDSWLAARAAGTPYDLILMDVQMPRLDGIAATRRIRAHEASEPGRRTPILALTANALVEDRYACFEAGMDGFLVKPIDRDKLDEALANLAAARQVAA

SEQ ID NO: 2953 - protein, 526 aa, Arabidopsis thaliana
MNDHIHRVPALTEEEIDSVAIKTFERYALPSSSSVKRKGKGVTILWFRNDLRVLDNDALYKAWSSSDTILPVYCLDPRLFHTTHFFNFPKTGALRGGFLMECLVDLRKNLMKRGLNLLIRSGKPEEILPSLAKDFGARTVFAHKETCSEEVDVERLVNQGLKRVGNSTKLELIWGSTMYHKDDLPFDVFDLPDVYTQFRKSVEAKCSIRSSTRIPLSLGPTPSVDDWGDVPTLEKLGVEPQEVTRGMRFVGGESAGVGRVFEYFWKKDLLKVYKETRNGMLGPDYSTKFSPWLAFGCISPRFIYEEVQRYEKERVANNSTYWVLFELIWRDYFRFLSIKCGNSLFHLGGPRNVQGKWSQDQKLFESWRDAKTGYPLIDANMKELSTTGFMSNRGRQIVCSFLVRDMGLDWRMGAEWFETCLLDYDPCSNYGNWTYGAGVGNDPREDRYFSIPKQAQNYDPEGEYVAFWLQQLRRLPKEKRHWPGRLMYMDTVVPLKHGNGPMAGGSKSGGGFRGSHSGRRSRHNGP

SEQ ID NO: 2954 - protein, 368 aa, Streptococcus pyogenes
MHYLHRRKGSVMVSVMWFRRDLRIDVQKALAHAIASQSPTLCVFQFNKEQLNLLHSRNQSSFITSVLAFRKLLKCEGIDLYLMYGDLMTCFEQLLTQLKDWTDVYFNYDESGYGRLRDQKAAQFFKKNGIAVHTYQDHYLHGSQEIINQSGQPYKVFTPYYRIWQNYPKETPIKVELSQGRWLNLETPDDVLRTVESIKDEKYQDVATFDEASKQLNRFIQDQLAAYHANRDFPAQLGTSRLSPFLRIGAIGIRTVYHAVRQAPNSLGQATFLKELAWRDFYNMVYVAYPDQKTQPIQKAFSQIEWVNNPDWFQLWKEGKTGYPIVDAAMLQLQKTGWMHNRLRMIVASFLTKDLLCDWRLGEQYFQQ

SEQ ID NO: 2955 - protein, 276 aa, Streptomyces coelicolor
MISIPAYTLNDGTSLPALGLGTWPMKDEEAERAVRAALETGYRLIDTATNYRNETGVGRGVASAGLPREEIVVTTKLPGRHHGYEETLASFEESRARLGLEYVDLYLIHWPLPRVDKYVDSWKAMVKLREDGLVRSVGVSNFTAEHIERLERETGVLPSVNQIELHPLLPQDELRAYHERKGIRTESWSPLGRGSDLLDDPAVAAVAAAHGVTPAQAVLRWHTQLGAVPIPKSADPARQRANLDVFGFELDAEQLRAVADRVHRRIGGDPEVHEEF

SEQ ID NO: 2956 - protein, 353 aa, Unknown
  Burkholderia sp. 383
MPTLFDPVTLGDLTLPNRIVMAPLTRSRAGATRVPNALMARYYAERATAGLIITEATSVTPQGVGYADTPGIWSDEQVEGWKQVTQAVHAAGGRIVLQLWHVGRISDPVFLNGDLPVAPSAIAAGGHVSLVRPQRPYVTPRALELDEIPGIVAAYRKGAENAKAAGFDGVEIHGANGYLLDQFLQDSTNRRTDAYGGPVENRARLLLEVVDAAIDVWGAGRVGVHLAPRGDAHTMGDSDPAATFGYVARELGRRKIAFIFTRESYSGDHLSPRLKEAFGGPLIANEQFTLDTAQATLASGNADAIAWGKLFIANPDLPRRLELGAALNKPVPETFYAEGETGYTDYPALSDAA

SEQ ID NO: 2957 - protein, 324 aa, Magnaporthe grisea
MASPTMKLNNGLDMPQVGFGLWKVENSVCADVVYNAIKAGYRLFDGACDYGNEVECGQGVKRAIDEGLVKREELFIVSKLWNTFHDGERVEPIVKKQLADWGIEYFDLYLIHFPVALEYVDPSVRYPPGWHYDDAGTEIRPSKASIQETWTAMEKLVDAGLSKAIGVSNFQAQLLYDMLRYARIRPATLQIEHHPYLVQQRLIEACKTEGIVVTAYSSFGPASFKEFNMEHAEALTPLLEEPTIVKLAEKYGKDPGQVLLRWATQRGLAVIPKSSREKTMKSNFEAVGWDMEDSDIKTISALDKGIRFNQPANYFSTDKLWIFG

SEQ ID NO: 2958 - protein, 508 aa, Vibrio vulnificus
MHMSKSFLLISMGLASISVHAQTLTRDNGAPVGDNQNSITAGENGSVLLQDVHLIQKLQRFARERIPERVVHARGTGAHGEFVASGDFSDLTLSSPFAQSGKVTPVFVRFSTVIHSKGSPETLRDPRGFATKFYTDQGNWDLVGNNLPVFFIRDSIKFPDMVHSLKPSPVTNLQDPNRFFDFFSSQPSATNMLTWVYTNLGTPASYRTMDGFGVHAYKWINQKGEVNYVKFHWKSQQGVKSLRPAEVTKVQGEDFNHLTNDLYTQINAGNFPKWDLYVKVLSPKALSKLDYNGLDATKVWLDVPEKKVGTMTLNRVPDNFFLETEQSAFAPSNIIPGIEPSEDRLLQGRLFAYADTQLYRLGANLFQLPVNSPKSPVANHNQDGPSNNSTGLGNVDSLDVNYEPSRLVNLTVDKQARAVETPLSGHVQQQAIRNPRDFFQAGVLYRSLSEQDKADLIHNLSGDLNKVNDAEVKAIMVSYFYRADKEYGTRLAKATDVNLKQVTKLASM

SEQ ID NO: 2959 - protein, 335 aa, Arabidopsis thaliana
MKFGETFTEYLHGEEEWFLEKCRFVEYKKLKKVLKKCKTCNSTKSDDGQIIPSATSSSLSDSCECKACPWCDQMFFEELMKEATDIAGFFRSRVRHLLHLHVATGMQRYMIRLRRCFTDEKQALVQEGQILIQYITMNAIAIRKILKKYDKVHSSENGKNFKLKMRAERIELLHSPWLIELGAFYLNSGLDNVGNFKNSFGRVACENLNEDQPVLKLMLPNSIELEYDLTCAICLETVFNPYALKCGHIFCNSCACSAASVLIFQGIKAAPRHSKCPICREAGVYAEAVHMIELHLLLKTRSKEYWKERMMNERSEMVKQSKMFWNEQTKHMIGY

SEQ ID NO: 2960 - protein, 540 aa, Rauvolfia serpentina
MATQSSAVIDSNDATRISRSDFPADFIMGTGSSAYQIEGGARDGGRGPSIWDTFTHRRPDMIRGGTNGDVAVDSYHLYKEDVNILKNLGLDAYRFSISWSRVLPGGRLSGGVNKEGINYYNNLIDGLLANGIKPFVTLFHWDVPQALEDEYGGFLSPRIVDDFCEYAELCFWEFGDRVKHWMTLNEPWTFSVHGYATGLYAPGRGRTSPEHVNHPTVQHRCSTVAPQCICSTGNPGTEPYWVTHHLLLAHAAAVELYKNKFQRGQEGQIGISHATQWMEPWDENSASDVEAAARALDFMLGWFMEPITSGDYPKSMKKFVGSRLPKFSPEQSKMLKGSYDFVGLNYYTASYVTNASTNSSGSNNFSYNTDIHVTYETDRNGVPIGPQSGSDWLLIYPEGIRKILVYTKKTYNVPLIYVTENGVDDVKNTNLTLSEARKDSMRLKYLQDHIFNVRQAMNDGVNVKGYFAWSLLDNFEWGEGYGVRFGIIHIDYNDNFARYPKDSAVWLMNSFHKNISKLPAVKRSIREDDEEQVSSKRLRK

SEQ ID NO: 2961 - protein, 678 aa, Pseudomonas fluorescens
MNNDPLLQPYRLKHLTLRNRIITTSHEPAYPEEGMPKKLYRAYHVERAKAGVAMTMTAGSAAISRDSPPVFNNILAYKDEVVGWMKDLTDECHEHGAAVMIQLTHLGRRTRWDKGDWLPVVSPSHNQEPAHRAFPKKLEIWDIERIIRDYADAAERMQAAGLDGIELQAYGHLMDQFWSPLTNELEGAYGGSLHNRLRFTFEVLSAIRQRVGPEFIVGIRYTGDEVLAGGLEKEEGLHISQLLKDSGMVDFLNVIRGNIATDAGLTDIIPIQGMRNAPHLDFAGEIRALTGFPTFHAAKIPDVATARHAIASGLVDMVGMTRAHMTDPHIVRKIIENREDEIRPCVGANYCLDRIYNAGAAYCIHNAATGRETSMPHEVPKAAHPRKVLIIGAGPGGLEAARVAGERGHEVLVLEVADQPGGQVRLTAQSERRKEMISIIDWRMAQCERLGVKFRFNTWADAAMVLDENPDVVIVATGGLPHTEVLHSGNQWLVSSWDIISGDVKPGRNVLVYDDAGDHAGLQAAEFIARSGARTEIMTPDRSFAPEVMGMNLVPYMRSLQQLDTTFTVTYRLKAVERQGEQLLATIGTDYSDLEKTRLVDQIVVNHGTRPLDELYFELQPMATNEGAVEYKDLIAGTAQNLVTNPQGRFQLFRIGDAVSSRNTHAAIYDALRLVKDL

SEQ ID NO: 2962 - protein, 355 aa, Ustilago maydis
MPQYPSAAPGQKTFKLNTGAEIPVIGLGTWQSAPGEVAKAVESAIKAGYRHIVSMLTSLLTLTLGYVALHPLYIPFLAKDAAWIYGNENEVGQGIKASGVPRSELFVTTKIWCTYHRQPEACLDESLQRLGLDYVDLLLVHWPVPLVKRGDEKIPLNEDGSRAIDRDWSPEQTWELMEKLPATGKTKAIGVSNWSIAFLDKLLAKAKIVPAANQVELHPFLPQHELVKYCHDKGILPQAYSPLGSSGGPVLQDERVQSIAKAHKADPAQVVISWAAQRGVVALPKSVTPSRIETNGKLIVLSDEEMLELNELHKQEGKAVRLVKPNSDICSPPSETCLAPLNVADEALSYLRNSD

SEQ ID NO: 2963 - protein, 207 aa, Brassica oleracea
MAMLGGVRDLPANENSVEVESLARFAVDEHNKKENALLEFARVVKAKEQVVAGTMHHLTLEIIEAGKKKLYEAKVWVKPWLNFKELQEFKPASDDGAPSTTITPSDLGCKKVSDENASGWREVPGDDPEVQHVADHAVKTIQQRSNSLFPYELQEVVHANAEVTGEAAKYNMVLKLKRGEKEEKFKVEVHKNHEGVLHLNHMEQHHD

SEQ ID NO: 2964 - protein, 222 aa, Brassica napus
MGQGSFIYSFVARGTMVLAEYTEFTGNFPSIAAQCLQKLPSSSNSKFTYNCDHHTFNFLVEDGFAYCVVAKDALSKQISIAFLERVKADFKKRYGGGKASTAIPKSLNKEFGPVMKEHMKYIVDHAEEIEKLIKVKAQVSEVKSIMLENIDKAIDRGENLTVLTDKTENLRSQAQEYKKQGTQVRRKLWYQNMKIKLVVLGILLLLVLIIWLSVCHGFNCTD

SEQ ID NO: 2965 - protein, 241 aa, Oryza sativa
MGRGKIVIRRIDNSTSRQVTFSKRRNGLLKKAKELSILCDAEVGLVVFSSTGRLYEFSSTNMKTVIDRYTNAKEELLGGNATSEIKIWQREAASLRQQLHNLQESHKQLMGEELSGLGVRDLQGLENRLEISLRNIRMRKDNLLKSEIEELHVKGSLIHQENIELSRSLNVMSQQKLELYNKLQACEQRGATDANESSSTPYSFRIIQNANMPPSLELSQSQQREGECSKTAAPELGLHLP

SEQ ID NO: 2966 - protein, 546 aa, Corynebacterium diphtheriae
MAKIIAFDEEARRGLEKGLNTLADAVKVTLGPKGRNVVLEKSWGAPTITNDGVSIAREIELEDPYEKIGAELVKEVAKKTDDVAGDGTTTATVLAQALVREGLRNVAAGSNPMGIKRGIELATAKVTEALLASAKEVETEEQIAATAGISAADPAIGEQIAKAMYAVGGGKLNKESVITVEESNTFGVDLEVTEGMRFDKGYISGYFATDMERLEAVLEDPYILLVSGKISNIKELLPLLEKVMQTGKPLLIIAEDVEGEALSTLVVNKIRGTFKSVAVKAPGFGDRRKAQLQDMAILTGSQVISEEVGLSLETADLPLLGRARKVVVTKDDTTIVEGAGDSAQIDGRVNQIRTEIENSDSEYDREKLQERLAKLSGGVAVIKVGAATEVELTERKHRIEDAVRNAKAAVEEGIVAGGGVALLQAAHVLANDLDLTGDEATGVKIVREALSAPLKQIALNAGLEAGVVADKVSHLPAGEGLNAATGEYVDLMAAGINDPVKVTRSALQNAASIAALFLTTEAVVADKPEPAAPAMPGADEMGGMGF

SEQ ID NO: 2967 - protein, 410 aa, Campylobacter jejuni
MAKEIIFSDEARNKLYEGVKKLNDAVKVTMGPRGRNVLIQKSFGAPSITKDGVSVAKEVELKDSLENMGASLVREVASKTADQAGDGTTTATVLAHAIFKEGLRNITAGANPIEVKRGMDKACEAIVAELKKLSREVKDKKEIAQVATISANSDEKIGNLIADAMEKVGKDGVITVEEAKSINDELNVVEGMQFDRGYLSPYFITNAEKMTVELSSPYILLFDKKITNLKDLLPVLEQIQKTGKPLLIIAEDIEGEALATLVVNKLRGVLNISAVKAPGFGDRRKAMLEDIAILTGGEVISEELGRTLESATIQDLGQASSVIIDKDNTTIVNGAGEKANIDARVNQIKAQIAETTSDYDREKLQERLAKLSGGVAVIKVGAATETEMKEKKDRVDDALSATKAAVEEGI

SEQ ID NO: 2968 - protein, 155 aa, Triticum aestivum
  misc_feature (132)..(132): Xaa can be any naturally occurring amino acid
  misc_feature (137)..(137): Xaa can be any naturally occurring amino acid
  misc_feature (144)..(144): Xaa can be any naturally occurring amino acid
MSLIRRSNVFDPFSLDLWDPFDGFPFGSDGSGSLVPRTSSDTVAFAGARIDWKETPVAHVFKADVPGLKKEEVKVEVEDGNILQISGERNKEQEEKTDTWHRVERSSGKFLRRFRLPENAKAEQVKASMENXVLTVXVPKEEAXKPEVKSIQISS

SEQ ID NO: 2969 - protein, 647 aa, Xanthomonas campestris
MCGLAGLLLATPRMHGEQLEALVRPMGGALRHRGPDDAGTWCDAQAGVALAHQRLSILDLSPLGHQPMRSADSRYVLAYNGEIYNFAQLRAALAALGHRFRGHSDTEVLLAAVVEWGLDDTLARCNGMFALALWDERDHCLSLARDRVGKKPLYYGWAGDTLVFGSELKALWQHPDFDNGVDRDALTLLLRLGYIPAPACIHERTFKLMPGRVLRLDAQAVAAGAAAHRPDQAQQPFWNAREAMQRALAAPFTGTDAQAEEQLDSLLRDAVALRMVADVPVGVFLSGGTDSSIVTAMMQAQSDQPVHTFSIGFEGSHHDEAPLAREVATHLHTDHTELYVSGADALAVVPTLPDMFDEPFADASQVPTALVARLARGGVTVALSGDGGDELFFGYGRYQRALRNWRMHGLVPAPLRRLMAVAARKSGEASRTGGLAALVAEAGARGIGDIYRNRISRWRDPAAVVLGATEPDSFYSLADPLHGSGTPADAMMLADFAAYLPDDLLCKVDRTTMAVGLEARAPLLDWRVAEFAWSLPLSLKYRDGVSKYLLKRVLCRYLPEPMVYRGKRGFGAPVSAWLRGDLHGWADDLLAHGTLQREGVFAADTVAGLWRDFNGGERKWHTHLWTVLMFQAWQDHWRAQRAAIVRS

SEQ ID NO: 2970 - protein, 480 aa, Pisum sativum
MKLLSTKATCNSHGQDSSYFLGWQEYEKNPYDHVQNPKGIIQMGLAENQLSFDLLESWLAKNQDVGGFKRDGKSIFRELALFQDYHGLPSFKKALVDFMAEIRGNKVTFDPNHIVLTAGATSANETLMFCLAEKGEAFLLPTPYYPGFDRDLKWRTGVEIVPIQCTSSNNFQMTESALQQAHEDAKKKNLKVKGVLVTNPSNPLGTTMSKNELNLLIDFIKDKNMHLISDEIYSGTVFTSPNFVSVMEILNERTDKDFLDANVSERVHIVYSLSKDLGLPGFRVGAIYSDNETVVAAATKMSSFGLVSSQTQYLLSAMLGDKKFTRNYLSENQKRLKKRQKMLVNGLQKAGISCLKTNNAGLFCWVDMRNLLTSDTFEAEMDLWKKILYEVGLNISPGSSCHCTEPGWFRVCFANMSEDTLNLAMKRLKDFVSNSNGEEGSNSDNKRTRSSQSSRSFTRKSISNWVFRLSSRDHHEQEER

SEQ ID NO: 2971 - protein, 405 aa, Enterococcus faecalis
MRNFKKSDKLNNVSYDVRGPVLEEAERMQEEGIRILKLNTGNPAPFGFDAPNEIVRDMIVNVRDSEGYSDSKGIFSARKAIEQYCQLKKFPNVTINDIYTGNGVSELITMCMQGLLNNGDEVLVPMPDYPLWTASVSLAGGTPVHYICDEQAEWYPDIDDIKSKITSNTKAIVIINPNNPTGALYPKELLLEIVEVARQNDLIIYSDEIYDRLVMDGLVHVPIATLAPDLFVVTLNGLSKSHRVAGFRCGWMVLSGDKSRVKGYIEGLNMLASMRLCSNVLSQQIIQTALGGYQSVDGLLLPGGRIYEQREFIYNAINDIPGLSAVKPKAAFYIFPKIDTAKFDIYDDEKFVLDFLHKHHILLVHGGGFNWQQPDHFRIVYLPKMEDLKTTADKMREFLSTYKQK

SEQ ID NO: 2972 - protein, 197 aa, Triticum aestivum
  misc_feature (37)..(37): Xaa can be any naturally occurring amino acid
  misc_feature (48)..(48): Xaa can be any naturally occurring amino acid
LVVNRETPHRMASNVLRIASGAAMVEAIAAFSTRRAXGMSVLSGKGRXVPTVTVRQPAGAGAPPVAIRGRFEIVSLSGAFLPAPAPPGSTGLAVYLAGGQGQLLGGSVMGELLASGPVMVIAATFGNATYERLPLDQDAEEGAVLSGSEGAATQLEQQGSPRPPPPPPMYAVPQTPPSDVFGQWGQAAVARPPPTSF

SEQ ID NO: 2973 - protein, 191 aa, Xanthomonas oryzae
MKSARPRLSDAHGRRNCARRGRRPGHQPFWRLAMNIVRYPQFSTHALQNEIKHVFDRFFEHNSDTDESAVVTAQWVPRVDIKEEPKHFVLYADLPGIDPSQIEVQMDKGILSIKGERKSESSTETERFSRIERRYGSFHRRFALPDSADADGITASGHNGVLEIRIPKRPAATPRRIHVGNGQDTSDSTVQ

SEQ ID NO: 2974 - protein, 400 aa, Saccharomyces cerevisiae
MPFVKGFEPISLRDTNLFEPIKIGNTQLAHRAVMPPLTRMRATHPGNIPNKEWAAVYYGQRAQRPGTMIITEGTFISPQAGGYDNAPGIWSDEQVAEWKNIFLAIHDCQSFAWVQLWSLGWASFPDVLARDGLRYDCASDRVYMNATLQEKAKDANNLEHSLTKDDIKQYIKDYIHAAKNSIAAGADGVEIHSANGYLLNQFLDPHSNKRTDEYGGTIENRARFTLEVVDALIETIGPERVGLRLSPYGTFNSMSGGAEPGIIAQYSYVLGELEKRAKAGKRLAFVHLVEPRVTDPSLVEGEGEYSEGTNDFAYSIWKGPIIRAGNYALHPEVVREQVKDPRTLIGYGRFFISNPDLVYRLEEGLPLNKYDRSTFYTMSAEGYTDYPTYEEAVDLGWNKN

SEQ ID NO: 2975 - protein, 276 aa, Chlamydomonas eugametos
MTSHAANPKEEQDQRLPFKSDISGPIAPSQAPAHTVQAHDSQPKPSDDSSDEHLSFYEAKARIVRAFAASRAPQPAAPAAKALEGDASVIVPGKLILSSCEVEESSELLTKLGVTHILQVGEELKPSHPGRFTYLSLPILDMEGQDIVALLPSCFQFLQQAQASGGVCLVHCLAGISRSASVVIAYLMWTQGMPYTEARAMVRRARSKVYPNTGFTLQLQELDRLRESGAIQWGDTPSLASSLEQHRQPWNLIRYLEVKEKQAQEEGWTWGRTLVI

SEQ ID NO: 2976 - protein, 487 aa, Pisum sativum
MGVMNLDQPQLLSKIAMGDGHGEASSYFDGWKAYDKDPFHPSKNPHGVIQMGLAENQLTADMVQNWIMSNPEASICTLEGVHNFKQMANFQDYHGLPEFRNAVAKFMSRTRGNRVTFDPERIVMSGGATGAHEATAFCLADRGEALLVPTPYYPGFDRDLRWRTGVKLVPVICESSNNFKLTKQALEEAYEKAKEDNIRFKGLLITNPSNPLGTVMDRNTLRTVITFINEKRIHLISDEIYAATVFSHPSFISIAEIIEHDTDIECDRNLVHIVYSLSKDMGFPGFRVGIIYSYNDTVVDCTRKMSSFGLVSTQTQYLIAKMLSDDDFVEKFLPESAKRLAQRYRVFTGGLIKVGIKCLQSNGGLFVWMDLRGLLKNATFESEIELWRVIIHEVKINVSPGVSFHCSEPGWFRVCYANMDDRDVQIALQRIRSFVTQNNKEAMGSDKNSKPYWHSNLRLSLKPRRFDDIMMSPHSPIPQSPLVKATT

SEQ ID NO: 2977 - protein, 174 aa, Zea mays
MMPRRALLFAAVLLAASAAAVSGFHLGGDESGLVRGVLAALRERAEAEDAARFAVAHYNKNQGAALEFTRVLKSKRQVVTGTLHDLILEAADAGKKSVYRAKVWVKSWEDFKSVVEFRLVGDSESEPEPSVASDVSSGQAIAKLSLEADIVQEEARLHTIENDGLSGDFTSSSS

SEQ ID NO: 2978 - protein, 328 aa, Magnaporthe grisea
MAKTSIKLNSGYEMPLVGFGIWKVPVDKTAQAVYDAIKLGYRQIDGAYDYTNSKEAGEGVRRAIEEGIVKREDLFITSKLWNNYHKHEHAIEMAKHEVDTWGIGYLDLFLIHFPISLEYISHSKMPYPCFWPDREKSRSTPLQYTPVAETWAALESLVKTDSNPDGILRSIGVANFRAQLLTDLWGSAKIKPAVNQIEHHPYLVQPQLLAFLKDHGIAITAYSSFGPQSFVELDHPRVSKVEPLFTHPTIKAIADKHGRTGAQVLLRWATQRDIVVIPKSNNVDRLKQNLDCVSFDLSDDEVKQISDLDCGVRFNDPADLSPPIYIFD

SEQ ID NO: 2979 - protein, 547 aa, Angiococcus disciformis
MAAKEIFFHQSAREAILRGVRTLADAVAVTLGPKGRNVVIEKSFGSPTITKDGVTVAKEIDLDNKFENMGAQMVKEVASKTSDKAGDGTTTATVLARAIYEEGLKLVAAGHSPMDLKRGIDKAVEVVVEELKKLSKPTADKKAITQVGTISANGDETIGSIIADAMEKVGKEGVITVEEAKGLETNLDVVEGMQFDRGYVSPYFVTNRERMEVVMDDPFILISEKKVSSMQDMIPILEQVARSGKPLLIIADDIEGEALATLVVNKIRGVLNVAAVKAPGFGDRRKEMLKDIATLTGGMVVSEELGHKYENLTLNDLGRSKRITVDKDNTTIVDGAGTKSEIEGRIKLIRSQIDTVTSDYDREKLQERLAKLVGGVAVINVGAATETEMKEKKARVEDALHATRAAVEEGIVPGGGVAFLRCLPALEKLKLGGEQDFGVEIIRRALQEPLRKIASNAGVEGAVVINKVREGQGAFGYNARTEVYEDLEKAGVIDPTKVERTALQNAASVASLLLTTEAMIADRPAKKKGKNGGGAGMPDYGGDDMDY

SEQ ID NO: 2980 - protein, 520 aa, Zea mays
MGNSLGCSASGERLVSAARDGDAIEARMLLELSPALARYSTFGGLNTPLHFAAAKGHLDIVTMLLEKGADVNARNYCGQTALMHACRHGHWEVVQMLLLFRCNVTRADYLSGRTALHFAAHDGFVRCIRLLVADFVPSVALEDIASSVVDGGDCQTNNGSSPNSSSGQKFNESARVRYINKPADGGVTALHMAALNGHLDCMQLLIDLGANVSAVSFPYGTTANLIGAGSTPLHYAAGGGKQECCELLISKGSSRLTLNCNGWLPVDVARIFGRRSLEPLLSPNSHSNVPVFQPSSYLALPLMSILNIAREFGLQHTTPSIDDNDLCSVCLERSCSVAAEGCSHEFCIKCALYLCSTSNIRVEFTGPPGSIPCPLCRNGIMSFTKLPSTPTEGLKSGSALTFCNPCILNTRSMDSPATFSKAEIRRNRVAAVSSELVCPITCSPFPSSALPTCRCSDDDPCGDTDVQDGPEFQSPRPSHSASMELDKRGEGDLDRASCSGMFWSRRSCHREQQCDAEINA

SEQ ID NO: 2981 - protein, 160 aa, Zea mays
  misc_feature (14)..(14): Xaa can be any naturally occurring amino acid
  misc_feature (38)..(38): Xaa can be any naturally occurring amino acid
  misc_feature (101)..(101): Xaa can be any naturally occurring amino acid
LMLVYDLIQGLSSXLVTIREDVLGAPTFALAVHHGGPXVTTRLRMAEADKWIRLLKQSDETWKMGGLAHTLAPRLCAEKCDTYAVMYDHPLAIRLRRIAFXLMAKDTFDFLALDRPSTTTIDRAIALPKMTGPITLCLGGEGCLNFVGRAFVHPEWLLFS

SEQ ID NO: 2982 - protein, 266 aa, Triticum aestivum
  misc_feature (83)..(83): Xaa can be any naturally occurring amino acid
  misc_feature (94)..(94): Xaa can be any naturally occurring amino acid
  misc_feature (155)..(155): Xaa can be any naturally occurring amino acid
  misc_feature (172)..(172): Xaa can be any naturally occurring amino acid
  misc_feature (189)..(189): Xaa can be any naturally occurring amino acid
  misc_feature (191)..(192): Xaa can be any naturally occurring amino acid
  misc_feature (225)..(225): Xaa can be any naturally occurring amino acid
  misc_feature (242)..(242): Xaa can be any naturally occurring amino acid
MSASPSMSGGAGERTRTVVWFRRDLRVEDNPALAAAARTAGEVVPAYVWAPEEDGPYYPGRVSRWWLSQSLKHLDASLRRLGXATRLVTRRSTXDPSPPLLELVRSTGATHLFLNHLYDPLSLARGHRGKQVLGAQGITVQAFNSDLLYEPWEVXDHHGWPFTMFTPFWNTXLCMVDPPAPHAAPKRIXSXXMSRCCSSDELIFEDESERGSNALLAPALSRGGXNATKVLRALFKGPFIDXPGPGRRAEGKKPKGLPPYLHLGEA

SEQ ID NO: 2983 - protein, 423 aa, Unknown
  Burkholderia sp. 383
MVAVPIPDARPLMESVDLTTAFSPLQIGPLTLRNRLIKSATNEGMTPNGVPSRALVRFHERIAEGGAALTTVAYCAISDDGRTFVDQARLDVPTVRQFRALTDAVHRHGAAASAQITHGGCFTFLPSLSTRRPLSASGGLNKVGVMSGRFLKQAMTRDQMSTIADEFAQAARHARDAGFDAVEIHMGHGYLLSQFLSPLYNRRRDAYGGDATRRATFPVEVLRRVLDAVGRDLAVVCKIGVTEGVRGGGTADDACEIARRLEAEGAHLLVLSGGMNVESVWQLFGSPLPGEARANADNAIVRTAMALQKLTEPKMGAFREMYFLEHSKKVRAAVRMPLAYLGGVRSRGNVELAMREGFDAVALARALVFEPDFVNGLRDGRLAQSGCTSCNRCVVSMYTPGGTACVLREPNDPAPNRVPAAGA

SEQ ID NO: 2984 - protein, 360 aa, Corynebacterium diphtheriae
MTTLFESATAGVLELNNRITMAPLTRSRAGQDGVPTDMHVEYYKQRANNGLIVTEGTFFEDINRAFLGQPGIATADQQEGWRKVAQAVHEQGSNIVMQIMHGGRLTLPSINGFDQGESSSAIAPGVTLHGDGESREEVPTPVALDAEGIKRVIQKFTEGARRAIDAGMDGVEVHGANGYLLHQFLAPSSNDRTDEYGGSPENRARLTIEVIRSIADEIGADRVGLRISPMHNIQGCIEEDEDDVRATYKALLDGIADLNIAYLSILYQDAESDLVAYLRESFGGFTILNTGFGAVTELEDARYIVENGLADAVAVGREIIANPDLSYRWKNNLALNSIDFDTFYTPGPRGYIDYPMVDEG

SEQ ID NO: 2985 - protein, 484 aa, Xanthomonas campestris
MLRGLTCRCRVCMSYAIVWFRRDLRLEDNPALRAALDAGHDPIPLYIDAPHEEGQWAPGAASRAWRHRSLAALDASLRARGSALLIRQGDSAQVLDAVIAQTEAVAVYWNRKYEPATQPRDAQIKRSLRERGLEVQSCNAALLFEPWTLATQQGRPYKVFTPFWRNALTQLRLPDAMPAPRSLPPLPASLDGVHVDALNLLPTPAWDQGFWEHWQPGEAGAHEMLEIFVDGALSGYRENRDRPDRVGTSQLSPHLHFGEIAPWRIASTLEAQRSARNGADIDGYIRQLGWRDFAYHLLHHFPDTTTQNLNPRFAGFDWATVDPVTLDAWQRGRTGIPIVDAGLRQLWHTGWMHNRVRMIVASLLCKHLRVHWLEGARWFWDTLVDADLANNTMGWQWVAGTGADAAPYFRVFNPVTQAEKFDPQATYITRWIPELAALPVKERFAPWLHPLSLARLAPTYPRAPIIGLAEGRDAALAAYAGTRG

SEQ ID NO: 2986 - protein, 612 aa, Arabidopsis thaliana
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAMKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDIARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 2987 - protein, 360 aa, Zea mays
LEKPLLSHLRFFPWVVDEVHFKVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQGALSEMWELEAASCAAIENGMEEGLGDSTDEPPIDFPQELRMEVDRQPAQPAIIHTPVVVCWRREDQRVPSMTSSLIRAETELTADFGNTSEDSRREVPSNIHLQARAEREEIVDGATGNTVRVNGNQQQQNLQNNMHRVLGIAPSISEASSSWTGREGGLVPSTCKQFRFTIHKQSISQSSDRR

SEQ ID NO: 2988 - protein, 250 aa, Buchnera aphidicola
MILTSISVLKDNYVWILYNDNCSCIIIDPGVSEDIIKKIEKKNWKLIAILLTHNHIDHVGGVEEIIRRYPNVTVFGPEETKTRNVNKIVKQGDVIKLLKSEIHVFLTPGHTLGHVSYYLKPYIFCGDTLFSGGCGRVFKNKFFDMYQSINFIKSLPKKTILCCSHEYTLSNLNFAMSILPFDKKIKKYYKKIKKHISQNKTSLPVSLETEKKINIFLRTNEKTIKKAMGLKKDTSSFEVFILLRKEKDDF

SEQ ID NO: 2989 - protein, 408 aa, Prosthecochloris aestuarii
MDAFRGAFEIGLFCQPAAHTLYCSIDQDLPEQAITGYAPCLDDAKEVSLMTMLFSPASLGTLTLQNHIVMAPMTRSRATGNVANALMREYYAARSSAGLIITEGTSPSPDGLGYPRIPGIFSGAQIEGWKSITEAVHQRDGKIFMQLMHCGRIAHPLNMPDGAEIIAPSAVAAQGTMYTDTDGLQPYPVPRAMSEEDIAIAKAGYVDASLHAMEAGFDGVELHGANGYLLEQFFRPNTNLRTDCYGGSVENRARFMLEVLDEVIAAVGDQRVGIRLSPFGVFNDMPLYEAMEEEYRWLAGAIARVAPLYIHLVDHSSMGAPTVPDSIKESFRKSFKATLILSGGYDAARAARDLDARKCDLVAVGRAFIANPDLVERWHAGAPLNTPDPDTFYSAGPKGYIDYPVLEG

SEQ ID NO: 2990 - protein, 337 aa, Yarrowia lipolytica
MFRSVYKRGRILSKIPIKQHIQITHKHTMTSLDFTLNNGKTIPAIGLGTWKSTTEEVAGAVECALTEGGYRHIDTAFNYRNEDAVGLGIKRAMEKGVKREDIFVTTKIWVTYHDRVEENLDMSLERLGLDYVDMLLIHWPVPLNPNGNDPVYPLRPDGSRDIDESGSQPKTWKQMEAVLKTGKTKSIGVSNFSIPYLEELLKEAEVVPAVNQVELHPLLPQLELMEFCKKNNIVMTAFSPFGSVGGPLLKNELVVSLADKYNTSPGGILTSYHIGNGTVVIPKSVTNSRIVENGKSAVTLSQEDLKALNDLHKTEGIHRTSKPKWGVDLGFPDFDFC

SEQ ID NO: 2991 - protein, 329 aa, Escherichia coli
  misc_feature (271)..(271): Xaa can be any naturally occurring amino acid
  misc_feature (277)..(277): Xaa can be any naturally occurring amino acid
  misc_feature (296)..(296): Xaa can be any naturally occurring amino acid
  misc_feature (302)..(302): Xaa can be any naturally occurring amino acid
  misc_feature (308)..(308): Xaa can be any naturally occurring amino acid
  misc_feature (315)..(315): Xaa can be any naturally occurring amino acid
  misc_feature (318)..(318): Xaa can be any naturally occurring amino acid
  misc_feature (325)..(325): Xaa can be any naturally occurring amino acid
  misc_feature (327)..(327): Xaa can be any naturally occurring amino acid
MTNKHPSLFSPFMLTEKIKLRNRIVMAPMTTWSANPDGTISEQELEFYKRRSQNVGLVITGCTYVTPSGIGFTHEFAAYDDRFINSLEKLAAAAKSGGAPAILQIFHAGNKAIPELVPNNDVISASASSVKSGDFMKRVVQSREMTENEIQETIRAFGDVTKRAIKAGFDGVELHGAHGFLLQNFFSPLFNQRNDRWGGDLEGRMRFPLAVLQEVKNVVYEYATKPFAIGYRISPEESVTGGLRIEDTYKLLDRLISSGISYIHTSLVSIXIATLLXLPNGPRTIELILNHIAGRXTGNRRXKIHTPXQAQEAIXRWXATCCDPXKXWR

SEQ ID NO: 2992 - protein, 392 aa, Pseudomonas aeruginosa
MWFNGFLDLSPWQLVAVTLVLTHITIVSVTVYLHRYSAHRALDLHPALQHFFRFWLWLTTGMNTREWTAIHRKHHAKCETVEDPHSPVHKGLFTVLRAGAELYKAEAKNQDTLRIYGKNCPDDWIERNLYSRFPIGGVVLMALIDLALFGALGLTVWAVQMVWIPFWAAGVVNGLGHAVGYRNFECRDAATNLVPWGILIGGEELHNNHHTYPNSAKLSVKKWEFDLGWAWIKLFSFLRLARVARVAPIAHRVEGKHSLDMDTAMAILNNRFQIMAQYRKLVIAPLVKQEVAKADESVRHLFRRAKRLLSRETSLLQDRHHVRIDSMLAHSQALKVIYEKRLALQQIWAKTSANGHDMLAAIKDWVHEAEASGIQSLKEFAAQLKTYSLRPA

SEQ ID NO: 2993 - protein, 233 aa, Arabidopsis thaliana
WSPAIRESIAKFLEKRDGHPAEPKDIYLSAGASSGVNTLLHIISDKPTAGVLVPIPQYPLYTATLSVLGSKCVPYYLDESKGWGTDIDAIKGAYKIAEEKGIDVRAIVIINPGNPTGASLSIEDIQAVITFAAENRLVILADEVYQTNVFKGKFYSFKRILRDLQKSNPDKYKYIELASLHSVSKGMVGECGHRGGYFELVGFDPEVQQQIYKFVSITLCAPVIAQCLVELMV

SEQ ID NO: 2994 - protein, 496 aa, Yarrowia lipolytica
MLRQGIKRAVVHARAVQAVCKRTNMTITKKDLNPQVVNAQYAVRGKLAVRADEIKEQMRTNPSLFPFDKVINANIGNPQQLDQKPVTFYRQVLAMLQYPELMDRAADVGIPNDAVQRARKLLDDIGSVGAYSSSQGVTTVRNSVANFIQKRDGYAASASDIYLTTGASNAVTFLLTTLARGDGSDGFMIPIPQYPLYTATLTLQNSNPVPYYLDEAKEWGTNMAALNDAVESSKHKLKAVVVINPGNPTGACLGVKEIKDILLLAQKEGIAVIADEVYQANIFASGQFHSFKKVWSILKEENPDFNVPLASLHSTSKGKIGECGQRGGYMELVGFHEDVIEQIYKLCSISLCPVVTGQALIECMVNPPVEGDESYPLFNKETNHIMDTLTQRANRLYEAFKEMPKVSCEPPQGAMYLFPSIELPAGAIAEAERHNEQPDEFYCMKLLEQTGICVIPGSGFGQKDGTYHFRTTFLAPGDDYGEKIVNFHKKFLAQYE

SEQ ID NO: 2995 - protein, 162 aa, Unknown
  Dehalococcoides sp. CBDB1
MTLERWQPGWSLRPWRPFREVLSPGLWNMLTNERDWLPATEMVELKDKYLIKAEMPGINEEDIEVSVSDNVLSIKGEKKCDCEISEENYYFSERSYGSFSRSMTLPNNTDPQNIAATLDNGILEITIPKSSEAKPKKVSVIKAAKPKKTDLNTQSIKPKAQS

SEQ ID NO: 2996 - protein, 819 aa, Aegilops tauschii
MATFAVSGATLGVARAGVGVARAGSERRGGADLPSLLLRKKDSSRAVLSRAASPGKVLVPDGESDDLASPAQPEELQIPEDIEEQTAEVNMTGGTAEKLQSSEPTQGIVETITDGVTKGVKELVVGEKPRVVPKPGDGQKIYEIDPTLKDFRSHLDYRYSEYKRIRAAIDQHEGGLEAFSRGYEKLGFTRSAEGITYREWAPGAHSAALVGDFNNWNPNADTMTRDDYGVWEIFLPNNADGSSAIPHGSRVKIRMDTPSGVKDSISAWIKFSVQAPGEIPFNGIYYDPPEEEKYVFQHPQRKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYKFDGFRFDGVTSMMYTHHGLQMTFTGNYGEYFGFATDVDAVVYLMLVNDLIHGLYPDAVSIGEDVSGMPTFCIPVPDGGVGFDYRLHMAVADKWIELLKQSDESWKMGDIVHTLTNRRWLEKCVTYAESHDQALVGDKTIAFWLMDKDMYDFMALDRPSTLRIDRGIALHKMIRLVTMGLGGEGYLNFMGNEFGHPEWIDFPRGPQTLPTGKVLPGNNNSYDKCRRRFDLGDADFLRYRGMQEFDQAMQHLEEKYGFMTSEHQYVSRKHEEDKVIILKRGDLVFVFNFHWSNSFFDYRVGCSKPGKYKVALDSDDALFGGFSRLDHDVDYFTTEHPHDNRPRSFSVYTPSRTAVVYALTE

SEQ ID NO: 2997 - protein, 549 aa, Saccharomyces cerevisiae
MRRSPSRSNNNFAVPNCSTNSNSSQQQLTTPSDDLNSNEPNDPDDSRSLPTIKKFNNKHSINNYNTLASAGKNNNNKRASNDNLLIPGENAHKQKIYTKDENLKSLYLDIDVSVAKALSSSATAPKLINTARTSSTTTATTSNNILTSPSYRESNYSSPSSYSFSSYYSSATSASSSTSSFLKSSGLSSRVKSPSSSVKAGSFGAPSSPTSGIPNPKSSKKPIFLRRYSHDTSSNEGLDIDVAIEKLLQVGESREITKTSKKKNFPFHSWEIQLICYHAREIFLNQPTLLRLQAPIKVVGDVHGQFNDLLRILKLSGVPSDTNYLFLGDYVDRGKNSLETILLLLCYKIKYKDNFFMLRGNHESANVTKMYGFYDECKRRLSSKVWKMFVDVFNTLPLAAIIQDKIFCVHGGISPDLHDMKQIEKVARPTDIPESGLVTDLLWSDPDPQVTDWSENDRGVSYTFSKRNVLDFCAKFKFDLILRGHMVVEDGYEFFARKKFVTIFSAPNYCGEFHNWGAVMSVTTGMMCSFELLKPRALKNKKKLYKTKV

SEQ ID NO: 2998 - protein, 84 aa, Pisum sativum
MCGILAVLGCSDDSQAKRVRILELSRRLKHRGPDWSGLHQHGDNYLAHQRLAIVDPASGDQPLFNEDKSIIVTVNGEIYNHEEL

SEQ ID NO: 2999 - protein, 444 aa, Unknown
  Mesorhizobium sp. BNC1
MIRKLSLLFAGALMGASAMSLVYGTNGTAAIAADTDTYRQLAIFGDIFERVRAQYVTPPDDKKLIENAINGMLTSLDPHSSYLNAEAAQDMRVQTKGEFGGLGIEVTMENELVKVVAPIDDTPASRAGILSGDLIEKIDGEEVRGMTLNDAVDKMRGLVNTPIELTVLREGQSKPLTFKIIRDTIKVKAVKSRVEGDDIGYLKITSFTEKTTDDLRAAIEDIRKQVPEDKLKGYVLDLRLNPGGLLDQAVNVSDAFLERGEVVSTRGRESGDIARFSSQAGDLTGGKPLVVLINGGSASASEIVAGALKDHRRATLVGTRSFGKGSVQTIIPLGENGALRLTTALYYTPSGESIQGKGITPDIKVEQPLPEDLQDVDLSRGESDLRGHIRGAEEDEEGSGSIAYVPQDPKEDVQLSYALDLIRGVKTDPAYPASPDKAVMNQQQ

SEQ ID NO: 3000 - protein, 84 aa, Pisum sativum
MCGILAVLGCSDPSRAKRVRVLELSRRLKHRGPDWSGLHQHGDCFLAHQRLAIVDPASGDQPLFNEDNPSIVTVNGELYNHEDL

SEQ ID NO: 3001 - protein, 927 aa, Vibrio cholerae
MTQRYGLRARVMTLTLAPTLIIGLLLSALFSFNRYHDLETQVINSGASIIEPLAIASEDALRMQSRESVRRIISYAHRKNSKLVRSIAVFDANHELFVTSNFHPNFEKLMYPKDKPIPFLSSSVIDENTLILRTPIISERTVLDNGDANPATPVMGYIAIELDLSSLRLQQYQEIFSAGLVLVIGILLSGVFASRLMYDVTRPITHMKNMVDRIRRGHLDVRIEGKMHGELDTLKKGINAMAVSLSEYHVEMQHSIDQATSDLRETLEQLEIQNVELDIAKKRAQEAARVKSEFLANMSHELRTPLNGVIGFTRQMLKTQLTNSQADYLQTIEKSANNLLTIINDILDFSKLEAGKLALENIPFEFQEVLEEVVNLQATSAHEKGLEITLKIDPKIPRGVVGDPLRIQQVLTNLVGNSIKFTERGNIDVSVEMRALRDDVIDLQFMVRDTGIGISERQQAQLFQAFSQADASISRRYGGTGLGLVITQKLVSHMGGEISLTSRLHQGSTFWFTLRLHTTELPLNDGYNADSLNHRHLLLIEPNMQAAAIVQQTLVQSGLEVTYRSAIPEEQHVYDYVLLNLAPSKETNPTLVELWVQRALAMTHNVIVGVPSTELALADQLMQRYPVKCISKPLSRKKLLQTLAAQQPQLANTSLPKPQADKLPLCVMAVDDNPANLKLITALLQERVEYVVSCTSGQEAIEQAQSRQFDIILMDIQMPHMDGVTACKAIKQLKGYRDTPVIAVTAHAMAGERDRLLKAGMDDYLTKPIEEHILQQVLVHWSPHTRSKQVAKVTPPDGAAVISNALPSSPPAEEAIIDWPVALRQSANKEDLAKEMLGMLVDYLREVETVVNTALEDEEYPASDLLHHIHKLHGSCSYSGVPRLRKICASLEQALRNGASIDELEPELFELQDEMAKVLEASRDYLN

SEQ ID NO: 3002 - protein, 587 aa, Brassica napus
MYRLISSIASKARVARNCTSQIGSRLSSTRNYAAKDIRFGVEGRALMLRGVEELADAVKVTIPPKGRNVIIEQSWGAPKVTKDGVTVAKSIEFKDRVKNVGASLVKQVANRPTQLNRCLGDGTTCATVLTRAIFTEGCKSVAAGMNAMDLRRGIKLAVDTVVTKLKSRARMISTSEEIAQVGTISANGDRELVTDCKAMESVGKEGVITIQDGKTLFNELEVVEGMKIDRGYISPYFITNQKNQKCELEDPLILIHEKKISNLNSMVKVLELALKSQRSLLIVAADLESDALAVLILNKLRAGIKVCAVKAPGFGENRKANMHDLATLTGAQVITEELGMNLEKIDLSMLGNCKKITVSKDDTVFLGWGAGDKKAIGERCEQIRSMVEASESDYDKEKLQERLAKLSGGVAVLKIGGASESEVGEKKDRVTDALNATKAAVEEGIVPGGGVALLYASKELDKLSTANFDQKIGVQIIQNALKTPVYTIASNAGVEGAVIVGKLLESDNPDLGYDAAKGEYVDMVKSGIIDPVKVIRTALVDAASVSSLLTTTEAVVTEIPTKEDASPAMGGGGGGMGGMGGMGGMGF

SEQ ID NO: 3003 - protein, 364 aa, Arabidopsis thaliana
MVIMQVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQLYERLLKDVGTSSPEQEIVT

SEQ ID NO: 3004 - protein, 612 aa, Arabidopsis thaliana
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVSSYNGDLLYEPWEIYCEKGKPFTSFNSYWKKCLDMSIESVMLPPPWRLMPITAAAEAIWACLIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 3005 - protein, 773 aa, Pseudomonas fluorescens
MDIKFTNRLSYKQARLTVLVGFILGTALSLLQIGIDYASEDASINREIQSLLEISHNPASRIAYNIDAELAQELTLGLLRSPAIIRAQLIDNNNTLLANVERPPQQSRYRAISDFLFGADRQFEDRLYLSHLPEESLGTLHLDVDTYAFGSRFLRRAEVTLINGFARSLILTGILLALFYVMLTKPLVRVIRELSSRDPRSPKQAKLDFPHGHENDEVGVLVKVANQQFDIMATEIQQRRNAENRLTEYLGQLENIVSARTTELKASNARLSQSNEELEIARRTALDMAQARAAFLANMSHEIRTPLNGLLGMIALSLDSPLNPEQRQQLSIAHDSGKVLVELLNDILDMSKFDAGQLELERIPFDLGVLVEDTANLLSQNAAASVELACLIAPDFPALVLGDPTRVRQIVSNLLSNALKFTRFGRVDVRLSTLGDGVRIEICDTGIGIAQEAQVRIFQPYTQAGAGITRQYGGTGLGLALTYNLCEAMDGRLSISSEVGFGSQFCADLPLPCHTPAAPPPALAGKIIAITEAGSGLAELLASLLPSWGLSYQRCDIEDSLAGLDPDLLITDCPECLFGLRPAIRAPILLVTAYGSFLPSEEANALAPLQQQARPLARNALYQTLRRSLLGETITLNDAQLEMPVQRRRADILLVEDNPVNQLVAKGMLSKLGCAVTVAAHGAEALNQLELHRFDLVLMDCNMPVMDGYEASRQIRRSGRWPDLPIIALTANAMPEERERCRAAGMSDYLAKPFRREELIALLDLWVPTTTKL

SEQ ID NO: 3006 - protein, 154 aa, Yarrowia lipolytica
MPKDGEDGRCRWCIEATRTGINTEYGAAFTAGGIFFIFLGIMTFFDSALMAFGNILFLIGITLLIGPQKTLAFFARRQKLRGSIAFGLGIFLILIKRPFIGFAIELVGILALFGDFFAVIVAFLRSMPVIGPILRHPAVAPVIDRLAGVRILPV

SEQ ID NO: 3007 - protein, 957 aa, Cryptococcus neoformans
MSVQSPLIAVPRKTTTDVDWATPIRHVIAASYGEDPNSYAEECAVLQRCRQDAVRGAGNDQTARDLLYKYFGQLELLELRFAEIKVSFPWNDAFTDKLTTQTSLAFEKASIIHLISSILSSLAQSASRSDPEGLKRAYYNTRATAGMLTYINENFLHAPSTDLSREVVHLLIGIMMAQAAEIFTEKLVEEKKSASLVARSANQTASMYTSVVDEMKEFQGKGVFDRNWLYVLQIKAKLFGSLAQYYKATSDSAAGKHGTALVRLKIANSLIQDAQKQASSFIYTFVAASTPSLPHDAANALNEIVKAHATVCGEAKEQAVKDNDLIYHEVLPSEASLPAIEKLPPAAPITIQDVYGNQEVTKLIGPDIFLRLVPLAVHESASVYSEEKAKLVRAEVDKVELAEGEIQAGLDHLNLPEEIDRWRQFLEGDTNDDVPLSQQLKSLVDSVGDVRQVENDLGRLDGERAACERELRELNGALDAESRECERMRAKYTPNFTQSPSGPQTANLRSNLSANLSALSSASTSDAHLQSLWQSIQPSISLLSSGPSNLERAARDITEGNPQKIDKTVSLLDLDDEEVDRKALGQEEKDALRKAVDDGREKLDRLKKIRAERDEVLRDLKEKIQTDDVSNLLLLNRRSQNVEPQLFASELEKFRPYQTRLAAAVSASRSILQELDMLVAQVHKGTGFREILRKEKDRQRIIRDWEKRLIEAGESYAEIRAGLGKGLSYYDSLRRVIEDLRMEVQRFTNSREQERRNMVSDIETRQRLGGTSPSTGGVVANRGLEERLAALKMEAPPQPPRLGTTSTPNLPPPPGRGSSNVTSSYLPPPPPPKPQSNPYDFSTLAGFGSFATPSVSSPQHVYPSQPQQAYNQQSYIPPQQNPYYPPPPSRPTYASPPFAPQQPPMQSGHSPYAPPPGHAPQPQQPQYPSSQNQQQRQGYKYPGYGQQGGYGGGYGQY

SEQ ID NO: 3008 - protein, 403 aa, Pseudomonas fluorescens
MQVSKSNKLANVCYDIRGPVLKHAKRLEEEGHRILKLNIGNPAPFGFEAPDEILQDVIRNLPTAQGYSDSKGLFSARKAVMQYYQQKQVEGIGIEDIYLGNGVSELIVMAMQALLNNGDEVLVPAPDYPLWTAAVSLAGGNPVHYLCDEQANWWPDLADIKAKITPNTKALVIINPNNPTGAVYPREVLLGMLELARQHNLVVFSDEIYDKILYDDAVHICTASLAPDLLCLTFNGLSKSYRVAGFRSGWVAISGPKQHAQSYIEGIDMLANMRLCANVPSQHAIQTALGGYQSINDLVLPPGRLLEQRNRTWELLNDIPGVSCVKPMGALYAFPRIDPKICPIHNDEKFVLDLLLSEKLLVVQGTAFNWPWPDHFRVVTLPRVDDLEQAIGRIGSFLKSYRQ

SEQ ID NO: 3009 - protein, 400 aa, Candida glabrata
MPFSKDFEPVAFKDTNMFKPMKVGNTTILHRAALPPLTRMRAHHPGHIPNREWAVEYYKQRSQRPGTMLVTEGVFPSAQSGGYDNAPGIWSEEQMVEWRKIFNAVHDNKSFAWVQLWVLGRQGFPDSLARDGLRYDSASDGIYMSAEQEELAKKSNNPQHGITKDEIKQYIKDYVQGAKNAIAAGADGIEIHSANSYLLNQFIDPKSNKRTDEYGGSIENRARFTLEVVDAIVDAIGPERTAIRLSPYGTYGDMSGGAEPLIVAQYAYIIGELERRAKEGKRLAYLHLVEPRVLDPFAPEGEDVYNEGTTDFAYSIWKGPIMRAGNYAIHPEVAMEVLKDDRTIVGYGRYFIANPDLVDRLEKGLPLNKYDRSTFYAMSAEGYIDYPTYEEAIKMGWDKQ

SEQ ID NO: 3010 - protein, 542 aa, Oryza sativa
MRRSGNGGAAKKKKKRSASAASERRPRADGGMRIVVPLQGVVQGRGGLVLGSLIPCALFYFFQLYIKRNRASPPPPPGSPTAASAAAVSPIHRSLSRGLLAPRAALPAISARGASVRDDDSLYYAGLRRCAADPYHPVTNPSGIIQLGLAENYLSLDLVGRWMEEHAAEAASMAGGEDEDERELSIRGLAAYQPYDGILALKMALAGFMRQIMQGSVSFEPSQVVITSGATPAMEILSFCLADPGNAFLVPSPYYPGWDRDIKWRTGIELIPVPCRSTDNFNISITALEIAYNQAKKRGIKVRGVLISNPNNPTGSFVPKQTLHDLLEFAAEKNIHLISDEVFAGSTYGSGKFVSVAEVVDDLEDFDKGRVHIIYGLSKDLSLAGFRVGVIYSYNESIVTAAAKIARFSSVSTPTQRLLVAMLSDQKFISDYLKVNRERLRKMYHLFVDALDQVGIECYKSSGGFYCWADMSKFIRSYSEKGERKLWDRLLEEAKVNVTPGSSCHCIEPGWFRCCFTTLSEHDIPVLVQRLRTITDSHKPNH

SEQ ID NO: 3011 - protein, 283 aa, Escherichia coli
MQKVKLNNGIEMPLLGFGVFQMTDAAECERAVIDAINSGYRLIDTAASYQNEIQVGNALKQSGIARNELFVTTKLWLQDTSYEGAKAQFERSLNRLQLDYVDLYLIHQPYGDVHGAWRAMEELQQAGKIRAIGVSNFHPDRLADLIAFNNVVPAVNQVEVNPFNQQLQAVPWMQSRGIQPEAWAPFAEGKNGLFQHPVLTAIGEKYGKSVGQVVLRWIYQRGIVSLAKSVRKERMEENINILDFELSPEDMLQITALDTATSAFFSHRDPAMVEWLTGRKLDV

SEQ ID NO: 3012 - protein, 282 aa, Mycobacterium avium
MSKVPTIELNDGARIPQLGFGVYQIKPDETAAAVRAALDIGYRHIDTAEMYGNEREVAQGIRDAGLDRSEVFVTSKLNNGFHEPDAARRAFDATLNALGSDYVDLFLIHWPLPTLYGGDFVSTWRVLEEFARDGRARSIGVSNFQVAHLERLAAETDTVPAVNQVEVHPYFTNEKVRGYAREHGLAIEAWSPIAQGGVLGDAVINRIADGLGRTAAQVVLRWHIQRGDIVFPKTVNPDRMKSNFELFDFELDERAMEAISALDRGESGRRGPNPDTFDYIPR

SEQ ID NO: 3013 - protein, 294 aa, Escherichia coli
MEGLTVEFSVLSNNLKMPMMGFGVFQVTDKDVCKQSVLNAIRTGYRLIDTAAVYGNEDAVGEAVREAISEGLCTREELFITSKLWVQDMLNQDIAAAGIEASLKKSGLECFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 3014 - protein, 507 aa, Campylobacter jejuni
MKKLTNDFGNIIADNQNSLSAGTKGPLLMQDYLLLEKLAHQNRERIPERTVHAKGSGAYGEIKITADLSAYTKAKIFQKGEITPLFLRFSTVAGEAGAADAERDVRGFAIKFYTKEGNWDLVGNNTPTFFIRDAYKFPDFIHTQKRDPRTHLRSNNAAWDFWSLCPESLHQVTILMRDRGIPASYRHMHGFGSHTYSFINDKNERFWVKFHFKTQQGIKNLTNQEAAELIAKDRESHQRDLYNAIENKDFPKWKVQVQILAEKDIEKLGFNPFDLTKIWPHSLVPLMDIGEMILNKNPQNYFNEVEQAAFSPSNIVPGIGFSPDKMLQARIFSYPDAQRYRIGTNYHLLPVNRAKSEVNTYNVAGAMNFDSYKNDAAYYEPNSYDNSPKEDKSYLEPDLVLEGVAQRYAPLDNDFYTQPRALFNLMNDDQKTQLFHNIATSMEGVDEKIITRALEHFEKISPDYAKGIKKAFPIVSRIRAWRNHGHRCFLCEIVIRSQFHTTYEPEA

SEQ ID NO: 3015 - protein, 350 aa, Arabidopsis thaliana
MAEEIRFFELNTGAKIPSVGLGTWQADPGLVGNAVDAAVKIGYRHIDCAQIYGNEKEIGLVLKKLFDGGVVKREEMFITSKLWCTYHDPQEVPEALNRTLQDLQLDYVDLYLIHWPVSLKKGSTGFKPENILPTDIPSTWKAMESLFDSGKARAIGVSNFSSKKLADLLVVARVPPAVNQVECHPSWQQNVLRDFCKSKGVHLSGYSPLGSPGTTWLTSDVLKNPILGGVAEKLGKTPAQVALRWGLQMGQSVLPKSTHEDRIKQNFDVFNWSIPEDMLSKFSEIGQASDFPHIVVHIGQRAFFVLLTHLGYRILKTCVSMLQGRLVRGMSFVHETSPYKSLEELWDGEI

SEQ ID NO: 3016 - protein, 246 aa, Lycopersicon esculentum
MGRGRVELKRIENKINRQVTFAKRRNGLLKKAYELSVLCDAEVALIIFSNRGKLYEFCSTSSMVKTIEKYQRCSYATLEANQSVTDTQNNYHEYLRLKARVELLQRSQRNFLGEDLGTLSSKDLEQLENQLESSLKQIRSRKTQFMLDQLADLQQKEQMLAESNRLLRRKLEESVAGFPLRLCWEDGGDHQLMHQQNRLPNTEGFFQPLGLHSSSPHFGYNPVNTDEVNAAATAHNMNGFIHGWML

SEQ ID NO: 3017 - protein, 343 aa, Oryza sativa
MFNCAAREKAMVINLEFIRAIVTADEILLLDPLTIDVIPFVEQLTHHLPLKNLVCGNGQPGGDDHGEKHDDSHGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWYARWKKLLGP

SEQ ID NO: 3018 - protein, 1123 aa, Orobanche minor
MASSQPGRSSTNSAQSRQSARIIAQTSIDAKLDADFEESGSSFDYSTSVRVTNYPAGLSEPRSDKVTTAYLHQIQKGKLIQQFGCLLALDEKTFRVIAYSENAPEMLTMVSHAVPSVGDHPLLGIGSDIRTIFTAPSAAALQKALGFGEVSLLNPILVHCKTSGKPFYAIIHRVTGSLIIDFEPVKPHEVPMTAAGALQSYKLAAKAIACLQALPGGSIERLCDTMVQQVFELTGYDRVMIYKFHEDDHGEVFTEITKPGLEPYVGLHYPATDIPQAARFLFMKNKVRMICDCRANHVKVVQDDNLPFDLTLCGSTLRAPHGCHSQYMENMNSIASLVMSVVVNEGDEDGPDSSSGPYKRKRLWGLVVCHNTCPRFIPFPLRYACEFLVQVFSIHVNKELELENQMLEKNILRTQTLLCDLLLRDVPLGIVSQSPNVMDLVKCDGAILLHKRTKYRLGLTPTDFQIRDIVSWLDEYHQDSTGLSTDSLYDAGFPGALALGNALCGMAAVKITDEDWLFWFRSHTAAEIRWGGAKHELEAKDDGRKMHPRSSFRAFLEVVKTRSLPWKDYEMDGIHSLQLILRNAYKESEEKDLESREIHARLNELQIDGVKEIEAVTSEMVRLIETATVPIFSVGVDGLVNGWNTKISDLTGLSVVEAIGMHFLALVEDSSADTVSKMLGLALQGKEEHDVQFEIKTHGQRSESGPISLIVNACASKDVKENVVGVCFIAQDITTQKSMMDKFTRIEGDYRSIIQNPNPLIPPIFGTDEFGWCSEWNAAMIKLSGWGREAVIDKMLLGEVFGLNKACCRLKNQEAYVNLGVVLNNTVTGQESGKVSFGFFSRSGKYVACLLCVSKKVDSEGSVTGLFCFLQLASPELQQALHIQRISEQTASKRLRVLAYIRREIRSPLSGIIFSRKLMEGTDLNDEQKNIVRTSLHCQSQMNKILEDTDLDHIIEGYLDLEMVEFKLHEVLIASISQVISKSNGKGIKIVDNLAPNLSNETLYGDSLRLQQVLAAFLLIAVDSTPSGGQLGVAATLAKDSIGEFVQLGRLECRITHGGGVPQEILNQMFGDEPTDASEDGISLFISRKLVKLMKGDIQYLREAGRSTFIISVEIAISNKPNL

SEQ ID NO: 3019 - protein, 205 aa, Magnaporthe grisea
MSSRKKVLLKVIILGDSGVGKTSLMNQYVNKKFSASYKATIGADFLTREVLVDDRQVTMQLWDTAGQERFQSLGVAFYRGADCCVLVFDVNNSKSFDALDSWRDEFLIQASPRDPDNFPFVVLGNKIDVEESKRVISTKRAMTFCQSKGGIPYFETSAKEAINVEQAFEVIARNALAQEESEEFSGDFQDPINIHIDNDRDGCAC

SEQ ID NO: 3020 - protein, 656 aa, Clostridium acetobutylicum
MYKKLFEKGKIGELELKNRIVMVALAVGAAKSDQTIGDDMMEYYLERARGGVGLIIAENTRVNDENGVAARRQVSVARDEHIAPLKKLVDALHSENTKFFVQLHHPGRETYSNLNGDKPVVAPSAIPCGVCKQETRALETSEVEGIIQDFINGAKRAKKAGVDGVELHAAHGYLISQFLSPYTNKRTDKYGGSFEKRFNFVKEVVLGIKNACGQDYPISVRLTVDELLNLNGVKQEYLDLNMGIKICRELEKIGVDVINVSNGIYETFNSLSEPMTYDQGCRTERIKAVKEAVEIPVIAVNMIKEPWFAEKMLEDKLVDFIGLGRALVADSDWPKKALEGRDEDINRCISCTFCFETLLDQVIPNVGPIKCAVNPRAAHEFKYKEFNKNGADKVVAVVGAGVAGLEAARVLKIRGFKPVVLEQSADVGGQINVADKPPRKEKIDWIVEYEKTQLNKMGVEIKLNTKVTLEYLKKMKPYAVFIATGSVPLVPKSIKGIDRENVYTIDDVLTGKVKIIDKKVALIGSGSSGLETAEFLCINKNDVSIIEMQDAIGKGVYVQHYLDAMDKLSKFKVNYMPSNKLLEVTNKGVKLENIVERRIVDYDTDYVVLSLGVKANNDLEALCKAEFENVRVIGDAAAVGRIESSVRSGFEAAFWL

SEQ ID NO: 3021 - protein, 184 aa, Triticum aestivum
  misc_feature (166)..(166): Xaa can be any naturally occurring amino acid
  misc_feature (173)..(173): Xaa can be any naturally occurring amino acid
NKFVQKSRLLPVRNSRDIVDPRVRLDGMLSFVLLDTRDKSFIAARDALGICPLYMGWGLDGSVWFSSEMKALSDDCERFISFPPGHLYSSKTGGLRRWYNPPWFSESIPSAPYDPLLIRESFEKAVIKRLMTDVPFGVLLSGGLDSSLVASVVSRHLAETKSCQAXGNKLHTXFCIGLEGSPDL

SEQ ID NO: 3022 - protein, 664 aa, Listeria innocua
MTDYPSIFEPLTVKRMTIKNRVIMPPMGTNLAGLNGEFLEEHMNYYEQRAKGGTGLITIENACVDFPYGTNGTTQLRIDNDQYIPGFYKLTERLHKHGTCVSIQINHAGASAYPARLNGLQPVSASDIPSKKGGTVPRPLTVEEIYEIVNKYGDAARRAQQAGFDAVEIHGGHSYLLCQFLSPLYNKRTDEFGGTPENRARIVKLILEKVREEVGPFFPIVLRFSADEFTEGGNHLEDILELLDYCQEEADILNVSAAINDNLYLQIDQMNLEDGWRSYLAKAVKDKFNKPTITSGNIRSPKAAEKILSEGYADLLAMGRGLIAEPNWVNKVATGQEDMLRKCISCNIGCADHRISKSKPIRCTVNPDIIHEDKYKETKVTRPTNVVVIGGGTAGLEAACTAAEVGCNTTLIEANEQTGGLARAIANLPDKSRIADFPNYLANRAEKLTNLKVITGTKADTALIDTFNPDVVVNATGSKPLLPPIKGLLDVIDKEGSKVHSIFGLISNIDDFTEFSNKKVAVIGGGAVGLDVVEYFSERGSDVTIVEMMPILGKDLDMITRLSMMDIIEKNHVDVQTETALTEVAADHFKVKHDGVDAEIPFDYGFVCLGMRPERPLMEELAAYGKEKQIEIVNIGDSAATRKILEGVREGRNILTTLEKIGSL

SEQ ID NO: 3023 - protein, 255 aa, Glycine max
  misc_feature (198)..(198): Xaa can be any naturally occurring amino acid
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELQNLENQLEISLHGVRMKKDQLLMGEIQELNRKGNLIHQENVELYKKVYGTQDDNETNRDSVLTNGLGIGEDLQXACESPAKPATATATTLQGIFRNYKIGIAIALIHIQDVCVSQLLSRKMDSDLNLDVFV

SEQ ID NO: 3024 - protein, 365 aa, Geobacter sulfurreducens
MSHLFEPLTIRSLTLPNRIAVSPMCMYSSEDGFANDWHLVHLGSRAAGGAGLVLTEATAVTPQGRISPRDLGIWRDEHIEFLARIVHFITQRGSTAGIQLAHAGRKASTPAPWEQRTATLSGAEGGWPIVAPSPIPFDEGCIVPQELSTGEIDAITAAFVDAARRSLLAGFQIAEIHAAHGYLLHQFLSPLSNQRTDQYGGSFENRTRLLRTVVTAVREVWPEHLPLWVRISATDWVDGGWDIEQSVELVRRLLPLGVDLIDCSSGGSAPHARIPLGAGYQTQFAERIRRETGGRTGSVGQITAPAQADHIIRSGQADLVLLARELLRDPYWPLRAARELGHQSPWPAQYVRAAPHNTPAYLPKD

SEQ ID NO: 3025 - protein, 415 aa, Anabaena sp.
MSYYIAPRFLDKLAVHITKNFLNLPGVRVPLILGIHGRKGEGKTFQCELAFEKMGVEVTLISGGELESPDAGDPARLIRLRYRETAELIKVRGKMCVLMINDLDAGAGRFDEGTQYTVNTQLVNATLMNIADNPTDVQLPGSYDSTPLRRVPIIVTGNDFSTLYAPLIRDGRMEKFYWEPHRDEKVGIVGGIFAEDGLSQRDVEKLVDSFPNQSIDFFSALRSRIYDEQIRDFIHQVGYENVSLRVVNSLEGPPAFKKPDFTLSHLIESANFMVAEQKRIETSQLVDEYNRLNRGRSYQPASPVAEIATSQPSPNGVNQPQSASPHISLETQEQIRQILAQGHKITFEHVDNRRFRTGSWQSCGTIHVDAESDAISTLESCLAEYRGEYVRLVGIDPKAKRRVVETIIQRPNGTN

SEQ ID NO: 3026 - protein, 484 aa, Pasteurella multocida
MSKCPFDHGSKTLTNAAGAPIVENDNTMSAGPKGPLLLQDVWFQEKLAHFARERIPERVVHAKGSAAYGTFTVTHDISKYTKADLFNGIGKQTQVLLRFSTVAGERGAADAERDVRGFALKFYTEQGNWDLVGNNTPVFFIRDPLKFPDFIHTQKRNPQTNLRDANAAWDFWSRHPESLHQIMILFSDRGIPTDLRHMNGYGSHTYSFINAQNERFWVKFHFKTQQGHKFYTNEEAAKVVGENRESSQQDLYEAIERGEFPRWNVQVQIMPEADAHKHNYAFDLTKVWPHKDYPMIEVGVLELNQNPINYFAEVEQAAFAPSNIVPGIGFSPDRMLQGRLFSYQDAQRYRLGVNHHQIPVNAPKCPYHTTHRDGAMRVDNNGGTHPNYAPNRFDTYVPTHQQEPALELERSAAHFNFREYDEDYYTQPAALYNLFDVDQKARVAANFAAGLAGVTEPAIVERQLAHFDKVSKELADAIRANLAK

SEQ ID NO: 3027 - protein, 99 aa, Rumex obtusifolius
MATIGGIKQVEGSANSLEVESLAKFAVEDHNKKQNAMLEFSKVVNTKEQVVAGTMYYITLEATDGGKKKVYEAKVWVKPWMNFKQVQEFKLLGDQGSTS

SEQ ID NO: 3028 - protein, 241 aa, Lycopersicon esculentum
MGRGRVELKRIENKINRQVTFAKRRNGLLKKAYELSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDYQRKEHALNEANRTLKQRLMEGSQLNLQWQPNAQDVGYGRQTTQTQGDGFFHPLDCEPTLQIGYQNDPITVGGAGPSVNNYMAGWLP

SEQ ID NO: 3029 - protein, 381 aa, Manihot esculenta
MCGGAIISDFIPATAAGRSSRRLTADFLWPDLKKPIGKIVGDLDDDFEADFQEFKDESDVDEEDDVLFDVKPFSFSATASPPPRNRSPSRGSTAVKSVEFNGLAEKSAKRKRKNQYRGIRQRPWGKWAAEIRDPRKGVRVWLGTFNTAEEAARAYDAEARRIRGKKAKVNFPDEAPRASPKRTMKANPQKPLPKRNATESMSYLNNPDQDYFNTLGSVDEKPLVSQFDLMDSFPANGDATVKSIPPCDNVPTFFNSDQGSNSFECSDFGWGEQASKTPEISSVLSATPEIDESLFMDDANPKKKMKSDSENAVPIEESNGKSLSEELLAFDNQMNFQMPYLEGSWEASLDGFLNGDVTQDGGNPMDLWSFDDLPNMVGGVY

SEQ ID NO: 3030 - protein, 488 aa, Bacillus anthracis
  misc_feature (149)..(149): Xaa can be any naturally occurring amino acid
  misc_feature (194)..(194): Xaa can be any naturally occurring amino acid
MNPNNRLTTNQGAPVGDNQNSRTAGRRGPVLLEDYHLVEKLAHFDRERIPERVVHARGAGAHGVFVTKNSMKKYTKAAFLQNEGTETPVFVRFSTVIHGQGSPETARDPRGFAVKFYTEEGNYDIVGNHLPVFFIRDAIKFPDMVHSLXPAPDTNIQTPDRYWDFMTLSPESTHMMTWVFSDYGTPASYREMEXFGVHSFKWINAEGKIVYIKYHWKPQQGVRNLSAKEVQEVQGKDFNHATRDLFDAIEKGNYPKWDLHVQVMQLEETDSLDFDPLDPTKVWPEDRFPLMEVGTMTLNRNPKNFFAEVEQVAFSPSATVNGIEPSEDKLLQGRLFSYPDTQRYRLGANYLQIPVNCPYAAVHNQQRDGAMQINQNPSTINYEPSRHAENPVEDPAYRDSTMKVEGYVSREKIDKPNDFKQAGERYRSFSKEEQDNLIANLTSDLKDVNERTKLLAVCNFFRADQEYGMRLAQALNVDITQYVGNAPK

SEQ ID NO: 3031 - protein, 333 aa, Chlorobium tepidum
MNKLTTIESHFLQLQKRYPEINSEVTDLLNDVAFAAKLVRREVVRAGLADILGLAGSTNVQGEEVKKLDLFANERLINAIGQHGRFAIMGSEENEEIIKPPKFESGEYVLLFDPLDGSSNIDVNVSVGTIFSIYRLKSGEPSQASLEDCLQKGADQIAAGYVIYGSSVMMVYTTGHGVHGFTYDQTVGEFLLSHENITTPEHGKYYSVNEGSWQEFNDGTKRFLDYLKEEDKATGRPYSTRYIGSFVADFHRNLLTGGVFVYPATKKHKNGKLRLMYEANPMAFICEQAGGRATDGYRRILDIEPKELHQRTPLYIGSKNDVLIAEEFEQGKR

SEQ ID NO: 3032 - protein, 416 aa, Zea mays
MINKDKVMKVGLMEQIKREISIMRLVKHPNILQLYEVMASKSKIYFVLEYAKGGELFNKIAKGGKLSEDAARKYFQQLVSAVDFCHSRGVYHRDLKPENLLLDENENLKVSDFGLSALAESKRQDGLLHTTCGTPAYVAPEVLSRKGYDGAKSDVWSCGVILFVLVAGYLPFHDTNLIEMYRKISRAEFRCPRFFSTELKDLLHKILVPDPSTRISISRIKRSAWYRKPVEAHAKKNEAETSENTCTGEGFNLSGFFEDKYGRREERFTTRQPVTTVFTKLKELAKRLKLRVKKKENGTLKLAAPKEGKKDRSTLAVHVLQRNVSPGDIQRHPDMSPSKKQLTNNNDSLYWSNEKYDYSCSWLDDRAMISALLDVVIEEDSARALSPLPLVAVEAELHPVSVGHKSMDAEMKQPLE

SEQ ID NO: 3033 - protein, 252 aa, Unknown
  Petunia x hybrida
MRVNRNATVFIALNLILFLVFVFTAFALSGQENTGGFCGEEEEKGNNYIEMALLGGIRDSHPESQNSDEIHSLAKFAVDEHNKKENAMFELARVVKAKEQVVAGTLHHLTLEVVDAGKKKLYEAKVWVKPWLNFKELQEFTHVEDAPAITSSDLGVKKEEQCSGFKSVPVHDPVVQEAAEHAIKTIQQRSNSLLPYELQEIVHANAEMIEDSTKLHMLIKTSRGGKEEKFKVQVHHSNEGAFHLNHMEPDRS

SEQ ID NO: 3034 - protein, 427 aa, Oryza sativa
  misc_feature (76)..(76): Xaa can be any naturally occurring amino acid
RTSGSPGLQEFGTSARKRSAVSVAPPPPSPPRAPLPLRPDQLSLSLSLSLSLCPLRSSPPLAAPPPPAPTIDDSPXPPPPPPPTHAGKMKFGAIYEEYLREQQDKYLTKCSHVEYKRLKKVLKKCRVGRSLQEDCPNGDQQEGNNESPDICKCNSCTLCDQMFFTELTKEASEIAGCFSSRVQRLLNLHVPSGFLRYIWRVRQCFIDDQQIMVQEGRMLLNYVTMNAIAIRKILKKYDKIHGSVSGRDFKSKMQTDHIELLQSPWLIELGAFHLNCNSSDIDETVGFLKNEFFKNFSCDLTEARPLMTMAISETMKYEYSLTCPICLDTLFNPYALSCGHLFCKGCACGAASVYIFQGVKSAPPEAKCPVCRSDGVFAHAVHMTELDLLIKTRSKDYWRQRLREERNEMVKQSKEYWDSQAMLSMGI

SEQ ID NO: 3035 - protein, 462 aa, Oryza sativa
  misc_feature (145)..(145): Xaa can be any naturally occurring amino acid
KMINKDKVMKVGLMEQIKREISIMRLVKHPNVLQLFEVMASKSKIYFVLEYAKGGELFNKIAKEGKLSEDSARRYFHQLINAVDYCHSRGVYHRDLKPENLLLDENENLKVSDFGLSALAESKRQDGLLHTTCGTPAYVAPEVLXRKGYDGAKADVWSCGVILFVLVAGYLPFHDPNLIEMYRKICRADFRCPRYFSAELKDLIHKILDSDPSTRISIPRIKRSTWYRKPVEINAKNSEAATTNSISSGVATTSGSAECSTSEENQGSLSLPNLNAFDIISLSTGFNLSGFFEDTHGHQEERFTTRQPVTTVLGKLKELAKRLKLKVKKKDNGVLRLAAPKEGKKGFLELDAEIFEVTPSFLLVELKKTNGDTMEYRKLVKEDIRPALKDIVWVWQGDEHLNSQSILQGEQQQSPLPPELPQDQLQPSLPQQEKQDMPEPPLLPQVPQEEVQTSIPAEQTKN

SEQ ID NO: 3036 - protein, 135 aa, Zea mays
MRKHRIVSLVAALLVLLALAAVSSTRSTQKESVADNAGMLAGGIKDVPANENDLQLQELARFAVNEHNQKANALLGFEKLVKAKTQVVAGTMYYLTIEVKDGEVKKLYEAKVWEKPWENFKQLQEFKPVEEGASA

SEQ ID NO: 3037 - protein, 539 aa, Oryza sativa
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKHQFVAVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 3038 - protein, 1364 aa, Xanthomonas axonopodis
MPKGRWDLRRTYGRRAFFGALLILSAGLVAAIVTGVWLQRQNELERQQRFDYVVRTLARNIGERMSTFEHGLRGARGAVIGAGSDIISRERFTLYSRSRDYPREFPGVLGYGYIHRVAPADEAAFLQAARADGAPDIHRRPLAPWDGERYMVLYFEPESSGNRPLGIDIASEPRRRAAALQAARSGEPVMTSPISLSGYRIPNESGFLVLLAVYREGMPLQTPQQRMLATSGWVYAPFSVEQMVRSALGERDDVALDLSDRNEPTHNFYRSGTPASDSALRPPVVRLLPIYGRTWVITAHPTAGFVASLNQSSPWLIGGLVMAASVLFAALLVLYFSNGLRREEVLRKQMELAALVSHSSEAIVAQTPDGRITHWNPAAEAMFGYTADEAIDQDLTTLLSPQPYAMSEVDHADAALAGNASAAQTMRHRDGHQVHVLASKAPIIESEGTLSGHSHFFRDISDRVRSHQRIIDLNASLEHQVAERTSELVKFSVLQRAILAHAGYAIIATDSGGFVTLFNPAAEKLLGYSAAEVIGRRKASQFVEQEELQERAHMLAEQTGTQVAHTLEAIAALTSLGRSDTSEWTYVSHDGRRLPVLLTLSTLRDDHDQVIGYLGVAVDLTEQKLHEKQLRLAMDAAKSANQSKSDFLANMSHEIRTPMNAILGMLYLLQRSELPGAAQDMVAKIDRSARTLLEIINDILDFSKIEAGRIDLECAPFDLNQLFDNIADLMRSSLSAKPVEMIVEPLPRDSRWLLGDALRINQVLVNLVGNAIKFTEQGEVVLSVRRFPSGDPNKFKLLFSVRDTGIGISKEKQSVIFSPFLQADTSTSRRYGGSGLGLTISRRLVELMGGELEVESVPGRGSEFYFVVTLEKSAPLQAQRELPVLPPEAMPRVLIADDHDAALNNLVRIATELGWRVDAVASGQAALQAIEHAAEPYDIFLLDWRMPDIDGVAIAREIRARATPGPHPVIVMVTAYERRLLEQHPEQQDLDAVMTKPVTGAALHRLVEQLLEERPGARPATPTFVARRLEGAHLLLVDDSDINCEVAQRILEGEGAMVTVAHDGEQAVSTLKRAPNLFHLVLMDVQMPVVDGYEATRRLRQIPALASLPVIALTAGAFRPQQEKALEAGMNGFIAKPFNVEELVTAIRHFLQPGTRRIPSLPHEAQAHAGPEWKYSDPELLDAARARSLWREREPYARYLIKLLRDNPDPGEIAAEHLRRNELPAIGAMAHKLRGAAGSLALPALAGAAGDLETRIEEGHDITGSLIALKDVMQRTAEAIRAFLQHGDSDVAADEDGAALDADSVQILTSAFASDDADRIDHALLICAPRLPHALQEALQRAVEDFDFRRAETTLREWQTTHPH

SEQ ID NO: 3039 - protein, 516 aa, Pisum sativum
MAVVAAPKKNNSFNKKDNPNLLLGRFELGKLLGHGTFAKVHLAKNIKTGEAVAIKIISKDKILKSGLVSHIKREISILRRVRHPNIVQLFEVMATKTKIYFVMEYVRGGELFNKVAKGRLKEEVARKYFQQLICAVEFCHARGVFHRDIKPENLLLDENGNLKVSDFGLSAVSDEIKQDGLFHTFCGTPAYVAPEVLSRKGYDGGKVDIWSCGVVLFVLMAGYLPFHDPNNVMVMYKKIYKGDFRCPRWFSPELVNLLTRLLDTKPQTRISIPEIMENRWFKIGFKRIKFYVEDDVVCNLDSLGLDGNNGNDGNDDKKVLNIDEHRDEALESVSESEWDSEVVNRRKNRQLGSLPRPASLNAFDIISFSQGFDLSGLFEEKGDEARFVSGASVSKIMTKLEEVAQLVSFKVRKKDCRVSFEGSREGVKGPLSIAAEVFELTPSLVVVEVKKKGGDKVEYDRFLNTELKSALHSLTMEESAGSSCQNTPDETLQQRAFSDSAIDKHSDSIESLNLDT

SEQ ID NO: 3040 - protein, 569 aa, Glycine max
  misc_feature (228)..(228): Xaa can be any naturally occurring amino acid
MCGILAVLGCVDNSQTKRARIIELSRRLRHRGPDWSGIHCYEDCYLAHQRLAIVDPTSGDQPLYNEDKTVIVTVNGEIYNHKQLRQKLSSHQFRTGSDCEVIAHLYEEHGEEFVNMLDGMFAFILLDTRDKSFIAARDAIGITPLYLGWGHDGSTWFASEMKALSDDCERFISFPPGHIYSSKQGGLRRWYNPPWFSEDIPSTPYDPTLLRETFERAVVKRMMTDVGXPPLLSGGLDSSLVAAVVNRYLAESESARQWGSQLHTFCIGLKGSPDLKAAKEVADYLGTRHHELYFTVQEGIDALEEVIYHIETYDVTTIRASTAMFLMSRKIKALGVKMVLSGEGSDEIFGGYLYFHKAPNKKEFHEETCRKIKALHLYDCLRANKSTAAWGVEARVPFLDKEFINVAMSIDPEWKMIRPDLGRIEKWVLRNAFDDDKNPYLPKHILYRQKEQFSDGVGYSWIDGLKDHANKQVTDATMMAANFIYPENTPTTKEGYLYRTIFEKFFPKNAAKATVPGGPSVACSTAKAVEWDAAWSKNLDPSGRAALGIHDAAYDAVDTKIDEPKNGTL

SEQ ID NO: 3041 - protein, 208 aa, Oryza sativa
MASYHQQQGGSTFMAIPTINFQMYSEIAGDDEWWEYIPCPFCYIEVEVPFLCDHLQEEHCFDMKNAVCPICADNLDKDTDEHFRVQHSHLLKRRKSSSFSCKPSSAAADKGSYEEDSYFEAPSHCMGRPAPDSSPDPLLSQFICCSLAPPVDSPRRSEADAEGHGSSSSDDQKRREQGVMDDASKEELEERLQRIEFVKQMLMTTIAY

SEQ ID NO: 3042 - protein, 270 aa, Medicago sativa
HEGQGKSFQAELVFAKMGINPIMMSAGELESGNAGEPAKLIRQRYREASDIIRKGKMCCLFINDLDAGAGRMGGTTQYTVNNQMVNATLMNIADNPTNVQLPGMYNKEDNARVPIIVTGNDFSTLYAPLIRDGRMEKFYWAPTREDRIGVCIGIFRHDNIAKDDIVKIVDTFPGQSIDFFGALRARVYDDEVRKWVSGVGIETIGKKLVNSKEGPPVFEQPKMTLEKLLEYGNMLVSEQENVKRVQLADKYLEGAALGDANQDAIKEGKF

SEQ ID NO: 3043 - protein, 270 aa, Manihot esculenta
KFHWKPTLGVKCLMDDEAQKIGGVNHSHATQDLYDSIAAGNYPEWKLFIQTMDPADEDKFDFDPLDMTKIWPEDMFPLQQLGRLVLNRNIDNWFAENEMLAFDPGHVVPGIHYSNDKLFQLRTFAYADTQRHRLGPNYKMLPVNAPKCNYHNNHYDGFMNFMHRDEEVDYFPSRYDPVRHAERTPLPHAIISGRREKCVIEKENNFKQPGDRYRSWTPDRQERFLCRLVNALSDPRITHEIRSIWVSYWSQCDKSLGQKLASRLNVRPNF

SEQ ID NO: 3044 - protein, 672 aa, Escherichia coli
MSYPSLFAPLDLGFTTLKNRVLMGSMHTGLEEYPDGAERLAAFYAERARHGVALIVSGGIAPDLTGVGMEGGAMLNDASQIPHHRTITEAVHQEGGKIALQILHTGRYSYQPHLVAPSALQAPINRFVPHELTHEEILQLIDDFAHCAQLAREAGYDGVEVMGSEGYLINEFLTLRTNQRSDQWGGDYRNRMRFAVEVVRAVRERVGNDFIIIYRLSMLDLVEGGGTFAEMVELAQAIEAAGATIINTGIGWHEARIPTIATPVPRGAFSWVTRKLKGHVSLPLVTTNRINDPQVADDILSRGDADMVSMARPFLADAELLSKAQSGRADEINTCIGCNQACLDQIFVGKVTSCLVNPRACHETKMPILPAVQKKNLAVVGAGPAGLAFAINAAARGHQVTLFDAHSEIGGQFNIAKQIPGKEEFYETQRYYRRMIEVTGVTLKLNHTVTADQLQAFDETILASGIVPRVPPIDGIDHPNVLSYLDVLRDKAPVGNKVAIIGCGGIGFDTAMYLSQPGESTSQNIAGFCNEWGIDSSLQQAGGLSPQGMQIPRSPRQIVMLQRKASKPGQGLGKTTGWIHRTTLLSRGVKMIPGVSYQKIDDDGLHVVINGETQVLAVDNVVICAGQEPNRALAQPLIDSGKTVHLIGGCDVAMELDARRAIAQGTRLALEI

SEQ ID NO: 3045 - protein, 167 aa, Thiobacillus denitrificans
MLHTLKQAGKNIGRELNRAWESLAEGWRELLSSSGNALTHFARDKDKDEAEQGGPLDFPHWALLAGEVEETEKDVLVRLEVPGMKKEECTITIEGNTLRLSGEKHFAREAHDSTYHVMERAYGVFHRSVPLPRNVDSDKAEASYSNGVLTVRLPKLPGEQARSVPIS

SEQ ID NO: 3046 - protein, 544 aa, Chlamydia trachomatis
MVAKNIKYNEEARKKIQKGVKTLAEAVKVTLGPKGRHVVIDKSFGSPQVTKDGVTVAKEVELADKHENMGAQMVKEVASKTADKAGDGTTTATVLAEAIYTEGLRNVTAGANPMDLKRGIDKAVKVVVDQIRKISKPVQHHKEIAQVATISANNDAEIGNLIAEAMEKVGKNGSITVEEAKGFETVLDVVEGMNFNRGYLSSYFATNPETQECVLEDALVLIYDKKISGIKDFLPVLQQVAESGRPLLIIAEDIEGEALATLVVNRIRGGFRVCAVKAPGFGDRRKAMLEDIAILTGGQLISEELGMKLENANLAMLGKAKKVIVSKEDTTIVEGMGEKEALEARCESIKKQIEDSSSDYDKEKLQERLAKLSGGVAVIRVGAATEIEMKEKKDRVDDAQHATIAAVEEGILPGGGTALIRCIPTLEAFLPMLTNEDEQIGARIVLKALSAPLKQIAANAGKEGAIIFQQVMSRSANEGYDALRDAYTDMLEAGILDPAKVTRSALESAASVAGLLLTTEALIAEIPEEKPAAAPAMPGAGMDY

SEQ ID NO: 3047 - protein, 373 aa, Zea mays
MNINRKWGSQRRYLGRCRCLGQERINVVIAAVNDSQLSYGGPKPANCRSVARYLSRDLPYELSPDDVYLTNGGAQAIEIVCSALARPGANILLPRPGYKLYEARAVFSGMEARYFDLVPGEGWEVDTDSVRALADKNTVAVVIINPGNPCGNVYSYEHLAKASARYFWLALGLVAETARKLGVFVVADEAYAHLTFGERRFVPMGVFGAVAPVITLGSISKRWLVASSIKTYHYICSDPTTFVQGAVPNLLENTSEEFFRRNIRTLKESADMCWEKLKGVNGIACPSRPMGSMFVMVKLDLSCLQGIEDDMDFCCRLAKEESVVVLPGRVVGCEDWLRITFAIDPSSLEDGLDRLRSFCSRHSKPAAQGSAAS

SEQ ID NO: 3048 - protein, 309 aa, Yarrowia lipolytica
MTSIDFTMNNGKTIPAIGLGTWKSTTEEVAGAVECALTEGGYRHIDTAFNYRNEDAVGLGIKRAMEKGVKREDIFVTTKIWVTYHDRVEENLDLSLERLGLDYVDMLLIHWPVPLNPNGNDPVYPLRPDGSRDIDESGSQPKTWKQMEAVLKTGKTKSIGVSNFSIPYLEELLKEAEVVPAVNQVELHPLLPQLELMEFCKKNNIIMTAFSPFGSVGGPLLKNELVLKLADKYETSPGGILTSYHIGNGTVVIPKSVTNSRIIENGKSAVNLSKEDLQALNDLHKTEGIHRTSKPKWGVDLGFPDFDFC

SEQ ID NO: 3049 - protein, 602 aa, Deinococcus radiodurans
MTQTQPVTPTPPASFQTQHDPRTRLGATPLPGGAGTRFRLWTSTARTVAVRVNGTEHVMTSLGGGIYELELPVGPGARYLFVLDGVPTPDPYARFLPDGVHGEAEVVDFGTFDWTDADWHGIKLADCVFYEVHVGTFTPEGTYRAAAEKLPYLKELGVTAIQVMPLAAFDGQRGWGYDGAAFYAPYAPYGRPEDLMALVDAAHRLGLGVFLDVVYNHFGPSGNYLSSYAPSYFTDRFSSAWGMGLDYAEPHMRRYVTGNARMWLRDYHFDGLRLDATPYMTDDSETHILTELAQEIHELGGTHLLLAEDHRNLPDLVTVNHLDGIWTDDFHHETRVTLTGEQEGYYAGYRGGAEALAYTIRRGWRYEGQFWAVKGEEHERGHPSDALEAPNFVYCIQNHDQIGNRPLGERLHQSDGVTLHEYRGAAALLLTLPMTPLLFQGQEWAASTPFQFFSDHAGELGQAVSEGRKKEFGGFSGFSGEDVPDPQAEQTFLNSKLNWAEREGGEHARTLRLYRDLLRLRREDPVLHNRQRENLTTGHDGDVLWVRTVTGAGERVLLWNLGQDTRAVAEVKLPFTVPRRLLLHTEGREDLTLGAGEAVLVG

SEQ ID NO: 3050 - protein, 293 aa, Synechococcus elongatus
MSSEPSDGHDLRRSFRDRQELIDYLQQQFPEAAAVDAQVSPIPGGYQAAIAQLEAINPLRYGKSRNFLDGAVTRLSPYIRHGVLSLATVRDRVLAQIRQRSDGEKLITELAWRDYWQRIYWEWGDRIWRDREPYKTGWDSQQYSEALPPDLQAAETGLACMDRFSRELKETGYLHNHARMWMAAYLVHWRRIRWQAGARWFLQHLLDGDPASNNLSWQWVASTFSTKPYWFNRENLQRYNGDRDCQDCPSRDRCPFDGSYDELADQLFPKAEFRDQPRQGGRWHRDRSNSRQR

SEQ ID NO: 3051 - protein, 492 aa, Secale cereale
MDPCKFRPSSSFDTKTTTTNPGQPVWNDNEALTVGPRGPILLEDYHLLEKIAHFARDIPEPFVHAGRASAKGFFECTHDVTGLTCADFLPSPGAGTPVIVRFSTVIHERGSPETIRDPRGFAVKFYTREGNWDLLGNNFPVFFIRDGIKFPDVIHAFKPNPKSHVQEYWRVFDFLPHHPESLHTFFFLFDDVGIPTDYRHMDGFGVNTYTFVTRAGKSHYIKFHWRPTCGVSCLMDDEATLVGGKNHSHATQDLYDSIDAGNFPEWKLFVQVIDPEQQDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKKNHYDGAMNFMHRDEEVDYYPSRHAPLRHAEPASFPVPTRPVVGKREKTRIKKENDFVQPGERYRSWAPDRQDRFVALRRRLAHPKVSHELRVIWIDFLSKCDKSCGMKVANRLNVKPSM

SEQ ID NO: 3052 - protein, 371 aa, Mesorhizobium loti
MTTLFDPLRAGDLTLANRIVMAPLTRNRSPNAVPGDLSVTYYSQRATAGLIVTEATAISHQGQGYANVPGLYGADQLAGWRRVTDAVHRGGGKIVVQLWHVGRISHNTLQPGGGKPVAPSAIRANSKTFLVKPDGSGEFAETSEPRALDAAELPGIVDDFRRAAKAAIEVAGFDGVEIHGANGYLIDQFLRSGTNHRNDAYGGSIENRTRFLFEVVDAVTGAVGAGRTGIRLSPVTPANDASDSDPQPLFNHVVAGLGGRGLAYIHIVEGATGGARDFSQGDRPFDYEELKATYRKAGGAGAWLVNNGYDKELAEKAVGDGYAELVAFGKLFIANPDLVSRLKRNAELNAPDKATFYGGDARGYTDYPTAA

SEQ ID NO: 3053 - protein, 753 aa, Magnaporthe grisea
MSTPPPKRTDVTYRLRNTPTKTAPESSARGILGGEGWTIQLAQYCDHSCWDALGATSFCFCGDIGGRQPYGKGLVYKMAASLLLLLLCFGRYPWHVGNYQINAYLRVLKSRNMVQYVFTPWKDRGELLQVRRQFFPQQVAQHAPTVASGNGAVAAAGTAASSSFSSSSIVSSSSSSRADKKSAVSRVSMWMQRGGCPHMVESTALLIAAMIADEESMLLPTGKSATDSNSSYAVRASYSAAFSRFVTGLLDSHQDKAHKMSMYSVAKTIGLPATFVELRHQATHEQLPSLTRLRAGAQAGLVWIWDYYWKQLSAAEEDEDQVPVVAGRSAAAPHVEEVPQVVASACRDALRRYLDVGKEDLPTIARFVRRWGSSRVLSVLDAIGDEAGSAQPMDNRLVLGTLKLARQVTEMEQARDNDGSVDFVGDGGAPRSDLGQVPIEVQGVTSDAMVTESQDSKQAGGGWTRLRGSWRQKPIGFSFTPRRTMQVKSIPMFVADFLNRTGYIGVGSSDNYAYLVIDDKTKDAVIIDPANPEEAAPPIKKAIESGEINLKAIVNTHHHWDHSGGNKKFRDALELPDLPIIGGKNCEAVTTTPANGEGFPFGSIQVKGLYTPCHTQDSICWFMQDGDDKVVFTGDTLFHGGCGRFFEGTPEEMNTALNKTLAALPDDTRVFPGHEYTKSNVKFGISVLQSEPVQKLQEFAESNKETQGQFTIGDEKKHNVFMRMDDPVIQKATGETDPVKVMGKLREMKNNFK

SEQ ID NO: 3054 - protein, 363 aa, Unknown
  Rosa hybrid cultivar 'Kardinal'
MGLAENQLSFDVIEEWIKKNPKASICTPEGVAEFKNVANFQDYHGFPDFRKAIANFMSKARGGRVKFDPDRVVMAGGATGANETVMFCLADPGDAFLVPSPYYPAFYRDLGWRTGVKIVPVDCDSSNNFQVTRAALEAAYEKARNNNINIKGLIITNPSNPLGTTVDRDTLTSLVKFINDKNIHLVCDEIYAGTVFSCPKFTCVTEVLQDVKNCNRDLIHIVYSLSKDMGVPGLRIGIVYSYNDAVVNCARKMSSFGLVSSQTQHMLSAMLLDDEFVSNFLETSSKRLARRHRFFTTGLEEVGINCLKGNAGLYCWMDLRKLLKDQTFEAEMVLWRMIINEVKLNVSPGSSFRCVEPGWFRVC

SEQ ID NO: 3055 - protein, 218 aa, Ipomoea batatas
MGRGKVEIRRIEKSTNRRVTFWKRRNGLLKKAMEMGILCDAEVGLMIFSSTGKLHEFATTSIRSVIERYNKTQGDSLQSPLDPTLELKFWQIEVAILRQQLHNMQEDHRKVMGEVYGLSVKDLQNLENQLEMSLSGIRMKKEQILIEQIQELTHKQGSFVHQENFELFNKFQAYGTSDPNAVNGDTISPYDFTISEESQGHIHFQLPQNFSDLARALY

SEQ ID NO: 3056 - protein, 366 aa, Pseudomonas fluorescens
MTKQTLFSPYTLGSLTLSNRVVLAPLTRNRAGQGFVPSEFAAVYYSQRASAGLLISEATQISQQGQGYQDTPGIYTQAQIDGWRTVTDAVHAKGGKIFLQLWHVGRVSHVDLQENGAAPVAPSALRAATKVFVNNRFEDVSEPRALETSELPGIVSDFRQAAANAVAAGFDGVEIHGANGYLLDQFLRDNANLRTDAYGGSIENRARLLLEVTAAVINEIGADRTGVRLSPVSPANGVSSSDPQAQFNYIVEQLDALGVVYLHMVEGATGGPRDVAPFDFGALRQRFKNTYIANNGYDLDLAAARLAEDQADLIAFGRPFIANPDLVERLKQGAPLSAFNPATLYGGGAAGYIDYPTLAESSVSAS

SEQ ID NO: 3057 - protein, 414 aa, Anabaena variabilis
MQKQFFRLGFSLLVALSLAVGVVVQPATALTEEQKLVSEVWRIVNRSYLDETFNHQNWANVRQKALEKPLTDHKAAYGAIQNMLKTLGDPFTRFLDPEQYRSLQVSTSGELTGVGLQIALNPQSGKLEVVSPIAGSPADQAGIKPRDRIVKIEGISTTDLTLDEAATRMRGPIGSLVTLVIERDGEGEKEIRIVRDRIALNPVVAELRSSPEGKSFGYLRLTQFNANASMELAHAISSLEKKGAAAYILDLRNNPGGLLQAGIEIARQWLDSGTIVYTVNRQGIQGSFEAFGPALTDDPLIILVNQGTASASEILAGALQDNGRAQLVGETTFGKGLIQSLFELSDGSGLAVTIAKYETPNHRDINKLGIKPDTVVTQQILTRDEIATETDLQYQAALDLLSKNSVVAGIGNKG

SEQ ID NO: 3058 - protein, 433 aa, Arabidopsis thaliana
MSLKIKFLLLLVLYHHVDSASIVKFLPGFEGPLPFELETGYIGIGEDENVQFFYYFIKSENNPKEDPLLIWLNGGPGCSCLGGIIFENGPVGLKFEVFNGSAPSLFSTTYSWTKMANIIFLDQPVGSGFSYSKTPIDKTGDISEVKRTHEFLQKWLSRHPQYFSNPLYVVGDSYSGMIVPALVQEISQGNYICCEPPINLQGYMLGNPVTYMDFEQNFRIPYAYGMGLISDEIYEPMKRICNGNYYNVDPSNTQCLKLTEEYHKCTAKINIHHILTPDCDVTNVTSPDCYYYPYHLIECWANDESVREALHIEKGSKGKWARCNRTIPYNHDIVSSIPYHMNNSISGYRSLIYSGDHDIAVPFLATQAWIRSLNYSPIHNWRPWMINNQIAGYTRAYSNKMTFATIKGGGHTAEYRPNETFIMFQRWISGQPL

SEQ ID NO: 3059 - protein, 313 aa, Ceratopteris richardii
MAMPCSDIDLLDSDNDNVDDQHISLELRQVHEDTDDGSHDEPRELSLLNHESNLCKIVNSKGKGAEAGNSLLPSTGTSRGKIQIRRIENTTSRQVTFSKRRNGLLKKAHELSVLCDAEIALIIFSSTGKLFEYSSSRGIKKILERYKRCSGILQDVGGTVIRDVEYWKQEAERLKERLTYMEEIQRNMLGESLGSLQIKDLQNLEAKLDSGLYKIRGAKTQLMARQVQELQKKEQILLQQNEALRAKLAELSCLQAPVSGLTTATTSQDVQESSSGRGSRQRETSLSAAETTLQLASHNEQTFLLRAVPHMRL

SEQ ID NO: 3060 - protein, 236 aa, Ceratopteris richardii
TQKASELGNIHRKSAVSLLSDMSLDKSDTNINASGVTHSPLETESDTRSNLQSSNQPPYRSPRIAIRRVDNATNRQVTFSKRRNGLLKKASELSILCDAEIAAIVFSSTGRLSEFASSSMDKIIRRYEDLQSQSASRALLHQREYWKNQALHLRRQVGCMNDIQSCIMGENAAALSLDELQNTEARLQIALDKIRTRRNELLAMQTQNIISKGNGLWIENTLLRKRSTSAYDGEMP

SEQ ID NO: 3061 - protein, 745 aa, Unknown
  Shewanella sp. MR-4
MMTQAQTYFYDGSDVALLNGQYTDVFSLLGMHSINEGKALVVRCFLRNAQKVDVISLKDGRKVASLERVNEAGLFAGTLGRRVKPFLYALRVVYPLCELDIIDPYQFGSLLDSQDLYLFGEGSSEQAYRFLGANWRQVDSVEGVHFCVWAPNAKRVSVVGDFNHWDDTRHVMRQHMANGLWEIFLPDVAEGTHYKFDLVYQNGERHAKSDPMATQMECAPHNASIVPKKHQHPWADTQWMHKRATTAWHRAAMSIYEVQLGSWRRKGEFGEQYFDYQDLIEQLIPYVKEQGFTHIELMPVSEYPFDGSWGYQPVGLYAPTHRFGDANGLKAFIDACHQAEIGVLLDWVAAHFPKDPHGLVRFDGTCLYEHEDPRKGTHPDWDTLIYNYDRGEVRSFLLSNACYWLREFHLDGLRLDAVSSMLYLDYSREPGQWLPNAYGGRENLEAIHFLQMLNQRLYQAFPGICMIAEESTAFAGVTKPTDSGGLGFGFKWNMGWMNDSLSYLGRDPIYRQYHHNQLTFSLMYAYSEQFMLSISHDEVVHGKGSLLHKIPGDDWQKFATLKAYYGFMWGHPGKKLLFMGSEFAQRDEWNHNHSLDWHLLAFEPHQGVQRWLRDLNQLYRQFPALSVLDYESQGFRWLDCDNGRDSIFSFVRYGEGSDVPLVFVVNMTPTLHQGFRIGLPQGGDFCEYLNSDSHLYGGSNQGNAGKVIAEDLPWQGMASSALITVPPLGCLILGPATDAPRDTSL

SEQ ID NO: 3062 - protein, 281 aa, Picea mariana
AAGSGYWKATGADKPITAKGGKKRVGVKKALVFYVGKAPNGSKTNWLMHEYRVTNVSRPVKKKNSLILDDWVLCRIYNRRISAEKLALQQKESFNDVPMETIDEKEMENQLTSTSIEHSGIEQSNPSFDHLSKLGSSPTCYNSAPLCVSPMNSNICLQNLDFFQNSTTPFSDSTLKAPVQNTTFNPISSSINHQWTNCNSTDLMSGLHNDSSCSKPSSFSEPISEKEEVQSSFRLENFSQEQQQSLFNFGLEGLQNTFTHLDQITLPGAYQDWFYPNEPFH

SEQ ID NO: 3063 - protein, 469 aa, Rickettsia conorii
MTLCLKNTHIWSIMLLRLIITLFFIINSICAFAEGEKETENKISNQEAYKQFQDVFERIEKAYVQVPDRQKMIDEAINGMLNSLDPHSSYYTDEDLEDIVTFTKGEFGGIGVEIMYDSGAIKIISPIDDLPAFKAGLKGGDYIVGVNDELVSTLGPNKAIKEMRGTPGTKVKLLIIKEEEAKPQELELTREIVKIKPIKAHLEKNNIAYIRITTFNESTISELKAAVKKLKTESKDDLKGIILDLRNNAGGILDQAIAVSDYFIDSGVIVTTKGRTTSSNSEIKANEFSLKAPKVPMIVLINGNSASASEIVAGALQDHKRAIILGTKSFGKGSVQALTQINSRAAVKLTISKYYTPSGRSIQAEGIEPDILIEPAKVEYPEVKKIDKRFSESSLKNYLKNDNEKNKDNASKNKDSQKETKAKNNKQEENELSELYKKDYQFARAYDVITGLIINKKLETKERVKQEDK

SEQ ID NO: 3064 - protein, 404 aa, Pasteurella multocida
MAHFPKSDKLEHVCYDIRGPVHKEALRLEEEGHKILKLNIGNPAPFGFEAPDEILVDVIRNLPTAQGYCDSKGLYSARKAIVQYYQSKGIHGATVNDVYIGNGVSELITMSLQALLNDGDEVLIPMPDYPLWTAAATLAGGKPVHYLCDEEANWFPDVNDIKSKITKRTKAIVVINPNNPTGAVYSQDLLLEIIEVARQHKLIIFADEIYDKILYDDAVHHHIAALAPDILTVTFNGLSKAYRVAGFRQGWMILNGPKKAAAGYIEGLDMLASMRLCANVPMQHAIQTALGGYQSINEFILPGGRLLEQRNKAYELINQIPGVSCIKPQGAMYMFPKIDIKKFNIYDDEKMVFDLLAQEKVLLVHGRGFNWHSPDHFRIVTLPHVHQIEEALTKLARFLAHYHQ

SEQ ID NO: 3065 - protein, 602 aa, Deinococcus radiodurans
  misc_feature (1)..(1): Xaa can be any naturally occurring amino acid
  misc_feature (59)..(59): Xaa can be any naturally occurring amino acid
  misc_feature (164)..(164): Xaa can be any naturally occurring amino acid
  misc_feature (196)..(196): Xaa can be any naturally occurring amino acid
  misc_feature (243)..(243): Xaa can be any naturally occurring amino acid
  misc_feature (252)..(252): Xaa can be any naturally occurring amino acid
  misc_feature (262)..(262): Xaa can be any naturally occurring amino acid
  misc_feature (280)..(280): Xaa can be any naturally occurring amino acid
  misc_feature (434)..(434): Xaa can be any naturally occurring amino acid
XTQTQPVTPTPPASFQTQHDPRTRLGATPLPGGAGTRFRLWTSTARTVAVRVNGTEHVXTSLGGGIYELELPVGPGARYLFVLDGVPTPDPYARFLPDGVHGEAEVVDFGTFDWTDADWHGIKLADCVFYEVHVGTFTPEGTYRAAAEKLPYLKELGVTAIQVXPLAAFDGQRGWGYDGAAFYAPYAPYGRPEDLXALVDAAHRLGLGVFLDVVYNHFGPSGNYLSSYAPSYFTDRFSSAWGXGLDYAEPHXRRYVTGNARXWLRDYHFDGLRLDATPYXTDDSETHILTELAQEIHELGGTHLLLAEDHRNLPDLVTVNHLDGIWTDDFHHETRVTLTGEQEGYYAGYRGGAEALAYTIRRGWRYEGQFWAVKGEEHERGHPSDALEAPNFVYCIQNHDQIGNRPLGERLHQSDGVTLHEYRGAAALLLTLPXTPLLFQGQEWAASTPFQFFSDHAGELGQAVSEGRKKEFGGFSGFSGEDVPDPQAEQTFLNSKLNWAEREGGEHARTLRLYRDLLRLRREDPVLHNRQRENLTTGHDGDVLWVRTVTGAGERVLLWNLGQDTRAVAEVKLPFTVPRRLLLHTEGREDLTLGAGEAVLVG

SEQ ID NO: 3066 - protein, 542 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQVH

SEQ ID NO: 3067 - protein, 362 aa, Erwinia carotovora
MSALFQPFKLKDITLRNRIAVPPMCTYSANDGLINEWHEVHYASLARGGAGLVIVEATAVAPEGRISPRCTGIWNDEQAQAFAKVAKSIKDAGSVPGIQIGHAGRKASANIPWEGDDHIPAGDSRGWQTIAPSAAPFGANLPKQPQEMTLEDIARVRDDFVAAARRALEAGFEWLELHFAHGYLAQSFFSAHSNKRNDQYGGSFENRSRFLLETLAAVRDVWPQHLPLTARFGVIEFDGRDEETLQESIELTRRFKAAGLDMLSVSIGFSTPEANIPWAPAFMGPIAQQVREQADLPVSSAWGFGTPELAEQAVASDQLDLVMVGKAHLANPHWSYQAARELGIDRASWTLPTPYAHWLERY

SEQ ID NO: 3068 - protein, 243 aa, Zea mays
ASRYDICLHVDLCLGGFVLPFAHKLGYPIPPFDFSVKGVTSISSDVHKYGLAPKGTSIVLYRNHEIRKHQFVAVTEWTGGLYVSPTIAGSRPGGLIAGAWAAMMSLGLNGYLDSTSRIMDVSKKIQRGIGEIPGLFVIGKPDMTVVAFGSDVVDIFEVNDIMSSKGWHLNALQRPNSLHICVTLQHTTVYDQFLKDLQDSVNTVKANPGPISGGKAPIYGAAGKMPDRGTVRELLVEFMDSSC

SEQ ID NO: 3069 - protein, 403 aa, Citrus sinensis
MAFALSNQEQLLSKIAAGNGHGEDSPYFDGWKAFESDPYHPTKNPNGVIQMGLAENLLCHELVEDWLMNNPKASICSAEGLNEFKGIANFQDYHGLPEFRNAVAKFMGKVRGNRVTFDPDRIVMSGGATGAHETVAFCLADPGDAFLVPTPYYPGFDRDLRWRTGVQLVPVVCDSSNDFKVTMEALEAAYEKAQESNIRIKGVLITNPSNPLGTFLDRETLKDIVSFINEKNIHLVCDEIYAATVFTKESSFVSIAEIIDQDIACNRNLIHIVYSLSKDMGFPGFRVGIIYSYNDQVVSCARKMSSFGLVSSQTQHLIATMLSDDQFVEKFIAESAKRIAERHKAFTWGLSQVGIGCLKSNAGLFLWMDLHHLLKEQTYEAEMALWQVIINEVKLNVKKKKKK

SEQ ID NO: 3070 - protein, 616 aa, Rhodospirillum rubrum
MCGLVAILERRGPADEAAVSKALARLARRGPDGEGRAAFWDGRLLLGHRRLAIFGKGADGAQPMVDPETGSVLVFNGALYNYVELRQALQALGQRFAGESDTEVALLAWRQWGEAAFARFNGMWAMVLLDAPGDRLVVSRDRLGVKPLYLCDTGGRVTFASTIAATLAASGIAPRVDDDAVFDFLVGGLTDHRGGSFFAGIVEVPAGALWSVDRSGGIDRRRFHDWRKEGSGEAAPPSAEALRATLSDAVRLRLRADVPAVALLSGGLDSSIVTRLATAPDMPRGALAGLLTYGYRDATEADETREAGRFAATLDSALPHDILRVAPLPAAPDLDALLAAQEQPFNTPSLVAAFRLYRLIAARGVKVAITGEGADELFAGYTNRYGALLAREHLRLGRLRPLGALLGSAHCPPRLVANRLAWDLPLAIVRPLMAGRVHGRVIARSFWQDSAERFEALAAYHHQPLASRLRDDALRALLPYSLRFADRSGMASGVEVRSPFLDYRVVEAALALPVAAKIDDRGGKRILRQAFRHDLPAEIIGAGKTHGLGMAEQFQVGHLDWAALAEAPPTLAARYLDLGRLKTALAAHPSDPRLWWPLCLLRWLAWVEGGMADAPR

SEQ ID NO: 3071 - protein, 90 aa, Unknown
  Oryza
MARIRARGSSRVDLARFAVTEHNKKANSLLEFEKLVSVKQQVVAGTLYYFTIEVKEGDAKKLYEAKVWEKPWMDFKELQEFKPVDASANA

SEQ ID NO: 3072 - protein, 404 aa, Neisseria meningitidis
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLDDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKSYRVAGFRQGWMVLNGPKHHAKGYIEGLDMLSSMRLCANTPMQHAIQTALGGYQSINEFILPGGRLLEQRNRAWELVSQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 3073 - protein, 389 aa, Zea mays
  misc_feature (57)..(57): Xaa can be any naturally occurring amino acid
  misc_feature (305)..(305): Xaa can be any naturally occurring amino acid
MEGAGGGAGGGGAGAGGCLGMGHGGEAQIKGTHTHGGRYVQYNVYGNLLEVSAKYVXPIRPVGRGACGIICAAVNAQTREEVAIKKIGNAFDNQIDAKRTLREIKLLRHMNHENVISIKDIIRPPRRENFNDVYIVYELMDTDLHHLLRSNQQLTDDHCQYFVYQLLRGLKYVHSANVLHRDLRPSNMLLNAKCDLKIGDFGLARTTTETDFMMEYVVTRWYRAPELLLNCSEYTQAIDMWSVGCIFGEMVTREPLFPGKDYVHQLRLITELVGSPDDTSLGFLRSDHARRYVRSLPQHPKQQFXVRFPTMSSGAMDLLERMLVFDPSKRITVDEALCHPYLASLHEVNDEPICPAPFSFDFEQPSLTEEAIKELIWKESLKFNPDPIH

SEQ ID NO: 3074 - protein, 371 aa, Lactobacillus plantarum
MQAKYKKLFEPYTLNNDVVLKNRLVVAPLTIYDSGPDGELTPAAHNFWRNRFRGFGTWIVPFTNVHPSGIGFESPNAFHEENLPTLKAYATISHEQGAKAIIQLAHAGIHADPAMTKGYDLMGPSNLPYMGVRAMTDSEVREMVNAFAYATELAISAGLDGVEIHGANGWLIQQFVSETYNQRTDHWGGSVEKRFNFPLAIIDAIEAVRHKYHRPDFIVGYRFSPEEPGEVGLTMTETLALVDRLLDKPLQYIHISLWNFYKKIRRGGDVKKTRMEAVHDRINGRLPFIGVGDLFAEEQGLKAFNTGWADLLAVGGSVELNPNLIELIKTGQEDQIQSEFDWNEMDSYRFTPAMLYGTLAGNAMFPKVKQN

SEQ ID NO: 3075 - protein, 543 aa, Mesorhizobium loti
MSAKEIKFATDARDRMLRGVEILTNAVKVTLGPKGRNVIIDKAYGAPRITKDGVTVAKEIELADKFENMGAQMVREVASKTNDLAGDGTTTATVLAASILREGAKLVAAGMNPMDLKRGIDQAVAAVVVEIKAKAKKVKSSAEIAQVGTIAANGDATVGAMIAKAMDKVGNDGVITVEEAKTAETELDVVEGMQFDRGYLSPYFVTNADKMRVELEEPYVLIHEKKLGNLQAMLPILEAVVQSGRPLLIISEDVEGEALATLVVNKLRGGLKVAAVKAPGFGDRRKAMLEDIAVLTAGQMISEDLGIKLENVTIEMLGRAKRVLIEKDTTTIIDGAGTKATIQARVAQIKGQIEETTSDYDKEKLQERLAKLSGGVAVIRVGGVTESEVKEKKDRIDDALNATRAAVEEGIVPGGGVALLRARSALSGLNGANADVTAGISIVLRALEAPIRQIAENSGVEGSIVVGKLADSKDHNLGFDAQNETYVDMIKAGIVDPAKVVRTALQDAGSIAALLITAEAMITDIPAKDAAPAGGGGGGMGGY

SEQ ID NO: 3076 - protein, 343 aa, Kineococcus radiotolerans
MSDEHAPVDPALVPRRELRGGATVPAIGIGTFGSDRYSPAEVAAAVAGAVAAGYRLVDCAAVYGNEAQVGEALAGAVAGGVDRDELFVVSKVWNDAHAPADAVASVHRSLRDLRLDHLDAVFVHWPFPNHHPPMADTDARDPRARPYDHDAYLALWGALEGLVDSGLVRHLGTSNTTVAKLDLLLRDARIPPALNEMELHPCFQQPELFAHCVRHGIQPVGYSPLGSPSRPERDRTPGDVVDTEDPVVVRIAREHGVHPALVCLKWAVARGQVPIPFSVKPAQYTANLRAVVEDPLTAQEVADLAAADRGERLIKGQVFLWPGAESWRDLWDEDGTIVGWTER

SEQ ID NO: 3077 - protein, 357 aa, Unknown
  Magnetococcus sp. MC-1
MNHLFKPLRIGDLELPNRLLMAPLTRCRADAQHVPTAMMVDYYAQRASAGLLITEATMVMQGYSAFWREPGIYSDAQIEGWKKITQAVHAKGGRIFMQIWHGGRACHPLLNDGREAVAPSPLAIAHDEVHTPQGKQPYTLPRALRDDELPAIVNGFARAARHARAAGFDGVEVHGANGYLLDQFLRDGSNHRSGAYGGSVENRARLLLEVIEAVSLAWGSERVGLRISPLNSFNDMIDSDPMGLAEWLAKRLNAYPLAYLHLMRRDFLGQQQGDVVPLVRQHYKGTLIGNMGYGGEEAEAAIAAGQLDGVAFGSAYLANPDLPERLRCGAPLNTPDPTTFYTQGAEGYTDYPTLAQG

SEQ ID NO: 3078 - protein, 923 aa, Pseudomonas putida
MRRLRIASALIVSLLTLLCMFPAAAEHDGGWTVLLDEQANLQLSDVRSERYRNQFSPLPLADLDAAPAGQALWLHYRLAPGDQEQLLRVFAPDLSGLDLYALEGEQLLRQLHHGRQAGNASPTLRGSDHVLPLPNSRQPLDIYLRLVSEHQLRPAISLEPAAEAASDQRQPLLFGMLFGGLIMLIMHNLIRFLYTRSSTTLILALYHGLMLLSGLILLNLSGPWWHVWHSAQTPAAYLTLVLAGLSGLYFTQHFFSPCNSPRLNRLLQGEMLIVGLSGLVLLFVDTLPLNLMTYALMALGSVSMLLVSSYHWYKGYAPGRLFSLAMVVFNLGGLVLLPALLGLTRTSTPWLLCILLGLTVVSGLLLNLAVSERLRRISEERFSASRALAASDAEINAKAEFLAKISHEIRTPMNGVLGMTELLLGTPLSVKQRDYVQTIHSAGNELLTLINEILDISKLESRQIELDDVQFDLNALIEDCLNIFRAKAEQQNIELISFTQPQVPRVISGDPTRLRQALSSLLENALKNTDQGEILLVVALDQRGEVPRLRIAVQDSGEPLPAADREALLQAELHSHHFLSSNKLGGHLGLVIAKQLIGLMQGEFGIKSSTGMGNTLWLTLPLDPSRLEQPPADLDSPLRDARVLVVDDNDTCRKVLVQQCSAWGMNVSAVPSGKEALALLRTKAHLRDYFDAVLLDQNMPGMTGMQLAAKIKEDPSLNHDILVVMLTGISNAPSKVIARNAGVKRILAKPVAGYTLKTTLAEELAQRGREQAMPASLPGIPQALDLPGDFRVLVAEDNSISTKVIRSMLGKLNLKPDTACNGEEALQAMKAQHYDLVLMDCEMPILDGFSATQQLRAWEAENQRQRTPVVALTAHILAEHKERARLAGMDGHMAKPVELSQLRELIQYWANHREAKVDPAHTS

SEQ ID NO: 3079 - protein, 151 aa, Coxiella burnetii
MAKAVQKYPHSMLSHLQQDINRLFEPFGWATGGELWDAFSSEWSPHIDIKDEGQNYLICADIPGVDPKKIQVSMENNILTIKGERETEAKEKSEGYLRIERTKGAFLRQFTLPESVDAESIKAKSKHGVLEITIPKAQPPRTKKIEIEEQE

SEQ ID NO: 3080 - protein, 371 aa, Berberidopsis corallina
AAGALKSYKLAAKAISRLQSLPSGTISLLCDVLVQEVSDLTGYDRVMVYKFHDDEHGEVVAECRRPELEPYLGLHYPATDIPQASRFLFMKNKVRMICDCLAPPVKVIQDKRLAQPLSLCGSTLRSPHACHAQYMANMGSIASLVMSVTINEEDDEMESDQQKGRKLWGLVVCHHTSPRFVPFPLRYACEFLIQVFGVQVNKEVELAAQLREKHILRTQTVLCDMLLRDAPVGIVTQSPNVMDLVKCDGAALYYRNKFWLLGVIPTEAQIRDIAEWLLEYHGGSRGLSTDSLMEAGYPGALVLGDAVCGMAAIRITSKDFLFWFRSHTAKEIKWGGAKHDPDDKDDGRKMHPRSSFKAFLEVVKRRSLPWE

SEQ ID NO: 3081 - protein, 391 aa, Carallia brachiata
DLEPVNPADVPVTAAGALKSYKLAAKAISRLQSLPSRNMSLLCEVLVKEVRDLTGYDRVMVYRFHDDEHGEVVAESCRTDLEPYLGLHFPATDIPQASRFLFMKNKVRMICDCLAPPVKVVQDRRLAQPLSLCGSTLRAPHGCHAQYMANMGSIASLVMSVTINEDDAEMDSGQQNGRKLWGLVVCHHTSPRFVPFPLRYACEFLIQVFGVQINKEVELATQMREKHILQTQTVLCDMLLRDAPVAIVTQSPNVMDLVKCDGAVLYYRKKTWLLGITPTEAQISDIAEWLLECHSGTTGLSTDSLMEAGYPGASDLGDAVCGMAAVKITAKDFLFWFRSHTAKEIKWGGAKHDPHNKDDGKMMHPRSSFKAFLEVVKWRSLPWEDMEMDAI

SEQ ID NO: 3082 - protein, 1364 aa, Cochliobolus heterostrophus
MTEDIAGNEGDYFAMESRSRPESPSSIRSDPMSMHLTAPSATIASLTALQYLPIPVLVLSSQKTVILANEALGRLFNIDFESIHHLSITEALQGKTMGELGVDIIQNGSPILITWEAFLDCVVNDAVADNMDTDGDSYMTSGHTTPTADNTGHQQNKQQSQSLPPLSSTNLARTTVHDVSVDVVVVPLAIGSDDTLQKCDRKGSYSDAVQASCIVSIWSIEDTQYYTLTFTSATQAQDSKKAQPSTRMVNRTNTGVRLDKSRSSGSSTSSSRRSNNSSNTTSKIVTPTLQQPEFPPRGPPSKNKSDIANSASVFQKATQLKDAILNSITMPAYAMWKDESFGIPNKALLRLVPKDTSYLSGDQRDFLAQFSCWTEDFQRRLPIEEFPIIEVCRHKKRVEKHRLGIRHPVTGSGMVYEVNGEPVFHEETGEFLGGIVVFKDVTEYTQKIAEQIEQNEKQFEYITNFMPVMVWTTTPDGMHDWFSKRWYDYTGLTVDKSLGEGWRLPFHPDDMHATAERWFHSLKTGDEYNTEYRCQRFDGQWRWMLGRAVPFYDDAGRIVKWFGTCTDIHDLVLARQEARQTREQLQQVIQHAKIVLWVIDRNNRVKVLEGDIDANEHLSKDQLLGKDVYDVFEFTDNNRERWRGPIQEILQGKQSDEIVNGGYMSENRYYRTRLVPLMSTSRTAGIESQAFVDGVIGVSMDITELREREEQLKEQEKENSRLLANEAAAKEASRMKSQFLANMSHEIRTPIAGVIGMSELLFDMDLNEEQKECAENIHRSANSLLTVINDILDFSKVESGRLDVEEVQFSLSVVLRDVNKMMAFAANRKGLEYQSLIQDEVQSDLRVIGDPGRLRQILTNVLTNSIKFTSVGTVQLSVSISHETKETVTVNFSIVDTGIGIEEEVRKRLFQPFSQADSSTARRFGGTGLGLTISKNLVELMKGQIWLDSKLGQGTTATFWIPFTRAPSQDGESPLVHLESIPDRLQSDMSVSCGSSEGHTPPLTPQISNGTSAYPMFKSAIPDQFMSLSESERQNVHVLVVEDNHINQQIALKTIKKLQFSVNAVWNGQEALEYLAKEFGPLHPRPDIILMDVQMPIRDGYSATHAIRTEAPWRNMPEVQGVPIVAMTASAIQGDKEKCVSCGMDDYLAKPVKGKILEKMLVKWALEGRRKAARETPCTNDKDRRSKTVPNPGNNFSASDHPRTAGMSLESETTAQALTAELDRLHYQSDAAFARSSENESERAMRRIHAEERDRKLRDEKLFSLVGPQLLHHEASEGPHSEPSMPLTVENIEKLVHEQDADGSVTRKSPSPDEMGSSATNHVPHIMSEDNNNNNNNHLDVSRPGLQQVRNRESEQTIVEQVAR

SEQ ID NO: 3083 - protein, 807 aa, Cryptococcus neoformans
MTSPSAQPMIPRSQPPRPSHTQSSPAINSTGIKPNGSPSVIRRAPSVPVNPSTAAASGSLSSLLKSENTAQAVSRSSPPTEPNDLPRPIEPTPMLPITGLPNSSSSSSNARHGSSSSISRGPSVTGTLTPATTALGAPIEPTPPQTGASKMAAAAKRGLDGSAGNNVKVYEEGHPLNEETLKQRGYQTLNILNHPFHLPDRWKLLRPLGQGAYGLVIQVQDAETEIPIAVKCVTRVFDKVILARRALREITLLRHFGEHDNLTGLVDMDNVWDGYNEIYLYMEPMEADLHQIIRSGQPLGNAHIQFFIYQLLRGMKYIHSANVIHRDLKPGNLLVNSGCELKICDFGLARGFNPVRGEEPQGEEGKLTEYVATRWYRAPEIMLSNRRYTTAIDVWSIGCILAELLGLKPVFKGKDYIEQMTLILETLGTPDEETMARVASEKALTFLKTLPTYEKKDLGSIFPDADPLAVDLTDKLLEFDPTRRIDVPSALTHAYVERYHDPEDEPSCDKIFDKWEEVESLSTIEELKEAITREIQGFREEVRMAAEEDDEDEEWAEGEYLDDENVFHDSPGPALASTLEKFTYPDHIAPSSSILPSAARLAPIIHQSPKGSKSPHVKSAHLPSVPSSANSSKPSSTAGSAPRTREHSPTTTFITPAEDYFTAQHGFGGPNGRASRRSSSHSTSGRRPASFLFSPFGAGMTQIVPTPNAYPRSHAQASPELTTAEKTPRDRRSSGLWRTRSRAQSQSGNLVLERLSSLEINDHKDGEKNRIDALHAVVGLGGDGEVPPMTVSPSDAPPSEVPKSFGY

SEQ ID NO: 3084 - protein, 472 aa, Coxiella burnetii
MTTIFWFRQDLRLSDNPALVEAAKSADHLIPLYILDDQLKMLGDAQRWWLHHSLSSLQTALSKKGTSLILKKGDTKRVLLELIKKYKVEKIYWNRSYEPPYREIDTYLENRLPPLSVEIYHSTLLTEPQKIKNKSGGYYKIFTPFWKHINASLQPRKTLAAPKKFSQHRAIKSDNLETWNLLPKHPDWSQGFDQWKPGEKNAQIVLKKFIKENLKNYPAHRDRPDISSTSHLSPYLHFGEISIRQVWTAITQATIQDKNLQKAADVFLRQLIWREFAYYLLWHFPQMGRSNFRNQFDNFKWKKNKNWLRAWQKGLTGYPIVDAGMRELWCTGYMHNRVRMIVASFLVKDLMIDWREGEKWFWNTLLDADLANNALGWQWIAGCGPDAAPYFRIFNPILQSKKFDPDGTYIKRWIPELAKVPSKYIHYPADMPDNISESSKVNLGVDYPFPIVNHHKAKELALKAYKDSTYRL

SEQ ID NO: 3085 - protein, 391 aa, Celastrus scandens
  misc_feature (303)..(303): Xaa can be any naturally occurring amino acid
  misc_feature (389)..(389): Xaa can be any naturally occurring amino acid
DLEPVNPADVPITAAGALKSYKLAAKAISRLQSLPSSNMSLLCDVLVKEVSELTGYDRVMVYKFHDDDHGEVVAECCIPDLEPYLGLHYPATDIPQASRFLFMKNKVRMICDCLAPPVKVLQDKRLAQPLSLCGSTLRSPHGCHAQYMANMGSIASLVMSLTINEDDDETNSDQQKRRKLWGLVVCHHTTPRFVPFPLRYACEFLIQVFGGQINKEVELATQLKEKHILRTQTLLCDMLLRDSPVGILTQSPNVMDLVKCDGAALYYRNKFWLLGVTPTEIQIKDIAEWLLDYHSESTGLSTXSLMEAGYPDASILGEAVCGMAAVKITSKDFLFWFRSHTAKEMKWGGAKHDPADKDDGRRMHPRSSFKAFLEVVKRRSLPWEDVEMXAI

SEQ ID NO: 3086 - protein, 392 aa, Cissus sicyoides
DLEPVNPADVPITAAGALKSYKLAAKAISRLQSLPSGNISLLCDVLVKEVTELTGYDRVMVYKFHEDEHGEVIAECLRADLEPYIGLHYPATDIPQASRFLFMKNKVRMICDCLAPPVKIVQDKRLAQPLSLCGSTLRSPHGCHAQYMSNMGSVASLVMSATVNEEDEDDTESEQQKGRKLWGLVVCHNTSPRFVPFPLRYACEFLIQVFGVQINKEMELAAQMKEKHILQTQTVLCDMLLRDAPVGIVTQSPNVMDLVRCDGAALYYQKKFWLLGVTPTEAQIRDIVDWLLECHSGSTGLSTDSLMEAGYPAAPALGDAVCGIAAIKITSNDFLLWFRSHTAKEIKWSGAKHDPDDKDDGRKMHPRSSFKAFLEVVKRRSLPWQDIEMDAI

SEQ ID NO: 3087 - protein, 241 aa, Populus trichocarpa
MGRGRVQLKRIENKINRQVTFSKRRTGLLKKAHEISVLCDAEVALIVFSHKGKLFEYSTNACMEKILERHERYSYAERQLVATDLDSQGNWTLEYNRLKAKVELLQRNHRHYLGEDLDSVSLKELQNLEQQIDTALKLIRERKNHLMYQSISELQIKEKAIKEQNNMLVKQIKEKEKALAQPALWDQQDHGPNASSFLLPQPPLPCLNISYQEEDPEARRNYELDLTLEPIYSCHLGCFGT

SEQ ID NO: 3088 - protein, 1130 aa, Monotropastrum globosum
MSSSRPTQSSGSSGRSKHSARIIAQTTVDAKLHADFEESGGSFDYSTSVRFTGTVGGDIQPRSDKVTTAYLHQIQRGKLIQPFGCLLAVDEKTFKVIAYSENAPEMLTMVSHAVPSVGDHPLLGIGTDVRTIFTNPSAAALQKAMGYGEVSLLNPILVHCKTSGKPFYAIVHRVTGSLIIDFEPVKPYEVPMTAAGALQSYKLAAKAITRLQSLPSGNMRILCDAMVQEVFELTGYDRVMVYKFHDDDHGEVFSELTKPGLEPYLGLHYPATDIPQAARFLFMKNKIRMICDCHAKQVKVIQDDKLPIDLTLCGSTLRAPHSCHLQYMENMNSIASLVMSVVVNEGDEEGDGGGSSVSSNQQQKIKRLWGLLVCHNTTPRFVPFPLRYACEFLAQVFTIHVNKELELENQIHEKNILRTQTLLCDMLMRDAPLGIVSQSPNVMDLVKCDGAVLLYKDKTYRMGTTPTDFQLRDIVYWLSEYHTDSTGLSTDSLYDAGYPGALAFGDGVCGMAAVKITSNDMLFWFKAQTAAEIQWGGAKHESGERDDGRKMHPRSSFKAFLEVVKTRSLPWKDYEMDAIHSLQLILRNAFKDTKAMDATTDVIHTRLHDLKIEGMEELEAVTSEMVRLIETATVPILAVDVDGLVNGWNLKIAELTGLPVDKAIGRDLLSLVEDSSTGIVKKMLDLALQGKEEQNIQFELKTDESRRDSGPISLVVNACASRDHHENVVGVCFVAQDITGHKTVMDKFTRIEGDYKAIVQNPNPLIPPILGTDEFGWCSEWNLAMEKISGWNREDVINKMLLGEVFGTHVVCCRLKNQEAFVNLGIVLNNAVTGRESEKISFGFFARNGKYVECILCASKKIDGEGAVTGVFCLLQLASPELQQALHVQRLTEQTALKRFKELAYIRRQTRASLSGIMYSWRLMEGTDLRERQKQLLHTSAQCQHQLTKILDDTDLDCIIDGYLDLEMVEFTLYEVLSASISQVTLKSNGKGIHIANPLQEEKMPATLYGDNLRLQQVIADFLSISVNFTPNGGQIVASASLTKDRLGQSVQLVHVEIRITHMGGGVPEGLLNQMFGGDTDTSEEGISLLVSRKLVKLMNGDVQYLREAGKSTFIISVELAAAANKSTCE

SEQ ID NO: 3089 - protein, 532 aa, Ostreococcus tauri
IDGLPGRGAEKVTSAGDLLLCVSRDQQELVGYRFKGMSACVKRDERGVVVGGEGARRAARSFWSYFDEAWTTRLSDGEDAIVKDFMLEMHDGDFIVMASATPLDGASVAAGGAVRETEEGAPIGTRAGGGRRGTETQETSSGIQGAPSMQRITFHLVRTATGEKLDAFSFRDDFMHLPRNGAVSMRGDTLAVLSMKHQRVVFLKVHAEGRFEEVSSIGEYITEGDKEAVREQESVERAWAASHEESTKIIERANALPRSGRSMLTGLTQRLVTFLYHEARESSNVDALRLLHRNFERYVSLVMLRVRILDANLLLIKFGTPEYALARRGDNVIGPTMYAVFDITKGAFTQTAMSMNASNSVVEEDLNAPPRGETLWARFAGSQGEALAQCNTCTSSIEEEDEDGLNTVAARLFRAQDYPPQFRSLSPYFDKRLFSYDERTITAIDRLQPHVDFGVKFVSQRRGSRRRISFKLMVNDTVANSGRSKRRVQYVFHPVYPFAMSISIAYMQPTLVNFHVRSAPGDEMHEEIVQNP

SEQ ID NO: 3090 - protein, 586 aa, Gluconobacter oxydans
MCGIAGLSCLPGHHPDQDALERMSQAIFHRGPDGEGRLDLGGAALRHRRLSIVDIAGGAQPFRLGAAALIANGEIYNDPAIRRRFPKTCFQTHSDCEPPLHLWLHDGAGYTHELRGMYAIAIVENEHGRHEMVLSRDPFGIKPLYIAAYEGGIAFASEPQALLAGGFGRRSVRDGARNELMQLQFTTGQDIIFDGIRRLLPGETLRIVDGRIVESRRRHVLHEARDTVPARLSDEQALARLDTALLDSVSAHLRADVPLGLFLSGGIDSSVILAAAHRLGLPHPRTWTARFDAGKADESADAAALAASVGAEHHVLTVTEDMVWRDLPSIVACMDDPAADYAVIPTWFLAREARKDVTVILSGEGGDELFAGYGRYRRVMKPWWKGGRAPYRSGTFGKRFAEHGRQWRRGIAMTELALGVSGLEGAQALDIAEWLPNDLLLKLDRCLMAHSVEGRTPLLDPVVAKAIWPLPEHFKVRDGYGKWLLRRWLQDALPQARPFAPKQGFTVPVGPWIEKQAHRLGPLVARQPCIRAMMPAADVERLFARASQRGVARQAWTLLFFALWHRHHIEGVPVDGDTFETLARAS

SEQ ID NO: 3091 - protein, 334 aa, Oryza sativa
MSFCERDMNKESMYQERDDMAGIRFATPPLPQQQQQQQLVECFSDEVDSRGSGGEMKDAVGSGSGQLVVVGGGDGASIEVAKKRRGRPPGSKNKPKPPVVITREAEPAAAMRPHVIEIPGGRDVAEALARFSSRRNLGICVLAGTGAVANVSLRHPSPGVPGSAPAAIVFHGRYEILSLSATFLPPAMSSVAPQAAVAAAGLSISLAGPHGQIVGGAVAGPLYAATTVVVVAAAFTNPTFHRLPADDDASVSVSVSLSGSGDADEHRGHQHKPEPQEPRQLRRPPPHLSAAAAVSAAQPVEPCGAPMYACHPQPQEVMWPPPARTPHPPPPPPY

SEQ ID NO: 3092 - protein, 374 aa, Arabidopsis thaliana
MEMVNAEAKQSVPLLTPYKMGRFNLSHRVVLAPLTRQKSYGSVPQPHAILYYSQRTSPGGFLIAEATGVSDTAQGYPDTPGIWTKEHVEAWKPIVDAVHAKGGIFFCQIWHVGRVSNRGFQPRRQAPISCTGKPIMPQMRANGIDEARFTPPRRLSIEEIPGIVNDFRLAARNAMEAGFDGVEIHGAHGYLIDQFMKDKVNDRTDEYGGSLQNRCKFALEVVDAVAKEIGPDRVGIRLSPFADYMESGDTNPEALGLYMVESLNKYGILYCHMIEPRMKTVGEIAACSHTLMPMREAFKGTFISAGGFTREDGNEAVAKGRTDLVAYGRWFLANPDLPKRFQLDAPLNKYNRSTFYTSDPVVGYTDYPSLESTA

SEQ ID NO: 3093 - protein, 242 aa, Glycine max
MALEALNSPTTTAPSFPFDDPTIPWAKRKRSKRSRDHPSEEEYLALCLIMLARGGTTTVNNRHVSPPPPQPQPQPQPTPDPSTKLSYKCSVCDKSFPSYQALGGHKASHRKLAAAAEDQPPTTTTSSATATSSASGGKAHECSICHKSFPTGQALGGHKRCHYEGNGNGNNNNSNSVVTVASEGVGSTHTVSHGHHRDFDLNIPAFPDFSTKVGEDEVESPHPVMKKPRLFVIPKIEIPQFQ

SEQ ID NO: 3094 - protein, 480 aa, Streptococcus pyogenes
MLAFPKEFWWGGATSGPQSEGRFAKQHRNLFDYWYEEEPDLFYDYVGPDTASDAYHQIESDLALLASLGHNSYRTSIQWTRLIDDFEQVTINPDGLAYYNRVIDACLANGIRPVINLHHFDLPIALYQAYGGWESKHVVDLFVAFSKVCFQEFGDRVKAWFVHNEPMVVVEGSYLMQFHYPAIVDGKKAVQVAYNLALATAKVIQAYRRGPAKLSNGRIGTILNLTPAYPASQSETDMAAAHFAELWNNDLFMEAAVHGKFPEELVAVLKKDGVLWQSTPEELALIAENRVDYLGLNFYHPKRVKAPDAIPVISPSWSPEWYYDAYLMPGRRMNVDKGWEIYPEAVYDIAIKMRDHYDNIPWFLSENGVGISGEDRYRDETGQIQDDYRIQFLKEHLTYLHKGIEAGSNCFGYHVWTPIDGWSWLNAYKNRYGLVENNIHTQVRRPKASAYWFKKVATHNRLISLEVMEEFGGSASHLSD

SEQ ID NO: 3095 - protein, 368 aa, Corylopsis glabrescens
ALKSYKLAAKAISRLQSLQSGNISLLCDVLVKEVSDLTGYDRVMVYKFHEDEHGEVVAECRREDLEPYLGLHYPATDIPQASRFLFMKNKVRMICDCLAPAVKVNHDKRLAQPLSLCGSTLRSPHGCHAQYMANMGSIASLVMSVTINEQDDEIESEQQQGRKLWGLVVCHHTSPRFVPFPLRYACEFLIQVFGVQISKEVELAAQLREKHILRTQTMLCDMLLRDAPVGIITQSPNVMDLVKCDGAALYYRKKFWLLGVTPTEMQIRDIVQWLLEYHSGSTGLSTDSLVEAGYPDALILGDAVCGMAAIRITSKDFLFWFRSHTAKEIKWGGAKHDPDDKDDGRKMHPRSSFKAFLEVVKRRSLPWE

SEQ ID NO: 3096 - protein, 189 aa, Zea mays
FLDKEFINVAMGMDPEWKMYDKNLGRIEKWVMRKAFDDYEHPYLPKHILYRQKEQFSDGVGYNWIDGLKSFTEQQVTDEMMNNVAQMFPYNTPSTKEAYYYRMIFERLFPQDSARETVPWGPSIACSTPAAIEWVEQWKASNDPSGRFISSHDSAATDHTAVSRRWPTAAARPANGTVNGKDVPVPIAV

SEQ ID NO: 3097 - protein, 240 aa, Arabidopsis thaliana
  misc_feature (216)..(217): Xaa can be any naturally occurring amino acid
MDPYKYRPSSAYNAPFYTTNGGAPVSNNISSPPVLLEDYHLIEKVANFTRERSPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFXXGSTGKPTFWGSKKLKGAKFFGQL

SEQ ID NO: 3098 - protein, 155 aa, Lycopersicon peruvianum
MDLRLMGIDNTPLFHTLHHMMEAVGEDSVNAPSKKYVRDAKAMAATPVDVKEYPDSYVFVVDMPGLKSGDIKVQVEEDNVLLISGERKREEEKEGVKFIRMERRVGNFMRKFSLPENANTDAISAVCQDGVLTVTVQKLPPPEPKKPKTIQVKVA

SEQ ID NO: 3099 - protein, 739 aa, Silicibacter pomeroyi
MSLVNKLAEERRARLAAERLLELKQAELSAANRKLGRHALALTKQIGEKQAEVATVRDENEKVKSDLTVANAKIEVAERRLWHSIQTIQDGFAFFDSDSKLIGANTAYLNVFDGLDEVAPGISYMRILQLMTEEGIIDTGELAAEEWRQMMHERWISPTPEPVVIRMWNDQYVKMIDQRGHGGDVVSLALNITSTVRYEAELRAAREKAEAANRAKSAFLANMSHEIRTPMNGVVGMAELLCDTALDEEQQLYASTIKNSGEALLVIINDVLDYSKIEAEKMMLHPEPFDLERCIHEVAMLMQPIVRDKGLTLLVDYDLFLPTLFVGDPGRVRQVLTNLLGNAVKFTTKGHILIRVTGVPDPATGRCAIHVAIEDTGIGIPREKLAHIFGEFNQVENERNRQFDGTGLGLAISQRLIQMMGGTVWVESEEGRGSCFGFRVTLPMSEEAQPVLPNLPGRLQHVLIVDDLAVNRAILEKQLAQLGVRVTCCASGAQALEKMSDCVDLVLSDHNMPEMDGLELAEALRGAGWSDLPIFLLSSNPGMAHADPAKRHVQGILQKPIPRAELFARLSDMRTEITSVQDPAAVSAPVTKPAQDAPGEPTERRQMRVLAAEDNRTNQLVFRKMVKTLDIDLRFANNGLEAVEIWQDFQPDLIFMDISMPKMDGKQATGEIRRLEAGTGRHVPIVALTAHAMAGDAEGILAAGLDQYLTKPLRKALIHQHIAEACPAGALPVEPESGE

SEQ ID NO: 3100 - protein, 1190 aa, Xylella fastidiosa
MRCLKRVRGGLLTALLVFVSLLTATAAVPEMPRFRVLDATSGLPSNVVRAMLQDAAGYLWLATSDGLARYDGTAFKVWRHDPNDPGSLPGDSVLALYIDVQDRIWVLSENAGLAVLDAQRRRFIQIPVGSVAKTDALHTLTGHGDAIWLSDLHASVIRIDSAGALTRYALADVSPTLKDTPVVALTFDANGRLWVGTPDGLLYFEAGRLHLAPPPLDKTSIHSIAAVGSRLWVGSTDGVYLQDAEGRWRAPNWGPMFAFGNLLLSVADAGDGEFWLGSERGLWRTRQERPPVQIPLSDMHHGVSTVSSLWRDTSGGLWVPVYGRGLGYLRQDWKRMAVVRPSDGGESAYCNVAPAAYSGGLWQLNRIGELMHLNTSTGELVHTGWQRHELRGVNITATLEDSRGRLWLANMQNGLSRLDLKNGQWREWAAHGDDAVPLYGPISWIVEMPDSSLWLEALGVLQQRDLESGRVLNQIVPGSHGLDGSRVEQIGLGPDGRLWLAAGSGVYAWESQRRMFVPIPDLTGTRAYSFVPVGGNEVWVHRLRGLEQWRHSSHGWKRVALVGPQHGLPAMESLGMQHDAQGRIWLSTRRGLWRIDNTDELQVRNFGLRDGLGTQEFAEACLWMAPDGVLVGGTTDGYLMLFDTAMPDPAPFVPQLRMETVSVIRAGHRIDLPVDQPFELLPNDRQLIVGARLLSFGDPLSNRYSYWLKGFDTGWIDQGSSGTREFSSLPPADYTLLIQGTDPMGNLSRIHLVTFRVLPPWWRSAWGMSVLTGSGLLLLWGVAWNYHRRLRRRARLQLEQHQREVAERASLAKTQFLATLGHEVRTPMTGVLGMSELLLETPLDTRQHGYATSIQAAGKHLLRLVNDALDLAKIEAGKLSLERRDFDFHALLEQVVAMIRPMVERKGLRFVYRLDPEVPQYVHGDADRLQQILLNLLINATKFTEHGEVVLQVAPGQEQACLGVRIDVADTGPGLSEEQCQRLFRRFEQVNGASTAARYGGSGLGLAICRELATVMEGEIHVDSELGKGTCFRVLLPLPWVLAVQPAVAVMDMEPSPCSNPLHLLLIEDDPTVAEVIVELLRARGHRVTHALHGLEALVEVTLTRFDACLCDLDLPGLDGAGLIVQLRAQGQSFPIVVVTARTDADAQRQAFHVGCDAFLRKPVTGEMLEQVLTQVLSAPRQDADVDTPT

SEQ ID NO: 3101 - protein, 368 aa, Daphniphyllum macropodum
ALKSYKLAAKAISRLQSLPSGNISLLCDVLVKEVSDLTGYDRIMVYKFHEDEHGEVIAECRRPNLEPYLGLHYPATDIPQASRFLFMKNKVRMICDCLALPVKVKQDKRLPQPLSLCGSTLRSPHGCHAQYMANMGSIASLVISVTINEEDEEMESDQLKGRKLWGLVVCHHTSPRFVPFPLRYACEFLIQVFGVQISKEVELGTQMREKHILQTQTVLCDMLLRDAPVGIVTQSPNVMDLVKCDGAALYYRKKFWLLGVTPTEAQIRDIAQWLFEYHSGSTGLSTDSLVEAGYPSALILGDAVCGMAAIKITSKDFLFWFRSHTAKEIKWGGAKHDPDDKDDGRRMHPRSSFKAFLEVVKRRSLPWE

SEQ ID NO: 3102 - protein, 391 aa, Euonymus alatus
DLEPVNPADVPITAAGALKSYKLAAKAISRLQSLPSSNMSLLCDVLAKEVSELTGYDRVMVYKFHDDDHGEVVSECCRPDLEPYLGLHYPATDIPQASRFLFMKNKVRMICDCLAPPVKVLQDKRLSQPLSLGGSTLRSPHGCHTQYMTNMGSIASLVMSVTINEDDDETNSDQKIGRKLWGLVVCHHTTPRFVPFPLRYACEFLIQVFGVQINKEVELAKQLKEKHILRTQTLLCDMLLRDAPVGILTQSPNVMDLVKCHGAVLYYRNKFWLLGVTPTETQIKDIAEWLLDYHSESTGLSTDSLVEAGFPDASILGEAVCGMAAVKITSKDFLFWFRSHTAKEMKWGGAKHDPGDKDDGKRMHPRSSFKAFLEVVKQRSLPWEDVEMDAI

SEQ ID NO: 3103 - protein, 370 aa, Gunnera monoica
  misc_feature (180)..(180): Xaa can be any naturally occurring amino acid
  misc_feature (366)..(366): Xaa can be any naturally occurring amino acid
ALKSYKLAPKPISRLQSLPSGNISLLCDVLAKEVSDLTGYDRVMVYKFHEDEHGEVVAECRRPDLEPYLGLHYPATDIPQASRFLFMKNKVRMICDCMALPVRVIQDNKLPQPLSLCGSALRSPHGCHMQYMANMGSIASLVMSVTINEDEEEEEEESNRQTRRKLWGLVVCHHTSPRFXPYPLRYACEFLIQVFGVQINKEVELAAQMREKHVLRTQTVLCDMLLRDAPIGIMTQSPNVMDLMKCDGAALYYKNKIWLLGVTPTELQLRDIAQWLLENHNSSTGLSTDSLLEAGYPNATILGDLVCGMAAVKITSKDFLFWFRSHTAKEIKWGGAKHDPGEKDDGRKMNPRSSFKAFLEVVKRRXVPWE

SEQ ID NO: 3104 - protein, 391 aa, Ixonanthes chinensis
DLEPVNPADVPVTAAGALKSYKLAAKAISRLQSLPSRNLSLLCDVLVKEVSDLTGYDRVMVYKFHEDGHGEVVAECCRPDLEPYLGLHYPATDIPQASRFLFMKNKVRMICDCRTSSVKVVQDQKLTQPISLCGSTLRAPHGCHAQYMANMGSIASLVMSVTINEEDDEIESDHQKARKLWGLVVCHHTCPRFLPFPLRYACEFLMQVFGVQVNKEVELAVQMREKHTLRTQTVLCDMLLRDAPVAIVTQSPNVMDLVRCDGAALYYRKKFWLLGVTPTEPQIRDIVEWLLEYHSGSTGLSTDSLMEAGYPGASILGDAVCGMAAIRITSKDFLFWFRSHTAKEIKWGGAKHDPGDKDDGRKMHPRSSFKAFLEVVKRRSLPWEDVEMDAI

SEQ ID NO: 3105 - protein, 222 aa, Picea abies
MGRGKIEIKRIENTTNRQVTFCKRRNGLLKKAYELSVLCDAEVALIVFSSRGRLYEFANHSVKRTIERYKKTCVDNNHGGVISESNSQYWQQEAGKLRQQIEILQNANRHLMGDGLTALNIKELKQLEVRLEKGIGRVRSKKNEMLLEEIDIMQRREHILIQENEILRSKIAECQNSHNTNMLSAPEYDALPAFDSRNFLHANLIDAAHHYAHQEQTTLQLG

SEQ ID NO: 3106 - protein, 741 aa, Pseudomonas syringae
MNAPHKTGTGRRAIPAAVDIDALIRAEHRDPFSILGPHGDGGSGQYVRAYLPAALSVRLLAKDDGRELGEMEMSEVPGFFVGHLEQPQPYLLKVQWAGGEQITEDPYSFGPLLGEMDLYLFAEGNHRDLSSCLGAQVTKVDGVDGVRFAVWAPNARRVSVVGSFNSWDGRRHPMRLRHPTGVWEIFVPRLQPGEVYKYEILGAHGILPLKSDPMALATTLPPDTASKVSAPLQFEWNDQEWLRSRTGRHDVAAPLSIYELHAGSWQMEQHEDGQWRQYNWRELADRLIPYVKELGFTHIELMPIMEHPFGGSWGYQLLAQFAPTARYGSPEDFAAFVDACHRAEIGVILDWVPAHFPTDTHGLAQFDGTALYEYADPKEGFHQDWNTLIYNLGRTEVHGFMLASALHWLKHYHIDGLRVDAVASMLYRDYSRNAGEWVPNRFGGRENIETIDFLRHLNDVVALEAPGTMVIAEESTAWPGVSEPTQQGGLGFNYKWNMGWMHDSLQYMMRDPLHRRHHHSTLTFGLVYAWSERFVLPISHDEVVHGKHSLIDKMPGDRWQKFANLRAYLSFMWTHPGKKLLFMGCEFGQWREWNHDEQLDWYLMQYADHVGVKNLVGDLNRLYRQEKALHQRDADPAGFQWLIGDDQANSVFAYLRWSNDGEPLLVVANMTPVPRLAYRVGAPVSGAWTELLNSDAETYAGSNMGNGGEVNTEDEPAHGMEASLKLNLPPLAVLILKPKKD

SEQ ID NO: 3107 - protein, 223 aa, Synechococcus elongatus
MLAALQAEGLTLTAILNTHHHGDHVGGNRRLLRQFPEAAVSASAVDRDRIPGQTVLLEAGDRLQICGQTAEVLFVPGHTRGHIAYYFPEVAEGNPRGALFCGDTLFAGGCGRLFEGTPAQMLDSLQQLRSLPDDTAIYCAHEYTLNNLRFALTVEPDNFDLQQRYQAVAIARQQGQATIPSRLDIEKATNPFLRWDQAALQAAVSSQDPVQTLARLRSRKDQF

SEQ ID NO: 3108 - protein, 796 aa, Pseudomonas syringae
MLGRHRAPEVAVLMDISLKNRLSFKQARLAVSIGFVLGTLLSLFQIAIDYASEDASINREIKSLLEIIQNPASRIAYNIDSELAQELTLGLLRSPAVVSARLTDNNDAVLSSVERPMATGRYRVFSDWLFGESRQFQEKLHLNHLPNETIGTLYLTVDTFAFGSHFLQRAEITLLNGFVRSLALAGILTILFYATLTKPLVRVIRELSSRDPRNPDQGKITCPPYHAQDEIGVLVETFNRQFETMSSEFSRRRAAEDRLTDHLNELENIVSARTNELKASNLRLRESNEELQIARSTALDMAHARSAFLAHMSHEIRTPLNGLLGMLALSLDSPLGAEQRQQLMIAHDSGKVLVELLNDILDMSKFDAGHLEIERIPFDLGMLIEDTANLLSQNAAPSVELTCLIAPDFPAMVTGDPTRVRQIVSNLLSNALKFTRFGRVDVRLTHHRDASSGEHRVRIEVRDTGIGIAQDAQTRIFQPFTQAETAITRQYGGTGLGLALTNNLCEAMNGTLSIQSQSGFGSQFCAELPLPVHVPAVTQTPLKGRVTVISSAGSGLVELLGSLLPFWGVDLKRRSIDDRAQAVDLDGSSDLVITDCPECLFTIRPTTPVPILLVTAYGNFMPGEQVAALAPLQQQARPLARNALYHTLRRILGQEETGLKDTQALEHTAPRLARVLLVEDNPVNQLVAKGILGKLGCEVIISSHGGEALEQLEQGHFDLVLMDCNMPVMDGYEASRQIRSSGRWPNLPIVALTANAMPDERERCKAAGMNDYLAKPFRRAELVSILDQWIPITGID

SEQ ID NO: 3109 - protein, 601 aa, Unknown
  Piromyces sp. E2
MLSLRQETSKIVCQNILKNGISSRIGSASRSVLSRRNYAAKDIMFSEDGRAKLAKGVNTLAKAVSVTLGPKGRNVLIDNQYGLPKITKDGVTVAKSVALKDRFENLGARIVQDVAIKTNDYAGDGTTTATVLARAIFAEGLKNVQAGINPMDLRKGVQMAVDEVVKFLKENKREIKTKKEIAQVGTISANNDKHIGNMLAEAMEKVGKDGVITIQEGRTMKDELVVTKGMSFKRQGFISSYFITDIKKQKCEFKNPLILICDQRISAIQDVIPALEIAAENRRPILIVAEDIEGEALAACILNKIRGQVQVCCVRSPSFGDNRRETIKDLGILVKGNVFNNEVENSLDKVEIGMLGTCDTVTVTKDDTVFINGAGSKEEIEKRCNAIREAIATTDSEFEKKNLRERLAKLTGGVALAKVGGVSEVDVNEKIDRFVDALCATQAAVEEGIVPGGGTALLKASKVLEKLHADSFDVQLGIDIVKKAIKVPIQTIVNNAGGEGAVVAETIYNSYKVDGVKDSNVDKYEPFSYGYDAYNNEFCDLIAEGIIDPVKVVRSAIVDASGVASLLTTSECMIVDKPKKKTTPPPAAPGMGGMGGMGGMF

SEQ ID NO: 3110 - protein, 401 aa, Candida glabrata
MPFVKDFKPIALKDTNMFKPIKIGNTEVAHRVVMPPLTRMRAHHPGNVPNKEWAVEYYKQRSQRPGTMIITEGAFPCAQAGGYDNAPGIWSEEQVAEWTKIFKAIHDNKSFVWVQLWVLGRQAFPDTLARDGLRYDSASDEVYMDKESEEKAKKSNNPQHGITKDEIKQYIKDYVQAAKNSIAAGADGVEIHSANGYLLNQFLDPISNKRTDEYGGSIENRARFTLEVVDAIVDAIGPEKTGIRFSPYGTFGTMSGGAEPLIVAQYAYVLGELEKRAKAGKKLAFVHLVEPRVTNPFFTEGQGEYKDGTNDFAYSIWTGPIIRAGNYALHPEIAKEHVNNDDRTLIGYGRFFIANPDIVDRIEKGLPLNKYDRDTFYAMTTEGYLDYPTYDEAIKMGWDKQ

SEQ ID NO: 3111 - protein, 403 aa, Pseudomonas syringae
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAVHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPILNDEKFVLDLLLSEKLLVVQGTAFNWPYPDHFRVVTLPRVDELEQAIGRIGNFLKGYRQ

SEQ ID NO: 3112 - protein, 445 aa, Zea mays
MMEAEKNGNILMQKYEVGKLLGQGTFAKVYHARNIETSQSVAIKVIDKDKIFKVGLMEQIKREISVMKLVRHPNIVQLYEVMATKSKIYFVLEYVKGGELFNKIAKGKLREDASRKYFQQLVSAVDFCHSRGVYHRDLKPENLLVDENGNLKISDFGLSALAESRRQDGLLHTTCGTPAYVAPEVISRKGYDGAKVDTWSCGVILFVLMAGYLPFQDSNLMEMYRKIGKADFKCPPWFPSDVRKLVSRILDPNPRTRMPITKIVECFWFKKGIDNKLIRKNIEMKGKVSALTDVNVVFSSTGIGSNNNKLVDVEQDVAKITNLNAFDIISLSEGFNLSGLFEESEKRKEARFTSSQSASTIISKLEDAATCSKMTIKKKEGGVLKMEGANEGRKGVLSIDAEIFEVTPAFHLVEIKKNNGDTLEYENLFKQDMKPALKDIVWAWQ

SEQ ID NO: 3113 - protein, 546 aa, Ostreococcus tauri
MGRTRVVIWFRNDLRLLDNACVARAATLASESSDVEVVPVYVFDETYFKPSKRGLARFGAGRGKFTLECVGDLKTSLRALGSDLLVRCGKSRDVIAELTLTGANDRTIILTQTEVTSEETEMDVAVERATRERARGGAASATMERHWGSTLYHIDDVPFDVTSGLSDLPDVFTPFRNKVESKCKVRDVIPAPTANELGHVPASVEGFEWMPKPSDLPFASSEIAMDCDKRIKDCLDERSVLDFKGGESNALARVKYYLWESDRLATYFETRNGMLGGDYSTKLAPWLALGCVSPRHVVSEIRRYESERVENKSTYWVIFELIWRDFFKFFALKHGNKIFHLDGTAGRRASWKRDEKILKAWKTGTTGYPLIDANMRELAATGFMSNRGRQNVASWLALDAGIDWRHGADWFEHHLLDYDTASNWGNWCAAAGMTGGRINRFNIAKQTKDYDPAGEYIKTWVKELAEVPAAYIADPNQAPRELRDRIGLNYPNKLALPRRDFTEMGSPPGPRRGGGGGGRGRGRPGGSTPNRGTKARVASVYDTVYG

SEQ ID NO: 3114 - protein, 205 aa, Helianthus annuus
MEKLQNANAVLRRLPPGFRLHPTDEELVVQYLKRRVHSSPLPASIIPEVDVCKSDPWDLPGDSDQQEERFFFSTREIKYPNGNRSNRATQSGYWKATGLSRQIMGANQVGLVGIKKTLVFYKGKPPTGSRTDWIMHEYRLATTQPTQGLEKWVLCKIFLKKRGNYKDEKKNVPVFYDFLATPKVKTSSSSSSGSSGITEESSTNC

SEQ ID NO: 3115 - protein, 559 aa, Ostreococcus tauri
MSVASTSAAAKGRTLVWFRKALRVHDNPALSRGTLHATACQPVFVLDPWFCQPSRVGANRMRFLLQSLRDLDAQLRARGSSLLVLHGEPRVVLPRACKKWRVDSVTWEHDIEPYAKIRDAAVRGALERAGVECHAASGHTLYDVDEMLEKCKGAPPTTYQGFFKIVDKMGAPNAPIDAMEKMPGSFASSDEETKALVQGVADAYGIPTLEDLGYEPLGDDEGFPGVGGETEGLRRLRLMLARKEWIGQFEKPSTNPTTRFHGLSQSGKTKPKSPFEIAAGRSKDGDASTSGAEALMIPSTTALSPYMKFGCVSPRVFYHELTAVYKELEGKHSKPPTSLMGQLMWREFYYLVAAGTKNFDKMEGNAICRQIPWKKDRELFAAWENAQTGFPWIDAAMTQLRREGWLHHLARHAVACFLTRGDLFIHWEWGRDAFDRDLVDADWALNNGNWMWLSCSAFFYQYFRVYSPIAFAKKYDKDGQYVRHYLPVLKNMPSKYVYEPWLAPLDVQKKAGCVVGVDYPAPIVDHSAASKRCVDDIATAYAAHKDANAVAGKKRKASD

SEQ ID NO: 3116 - protein, 548 aa, Ostreococcus tauri
TRVFASKRYEPENAEADERASVEMAVRGVELVRTRGFLLFEPSEVRIDVAARDGYFGTLMPFVHAAERTCGDPGKPKPAPVDVRMVDLGTESDHEWEQIGLEDLGVAPASDRRVDWSAGIRADWDISEGGAVETWSQFTAVGLDRFEAEHGRADPEAGVTVSRLSPYLRFGMISPRTVYHDLVKKDGKNISKTFWHRLYRRELAYWQLHHWPDLPKTSVRSHYENRAWLSGDEADEALRRWQRGETGFPVVDCGMRRLWRTGWMHQTERMITATFLVDYLGVHWTRGADWFMRTLVDADEAINSMMWQNAGKSGLDQWDFFEGTLAPDGSARAHDPHGDAIARWIPELAALPRGYLRHRPWEASKATLAECDVELGSTYPRRMIVDLDRARQRMLDDVTTIRHAELVRAGGLVKPGSMEDLVVAPRAAVVRGAADLARVSTRKEFKRSLKALKASIAGIDLPSNPSSKPHGKSRANASRPKVSAASRPKSGPRSGRLPAPDRDAVRASRREAKRLDAAFRGRVFHHLPVDDLDDRDAAPPRVGRRPAR

SEQ ID NO: 3117 - protein, 192 aa, Taxodium distichum
DNHGEVISEIRRSDLEPYLGLHYPATDLPQAARFLFMKNKVRMICDCYATPVKVVEDKRFPRELILCGSTLRAPHGCHAEYMSNMGSVASLVIAETINAKEEAEITDGQQQQQKGRRLWGLVVCHHSSPRFVPFPMRYACEFLMQVFAIHVNKEVELADQLREKHILRTQTLLCDMLLRDAPTGIIRQKPNI

SEQ ID NO: 3118 - protein, 203 aa, Bacteroides fragilis
MFPVNCYVLWDETNEAVVIDPGCFYDEEKQALKNFIVTNNLNIKHLLNTHLHLDHIFGNPFMLREFGLSAEANQADEYWIDEAPKQSRMFGFQLNEAPVPLGKYLHDGDIITFGNTTLEAIHVPGHSPGSLVYYCRADNCMFSGDVLFQGSIGRADLAGGNFDELKEHICSRLFVLPNETIVYPGHGAPTTIGIEKAENPFFR

SEQ ID NO: 3119 - protein, 258 aa, Yarrowia lipolytica
MKVRSLEMQPDETQNYCYVLTDDASKKSWVIDPAFPKWVLADVEKLNKSGDIDLAAIVNTHHHWDHSGGNEDFKQSFSKLPIIAGKDSPDVTKTPAHGEQLTLGDNLKITALHTPCHTQDSICYFVEDTKTGERAVFTGDTLFIAGCGRFFEGTPEEMNVALNDILAKLPDDTVVYPGHEYTKSNVKFVKTILPNNEAVNKLDHFCQNNKITTGVFTIGDEKKHNPFMMVNDPAVEEVCGSTDPVKVMEVLRERKNKL

SEQ ID NO: 3120 - protein, 336 aa, Streptomyces avermitilis
MTPGSDVIDDVPKANNDSMAASATLGGERKRSLEQITLLLFIIVPFLALLAAVPLAWGWGVSWLDMGLMVFFYYLGCHGITIGFHRYFTHGSFKAKRPLRIALAIAGSMAVEGPLVRWVADHRKHHKFSDAEGDPHSPWRFGETVPALMKGLWWAHIGWMFDEEQTSQEKYAPDLIKDGAIRAISRQFVLWTGLSLALPPLIGGLVTMSWWGAFTGFFWGSLVRVALLHHVTWSINSICHAVGKRPFKSRDRSGNVWWLAVLSCGESWHNLHHADPTSARHGVERGQLDSSARIIRWCERLGWAYDVRWPSRSRIDSRRHTGEEGSRRKRESADAA

SEQ ID NO: 3121 - protein, 181 aa, Thuja plicata
DDHGEVVAEMRRPDLEPYLGLHYPATDIPQASRFLFMKNRVRMICDYRATAVKVRQDKRLGQVLSLSRSTLRAPYGCHAQYMANMGSIASLVMAVTVDNSEVGGRRLWGLVVCHHTTPRFVPYPLRYACEFLTQVFGVQLNKEVELAARLRERHILRSQTVLCDMLLRDAPVGIVTKTPNI

SEQ ID NO: 3122 - protein, 366 aa, Unknown
  Vibrio sp. Ex25
MTDALFQPIQLGSLSLKNRIVMPPMTRSRASQPGNVANDMMATYYAQRAEAGLIVAEGTQISPMGQGYAWTPGIYSPEQIAGWKKVTDAVHEKGGVIFAQLWHVGRVTHPDNIGGEQPISSSALKAENVKVFIDNGTDEPGFVDVVEPREMTKKDIKNVIEEYRQAALNAIKAGFDGVELHAANGYLVNQFIDSEANHRTDEYGGSIENRLRFLGEVVEAMTQAIGAERVGVRLAPFTSLNGTVDSTPVDTYTAAAALLDKLNMVYIHIAEVDWDDAPDTPHDFKTAVREAYKGKLIYAGRYNAEKAQHAIESGLADMIGFGRPFVANPDLPSRIKHGYPLAEHDPTTLFGGGEKGLVDYPAYHAG

SEQ ID NO: 3123 - protein, 491 aa, Zea mays
MDPYKHRPSSAFNAPYWTTNSGAPVWNNDSSLTVGARGPILLEDYHCEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVRCGANHSHATKDLTDAIAAGNFPEWTLYIQTMDPEMEDRLDDLDPLDVTKTWPEDRFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 3124 - protein, 249 aa, Taihangia rupestris
MGRGRVELKRIENKINRQVTFSKRRTGLLKKAHEISVLCDAQVGLIVFSNKGKLFEYASDSCMENMLERYERYSYAERRLMEPDFESQGDWTFEYARLKVKVELLQRNLSHYLGDDLDSLSVKEIQSLEQQLDTALKQIRSRKNQLMNESISELQRKEKAMQVQNNLLTKKIQEKEKDVAATQEVHIWEPQQYQHQQNNGFHRLPQPLLPCLNMGGTHQNDQFFQMRGNQLDLTLEPSLYSFNLGCFTS

SEQ ID NO: 3125 - protein, 366 aa, Arabidopsis thaliana
QMGFAENQLCGDLMRKWVLKHPEASICTSEGVNQFSDIAIFQDYHGLPEFRQAVAKFMEKTRNNKVKFDPDRIVMSGGATGAHETVAFCLANPGDGFLVPTPYYPGFDRDLRWRTGVNLVPVTCHSSNGFKITVEALEAAYENARKSNIPVKGLLVTNPSNPLGTTLDRECLKSLVNFTNDKGIHLIADEIYAATTFGQSEFISVAEVIEEIEDCNRDLIHIVYSLSKDMGLPGLRVGIVYSYNDRVVQIARKMSSFGLVSSQTQHLIAKMLSDEEFVDEFIRESKLRLAARHAEITTGLDGLGIGWLKAKAGLFLWMDLRNLLKTATFDSETELWRVIVHQVKLNVSPGGSFHCHEPGWFRVCFA

SEQ ID NO: 3126 - protein, 217 aa, Pimpinella brachycarpa
MVRGKTQMRRIENATSRQVTFSKRRNGLLKKAFELSVLCDAEVALIIFSPRGKLHEFASSSMHETIERYRKHTKDVQSNNTPVVQNMQHLKHETASLAKKIELLEVSKRKLLGEGLGTCSINELQQIEQQLEKSVCTVRARKMQVFKEQIEQLKEKEKTLAADNAILLAKYDVQPRQESPEDGGNLTSTTENSENSDVETELFIGPPEKRFKRIMEK

SEQ ID NO: 3127 - protein, 514 aa, Lycopersicon esculentum
MDGTAVQGTSSVDSFLRNYKLGKTLGIGSFGKVKIAEHTLTGHKVAVKILNRRKIRNMDMEEKVRREIKILRLFMHPHIIRLYEVIETPSDIYVVMEYVKSGELFDYIVEKGRLQEDEARNFFQQIISGVEYCHRNMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGIYTLPSHLSAGARDLIPRMLIVDPMKRMTIPEIRLHPWFQAHLPRYLAVPPPDTTQQAKKIDEEILQEVVKMGFDRNNLTESLRNRVQNEGTVAYYLLLDNRHRVSTGYLGAEFQESMEYGYNRINSNETAASPVGQRFPGIMDYQQAGARQFPIERKWALGLQSRAHPREIMTEVLKALQELNVCWKKIGQYNMKCRWVPSLPGHHEGMGVNSMHGNQFFGDDSSIIENDGATKLTNVVKFEVQLYKTREEKYLLDLQRLQGPQFLFLDLCAAFLAQLRVL

SEQ ID NO: 3128 - protein, 258 aa, Taihangia rupestris
MGRGKVQLKRIENKISRQVTFSKRRTGLLKKAHEISVLCDAEVALIVFSTKGKLFEYSTNSSMEAILERYEQYSYAERQSMGITDPESQGSWSMEYPKLAARIEILQRKIRNYTGEDLDPLSLRELQSLEQQIDTALKRVRVRKNQVMHDSISEIQKKHRALQEQNNQMSKKLKENEKQSQAVPNNQQSNSTTIVLMAPPPPQAPPPPAPLPALTIGGAFLDRRNAMDEDSDDQQGRAQTRPVSNTGMPLWMVRGLNQ

SEQ ID NO: 3129 - protein, 376 aa, Klainedoxa gabonensis
AAGALKSYKLAAKAISRLQSLPSRNMSLLCDVLVKEVSDLMGYDRVMVYKFHEDEHGEVVAECCRPDLEPYLGLHYPATDIPQASRFLFMKNKVRMICNCQAPSVKVIQDNKLPKPVSLCGSTLRAPHGCHAQYMANMGISASLVMSVTINEDDDNMDNDQAKARKLWGLVVCHHTSPRFVPFPLRYACEFLIQVFGVQINKEVELAAQTREKHILQTQTVLCDMLIRDAPEGIITQSPNVMDLVKCDGATLYYRKKFWLLGVTPTEAQIKDITEWLLEYHSGRTGLSTDSLMEAGYPGASVLGEAVCGMAAIRITSKDFLFWFRSHTAKEIKWGGAKHDPDDKDDGRKMQPRSSFKAFLEVVKWRSLPWEDMEMD

SEQ ID NO: 3130 - protein, 281 aa, Leea guineensis
RFLFMKNKVRMICDCLATPVKVIQDKRLTQPMSLCGSILRSPHGCHTQYMANMGSIASLVMSVTISEEGDETQNEQQKGRKLWGLLVCHNTSPRFVPFPLRYACEFLVQVFGVQINKEVELVTQQRQKHILRTQAVLCNMLLRDAPVGILNQSPNVMDLVKCDGAALYYRKKFWLLGITPTEAQIGDIAEWLNEYHGGSTGLSTDSLIEAGYPGASALGEAVCGMVAVKITSNDFLFWFRSHTAKEIKWGGAIQGPNDTDDLGKMHPRTSFKAFLEAVKLR

SEQ ID NO: 3131 - protein, 232 aa, Taihangia rupestris
MGRGKIEIKRIENTTNRQVTFCKRRNGLLKKAYELSVLCDAEVALIVFSNRGRLYEYSNNSVRETIERYKKACADTSNNGSVSEATTQYYQQEAAKLRNQITALQNNNRNYMAEGLGNMSVKELKNVESKLEKAIGKIRSKKNELLFSEIEYMQKRELDLHNNNQILRAKIAENERHQQSINAIAGGGGAHGSYEIMQSAQSFHEARNYFQVNALQPNHQYSRHDQISLQLV

SEQ ID NO: 3132 - protein, 391 aa, Liquidambar styraciflua
DLEPVNPADVPVTAAGALKSYKLAAKAISRLQSLPSGNISLLCDVLVKEVSDLTGYDRVMVYKFHEDEHGEVLAECRRPDLEPCLGLHYPATDIPQASRFLFMKNKVRMICDCLAPPVKVNQDKRLTRPLSLCGSTLRSPHGCHAQYMANMGSIASLVMSVTINEDDDEMESDQQKGRKLWGLVVCHHTSPRFVPFPLRYACEFLIQVFGVQINKEVELATQLREKHMLRTQTVLCDMLLRDAPVGIVTQSPNVMDLVKCDGAALYYRKKFWLLGVTPAEAQIRDIAQWLLEDHNGSTGLSTDSLVEAGYPDALILGDAACGMAAIRITSKDFLFWFRSHTAKEIKWGGAKHDPDEKDDGRKMHPRSSFKAFLEVVKRRSLPWEDVEMDAI

SEQ ID NO: 3133 - protein, 268 aa, Arabidopsis thaliana
MDDLLNFSVPEEEEDDDEHTQPPRNITRRKTGLRPTDSFGLFNTDDLGVVEEEDLQWISNKNAFPVIETFVGVLPSEHFPITSLLEREATEVKQLSPVSVLETSSHSSTTTTSNSSGGSNGSTAVATTTTTPTIMSCCVGFKAPAKARSKRRRTGRRDLRVLWTGNEQGGIQKKKTMTVAAAALIMGRKCQHCGAEKTPQWRAGPAGPKTLCNACGVRYKSGRLVPEYRPANSPTFTAELHSNSHRKIVEMRKQYQSGDGDGDRKDCG

SEQ ID NO: 3134 - protein, 376 aa, Meliosma squamulata
  misc_feature (222)..(222): Xaa can be any naturally occurring amino acid
  misc_feature (306)..(306): Xaa can be any naturally occurring amino acid
TAAGALKSYKLAAKAISRLQSLPSGNITLLCEVLVREVRDLTGYDRVMVYKFHEDEHGEVIAECRRSDLEPYLGLHYPATDIPQASRFLFMKNKIRMICDCSSQPVKIIQDKRLAQPLSLGGSTLRAPHGCHAQYMANMGSIASLVMSVTINDDDDDDDDTSESDKKKGRKLWGFVVCHHTSPRFVPFPLRYACEFLSQVFGIQLNKEVELAAQLKEKHILXTQTMLCDMLLRDAPMGIITQSPNVMDLVKCNGATLYYNNKFWLLGITPTEEQIRDIIGWLFENHDQSTGLSTDSLVEAGYPGAXFLGDAVCGMAAIKITSKDFLFWFRSHTAKEIKWGGAKHDPIDKDDGRKMHPRSSFRAFLEVVKWRSIPWE

SEQ ID NO: 3135 - protein, 615 aa, Geobacillus kaustophilus
MCGITGWVHFGRNLRRERTVIDSMTETLAKRGPDDTNTWLDTHVAFGHKRLVVVDPAGGKQPMVRQKNGHRYTIVYNGELYNTEDIRKELLRQGYRFDGHSDTEVLLAAYMEWKEKCVDWLNGIFAFAVWDGERELLFMARDRLGVKPLFYREDGGGLLFGSEVKAILAHPDVKAEVNYEGLAEVFGLGPSRTPGHGVFDGIRELRPAHALTFSRSGLRIWRYWNVESDVHRDSFEETVEKLRFLLTDAVTRQLVSDVPVCTFLSGGVDSSAITGIAANAFAADGKGPLHTYSIDYEGNDQYFKANDFQPNTDAPFIEQVSNKFQTVHHRCVITQEELFRHLHEAVIVRDVPGMADVDSSLLWFCKQIRERFVVSLSGECADEIFGGYPWFHRPDDLSRKGFPWMRSVDARMGLLKDEWRQKLRLDDYVQMRYEQTLAEVPRLEGESAEEAKRRELFYLNMIWFMTTLLDRKDRMSMGASLEVRVPFADHRIVEYVWNIPWDMKMYGGREKGLLRKALEGLLPEEVLYRKKSPYPKTHHPLYTKLVKQWLEQLLHDRSSVLHEFFDREKLLALIETEGKSFQVPWFGQLMTGPQLLAYLGQVHVWFDHYGIRIKE

SEQ ID NO: 3136 - protein, 194 aa, Amborella trichopoda
FSNRGKQYEFCSSSSMLKTLERYQKCNYGTQETTVSTKETQSSQQEYLRLKAHFEALQRSQRNLLGEDLGPLSGKELEQLEQQLDMSLKQIRSIKTQYMIDQLADLQRKEQALSESNNALKRKLEAAGGWDSTGHQMEYNRQPAQAQADNFFHPLECDPTLQIGYPSGYPNPITVAAPGPSVTNFMPWMAGIEG

SEQ ID NO: 3137 - protein, 370 aa, Unknown
  Paeonia sp. Qiu 95-090
AGALKSYKLAAKSISRLQSLPSGNVPLLCDILVKEVSDLSGYDRVMVYKFHEDEHGEVVAECRRPDLGPYLGLHYPATDIPQASRFLFMKNKVRMICDCSAPSVKVTQDKSLPQPLSLAGSTLRSPHGCHAQYMANMGSIASLVISITINDGDDEMESGQQKGKRLWGLVVCHHTSPRFVPFPLRYACEFLIQVFSVQINKEVELAVQLREKHILRTQTVLCDMLLRDAPVGIITQSPNVMDLVKCDGAALYYRKKFWLLGVTPTEAQIKDIAEWLLEYHSESTGLSTDSLMEAGYPGASILGDVVCGMASIRIASKDFLFWFRSHTAKEIKWGGAKHDPDDKDDVRKMHPRSSFKAFLEVVKRRSLHWE

SEQ ID NO: 3138 - protein, 1039 aa, Pseudomonas fluorescens
MGGALFWGGQRIIRQEQERIAVDFQLLTRYMSEQQALLQRLAGEKRLQYKDADQDPAQLFHLMEQQEAVGATLFQGNPSSVETPFTLVCQDLAQCPHQSAAAAGLGRYLADLYSSFWVRSSFPASALLVVDAGAGSSFTVPTIGSRWPRLTTPLVLAGLHAVRASATSSDSDAIRWIRLKDFPQHMIAFTALHNLAPGSGLQSSGTYAACLTYRDRINVFTTPQRRHFYDKFWLQGRLDGLLLGDEPAPLALHEGANVRSDGLLFRINDASGHWSGYYLLSYRALFLGHSWSLAAIFLLLLLSPLAARVYARWYQRRVIAPAQQAHAELVENHQFSRTLLETTPVALCVLSREDRRIVFANNLALKWFTTQVGQSLDASGLDPALLERIARAREPGEIENFQSFDGRSFYIAFAPTRYRNQDVLICAFADLSARAQMEQQLTQAKQAADKANGAKSVFLATMSHEIRTPLYGVLGSLELMGLTDLDREQRQLLERIQVSSGLLLQIISDILDITRIESGQLSLGDQLFDPRALVQRCTASFVDSARNKGLLLFSWVDPELPPALLGDPGRISQILTNLISNAVKFTHSGQVIVRARAEPGSQGRVLLSLQVADTGIGIGKEEQQQLFIPFYQIDAHSHTVHGAGLGLSICAKLAALMGSQIHLTSELGLGSSFSMQLELPVASDPNAERQPDLGGARIYVQSPHHELTDNLCQWLQKWHAQATPVDATAPPPQGQGVLLRLFDDRPEASEALPPGLLRIDLGGQQRTPGAGLAEAGDYYAIGRLLERTLGGAPDAPAEPELPARDIATLAPLGLNVLVAEDNPINQATLSHQLQQLGCRNTLAADGAEALDLWRIGDYDLLLTDVNMPRMNGYELTCILRAAGDDRPIIGITANAMCDEEARCQACGMDAWLVKPVPLQTLRASLARLTSLAPEPPAEPAAAPGNAPVDGLPPNLRELFARTMGQDVEHLRQALDEEDYERIFQLLHRVRGSLAVAGQEALILQVHDLGQSLRQSGLTATTRTHSLMLLHALQDISQLE

SEQ ID NO: 3139 - protein, 243 aa, Amborella trichopoda
MGRGRVELKRIENKINRQVTFAKRRNGLLKKAYELSVLCDAEVALIIFSNRGKLYEFCSTSSMVKTLERYQKCNYGALETNVPTRETQSSYQEYLKLKARVESLQRSQRNLLGEDLGPLSSKELEQLEQQLEMSLKQIRSTKTQCMFDQLADLRRRELALQETNKALKRKLEGASASNPPQLAWENNGQNIHYNRQPAHTEGFFHPLECDSTLQIGYHPSCPDQMPVAAPVQNVNAFLPGWLV

SEQ ID NO: 3140 - protein, 540 aa, Clostridium difficile
MAKEIKFSEETRRALEAGVNKLADTVKVTLGPKGRNVILDKKFGSPLITNDGVTIAKEIELEDRFENMGAQLVKEVATKTNDVAGDGTTTATVLAQAIIREGLKNVTAGANPILLRKGIQKAVTVAVEELKNQSRIVETQEAISQVASISAGDEEVGKLIAEAMEIVGKDGVITVEESQTMNTELDAVEGMQFDRGFVSAYMVTDVDKMEAVLKDPYILITDKKISNIQELLPVVEQIVQQGKKLLIIAEDVEGEALSTLVVNKLRGTFDVVAVKAPGFGDRRKEMLQDIAILTGAQVISEELGYDLKEADLSMLGRASSVKVTKENTTIVDGSGDKKSIEDRVTQIKHQVEQTTSDFDREKLMERLAKLAGGVAVVKVGAATEVELKERKLRIEDALNATRAAVEEGIVAGGGTAFVSVIPAIGTLIESLEGEVKLGAQIVKKALEEPLRQIAINAGLEGAVIVQNVVNSEAETGFDALNEKYVNMIEAGIVDPTKVSRSALQNAASIASTFLTTEAAVADLPEKEDAGMPGTGMDGMY

SEQ ID NO: 3141 - protein, 603 aa, Bdellovibrio bacteriovorus
MESRYEALFELSNDMIGVFGEDWRPAKLNHVWSEVLGWSHEELMQIPFNELIHPEDVKNIVSRYEKIRKGDVLRNFLLRYRCKDGHYKFLSWNYQFDPVTNEALCVVKDTTPQKIFTEILGQANAEAPIGTWSMDLTTGKHFWSRALYDIFEVDPDTYDLDRLRGFEMIAEKDRSLMMETHRRLMEQGTDYDVEVTVCSGKGRVFPARVMGTALRQEGRIVQIYGLMYDVAQRRHVEKELRYQQFLLRMFLQSSPAIVYVKDLQGRYLLVSPTFENLVGKRSVELVGKTDAQIFGVEDARRFSDSDNQLIQEQQPRSYEEKLTFHDGSQKYYLSEKFPLRDEDGHLIAIAGVSTDITELHRYQQELERAKEAAEAGTRAKSEFLANMSHEIRTPMNSIMGMSELLLDTELSPDQRQFVTILTRASSSLLNLINDILDLSKIESGLMVIEKVPFSVRESVRRALELLMIRAVEKKLDLKLEIDPQVPEKILGDATRFQQVLINLIGNGLKFTTHGEVRVQLKVNGHQLWVGVKDTGIGMAPEQMQGLFTRFSQGDSSITRRFGGTGLGLSISKQLVEKMGGTIGVTSEIGQGSVFYFTLPLGSK

SEQ ID NO: 3142 - protein, 191 aa, Thuja plicata
DDHGEVISEIRRSDLEPYLGLHYPATDIPQASRFLFMKNKIRMICDCYATPVKVVEDRRLPRELILCGSTLRAPHGCHADYMSSMGSIASLVIAVHHAKEEDGVFDGQQQQQKGRRLWGLVVCHHTSPRFVPFPLRYACEFLMQVFAIQLNKEVELADQLREKHILRTQTLLCDMLLRDAPMGIIREKPNI

SEQ ID NO: 3143 - protein, 634 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKVSTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLHHQITVGSSVPINLPVINQVFSSNRAIIIPHTSPLARIRPLTGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDDHFYLKVQVKDTGCGIGPQDLPHVFTKFAHPQSGGNRGFNGSGLGLAICKRFVSLMGGHIWIDSEGTGRGCTATFVVKLGVCDNTNTYQQQLIPLVWPSSADSDLRAPKPLPDGRGSTPLKSRYQRSV

SEQ ID NO: 3144 - protein, 192 aa, Thuja plicata
DDHGEVISEIRKSNLEPYLGLHYPATDIPQASRFLFMKNRVRMICDCCAPPVSVVEDKRLPRDLNLCGSTLRAPHGCHVQYMVNMGSIASLVMAIIINEKEEEEGDSEGQQQQKGRRLWGLVVRHHTSPRFVPFPLRYACEFLMQVFGIQLNKEVELAAQLKEKHILRTQTLLCDMLLRDAPVGIMTQRPNI

SEQ ID NO: 3145 - protein, 375 aa, Staphylococcus aureus
MKSKYEPLFDKVVLPNGVELRNRFVLAPLTHISSNDDGTISDIELPYIEKRSQDVGITSNAASNVSDVGKAFPGQPSIAHDSDIEGLKRLATAMKKNGAKALVQIHHGGAQALPELTPDGDVVAPSPISLKSFGQKQEHSAREMTNEEIEQAIKDFGEATRRAIEAGFDGVEIHGANHYLIHQFVSPYYNRRNDVWANQYKFPIAVIEEVLKSKEVYGNKDFIVGYRLSPEEAESPGITMEITEELVNKISHMPIDYIHVSMMDTHATAREGKYAGQERLPLIHKWINGRMPLIGIGSIFTADDALDAVENVGVDLVAIGRELLLDYQFVEKIKDGREDEIINYFDPEREDNHHLTPNLWHQFNEGFYPLPRKDK

SEQ ID NO: 3146 - protein, 349 aa, Pseudomonas putida
MTTLFDPIKLGDLQLPNRIIMAPLTRCRADEGRVPNALMAEYYVQRASAGLILSEATSVSPMGVGYPDTPGIWNDEQVRGWNNVTKAVHAAGGRIFLQLWHVGRISHPSYLNGELPVAPSAIQPKGHVSLVRPLSDYPTPRALETEEINDIVEAYRSGAENAKAAGFDGVEIHGANGYLLDQFLQSSTNQRTDRYGGSLENRARLLLEVTDAAIEVWGAQRVGVHLAPRADAHDMGDADRAETFTYVARELGKRGIAFICSREREADDSIGPLIKEAFGGPYIVNERFDKASANAALASGKADAVAFGVPFIANPDLPARLAADAPLNEAHPETFYGKGPVGYIDYPRL

SEQ ID NO: 3147 - protein, 193 aa, Torreya nucifera
DDHGEVISEIRRSDLEPYLGLHYPATDIPQAARYLFMKNRVRMICDCVAPPVKVVEDKRLPRELSLCGSTLRAPHGCHTDYMSNMGSIASLVMAVVINGKEEEEGDTDRQNQQKKGRRLWGLVVCHHTEPRFVPFPLRYACEFLMQVFGIQLNKEVELAAQLREKQILRTQTMLCDMLLRDAPLGIIRQEPNI

SEQ ID NO: 3148 - protein, 228 aa, Taihangia rupestris
MGRKIEIKRIENTTNWQVTFCKRRNGLLKKAYELSVLCDAEVALIVFSTRGRLYEYANNSVRQTIQRYKKTCDSSNSGSVTEANVQFYQQEASKLRRQIREIQNSNRHILGEALSTLNVKELKNLEGRLEKGIGRIRSKKNEMLFAEIEYMQKKEIELQNQNNFLRAKIAETDKARQQQTNMMPGTSSAYDQSMPPPQTYDRSFLPVILESNHNYNRQGQNQTPLQLV

SEQ ID NO: 3149 - protein, 338 aa, Bacillus halodurans
MEHKLFSSYVVKGVTLKNRIVMSPMCMYSSDQKDGKIRPFHISHYESRAAGQVGLIIVEATAVTPQGRISPYDLGIWSDDHISGLTETVERIHAHGAKAAIQLAHAGRKAELDGPIIAPSAISYDKMKTPDAMTEEQISETIEAFKLGALRAKKAGFDIIEIHGAHGYLINEFLSPLTNKRTDAYGGSLENRYRLLREIISEIQTVWDGPLFVRISAAEYAEGGNELSDFITLAKWMKKQGIDLIDCSSGAVVPAPIPVYPGYQVPLAEAIRHEANIATGAVGLITSGIQAEEILQNERADLIFVARELLRNPYWPREAALELGTTISGPSQYDRAWL

SEQ ID NO: 3150 - protein, 504 aa, Zea mays
MVLTHVHDLDEASAASAVVFASRYVQDPLPRYELGEKSVSKDAAYQIIHDELLLDSSPRLNLASFVTTWMEPECDKLILEGINKNYADMDEYPVTTELQNRCVNIIARLFHAPVGASEKAVGVGTVGSSEAIMLAGLAFKRRWQNRRRAAGQPCDRPNIVTGANVQVCWEKFARYFEVELKEVRLREGCYVMDPDEAVRMVDDNTICVAAILGSTLTGEFEDVRRLNDLLAANNRRTGWDTPIHVDAASGGFIAPFLYPDLEWDFRLPLVKSINVSGHKYGLVYAGVGWVVWRSKEDLPDELIFHINYLGADQPTFTLNFSKGSSQIIAQYYQFLRLGFEGYRNVMENCMESARTLREGLERTGRFTIISKEQGVPLVAFTFKAKDETPLAFKLSAELRRFGWIVPAYTMPANLEHMAVLRVVVREDFGRPLAERFLSHVRMALEELDHAAKGGPVPRMRLTIELGPPARGSGEEASARVVNREAVVPVHRSVSLAGGKTKGVC

SEQ ID NO: 3151 - protein, 368 aa, Unknown
  Ranunculus sp. Qiu 95-024
MKSYKLAAKAISKLQAMPSGNIPLSCDMLVQEVRDLTGYDRVMVYKFHEDDHGEVIAEWRVSSLEPYLGLHYPATDIPQASRFLFMKNKIRMICDCSAIPVKVVQDKKLGQPLSLGGSALRAPHGCHAQYMSNMGSVASLVMSVTINEDDEQMETGQQKGRKLWGLVVCHHTSPRFVPFPLRYACEFLIQVFGMQINKEVELANQTREKHILHTQTVLCDMLLRDAPIAIVTQSPNVMDLVMCNGAALYYRDRLCLLGVTPTDDQIRDIAQWLLEYHNESTGLSTDSLMEAGYPSASLLGNAVCGMAAIKITSKDFLFWFRSHTAKEIKWGGAKHNPAEKDDRWKMHPRSSFKAFLEVVKHRSLPWED

SEQ ID NO: 3152 - protein, 241 aa, Eschscholzia californica
MGRGRVELKRIENKINRQVTFAKRRNGLLKKAYELSVLCDAEVALIIFSNRGKLYEFCSSSSMFKTLERYQKSNYGAPETNVSVRESQEHSSHQEYLKLKARVEALQRSQRNLLGEDLGPLSGKELESLERQLDMSLKQIRSTRTQYMLDQLTDLQRREQMLSDANKTLRRRLEEGTVTCHQWEQNMQYGQQQAHAQGEGFFHPIECEPTLQMGYQQDQITVAAAAGPSMTMNSYMPGPGW

SEQ ID NO: 3153 - protein, 371 aa, Reinwardtia indica
GALTSYKIAAKAISRLQSVPSGSINLLSDVLVNELRDLTSYDRVMVYRFHEDEHGEVVAESIAPGLEPYLGLHYPATDIPQASRFLFMKNKVRMICDCLAPSVKVTQDRNLAEPINLSGSTLRAPHGCHAQYMANMGSIASLVMSVTINDNEDGNEMESDQMMGRKLWGLVVCHHTTARFVPFPLRYACEFLIQVFGVQISKEVELEAQRKEKHIIQTQTVLCDMLLRDAPVAIMTQSPNVMDLVKCDGAALLYRKKCWLLGVTPTEEQITDITEWLLEYHNDSTGLTTDSIMEAGYPGASVLASTICGMAAIRITSKDFMFWFRSHTAKEIKWGGAKHDPDDKDGVRKMHPRSSFKAFLEVVKWRGLPWE

SEQ ID NO: 3154 - protein, 1239 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCA

SEQ ID NO: 3155 - protein, 248 aa, Eschscholzia californica
MGRGRVELKRIENKINRQVTFAKRRNGILKKAFELSVLCDAEVALIIFSSRGKLYEFCSSSSILKTLERYQRCSSNASQASRSIKDNDETYQNYLKLKSRVEVLQQNQRNLLGLDLEPLSLKELDQLESQLEVSLKQVTSTKTQFMLDNLSDLQTKEEVLQEANRSLNRKMEENMAEIPQQLRWEAGDGHNIPYNRHIPITDGFYQPLECNPTFQIGSSSMKSFDHLTDPPPTVQNLLGYFPSWSFET

SEQ ID NO: 3156 - protein, 363 aa, Sabia swinhoei
TAAGALKSYKLAAKAISRLQSLPSGNISLLCDVLVREVSDLTGYDRVMVYKFHEDEHGEVIAECRRSDLEPYLGLHYPATDIPQASRFLFMKNKVRMICDCSARPVKVVQDKRLARPLSLCGSTLRAPHGCHAQYMANMGSIASLVMSVTINEDDDDEMESDQKKGRKLWGFVVCHHTSPRFVPFPLRYACEFLIQVFGIQVNKESELAAQLREKHILQTQTMLCDMLLRDAPVGIVSQSPNVMDLVKCSGAALYYKNKFWLLGVTPTEEQIRDIIGWFVENHDQSTGLSTDSLMEAGYPGASVLGDAVCGMAAIKITSKDFLFWFRSHTAKEIKWGGAKHDPVDKDDGRKMHPRSSFKAFLE

SEQ ID NO: 3157 - protein, 242 aa, Liriodendron tulipifera
MGRGRVELKRIENKINRQVTFAKRRNGLLKKAYELSVLCDAEVALIIFSNRGKLYEFCSTSSMFKTLERYQKCNYGAPEAAVTTREIQSSHQEYLKLKARVEALQRSQRNLLGEDLGPLNGKELDTLERQLDVSLKQIRSTRTQYMLDQLTDLQRREQMLSEANKALKRRLDEGMQANPHQGWNHNPHAMEYVRQQGPPQGDGFFHPLDCEPTLQIGYQTDQITMSTAPGPSLNNYMPGWLA

SEQ ID NO: 3158 - protein, 368 aa, Sapria himalayana
ALTSFRLAAKAISRLQAISSGSISKLCNVLVKEVSHLTCYDRVMVYKFHEDEHGEVIAECIRPDLEPYLGLHYPATDIPQAARFLFMKNKVRMICNCMASPVKVLQAEGLDKPLSLCGSTLRSPHRCHEQYVANMNSIASLVLSVTINEEDGEMESTQSRPARLWGLVVCHHTSPKFVSFSLRYACEFLIQVFGIQINKEVELEAQRKEKHILQTQTLLCDMLVRDSPVGIITKSPNVMDLVKCDGAALFYRNKIWLLGLAPSEMQIRDIAEWLLECHGKSTGLSTDSLMESGYPGASLVGSSVCGMAAIRVTSKDFIFWFRSHIAKEFRWGGAKHGRHDKDDGRKMHPRSSFKAFLEVVKWRSLPWE

SEQ ID NO: 3159 - protein, 191 aa, Nuphar advena
DEFCSTSSMLKTLERYQKCNYGSIEASVPSRETQNSYQEYLKLKSKVEALQHSQRNLLGEDLGPLNSKELEHLEQQLEVSLKHVRSTKTQFMLDQLSDLKGKEQILQDANMALVRKLEGAAGSANHQQLSWENGGQHLQYGRHSGPQKDGFYHPLECDSTLQIGYNPTAQEQITVAAPAHNVNGFIPSWLV

SEQ ID NO: 3160 - protein, 636 aa, Unknown
  Azoarcus sp. EbN1
MDATTTHSRLSEHDIYLFREGSHGRLYDKLGCQLDEAGAHFAVWAPNARAVAVIGSFNAWRDDAAVLRPRDDGSGIWEGFVAGVAAGDVYKYSIVCQDGRVAEKADPFAQYAEVPPATGSRAWRSAHRWADDAWMAGRARANALDAPFSIYELHLGSWRRAQDGALPGYREIAPQLAAYVVEWGFTHVELMPLSEHPFYGSWGYQTTGYFAATARYGTPDDLMFLIDTLHQAGVGVILDWVPSHFPSDAHGLAEFDGTYLYEHADPRQGFHPEWHSCIFNYGRHEVCAFLLSSALFWLERFHIDGLRVDAVASMLYLDYGRQHGEWVPNRYGGRENLDAVAFLRRLNEAVYRDHPGVQTIAEESTAWPMVSRPLYVGGLGFGMKWNMGWMHDSLDYFRHDPLFRKFHHGRITFSIWYAFHENFVLPLSHDEVVYGKGSLIGKMPGDSWQQFAGLRALFGYMWAHPGKKLLFMGGEFGQRREWTHEGELEWWVLDRPEHAGLRHWVGDLNRLYRERAALHELDFDEAGFQWIDSDDSENSVLSFLRKSRNGATVLVICNFTPVTRPNYTLGVPRAGFWREALNSDATLYGGSGAGNLGGVETVPVPAHGHYQSLTLTLPPLAVLFLIPEVDDARPDS

SEQ ID NO: 3161 - protein, 355 aa, Nostoc punctiforme
MAHLFEPFKIREVTFRNRIAVSPMCQYSSTNGYANDWHVIHLASRAVGGAGIVFTEAAAIEPRGRISPQDLGIWSDAHIETLAKTVALIHNFGAVAGIQLAHAGRKASTAKPSKGGKTLDESQEGWRPLVSSSAIAFSQDSPVPEALSLKGIQEVIDAFVQGAKRSLQAGFKLVEIHAAHGYLLHQFLSPLANQRQDDYGGSFENRTRLLREVVQAVREVWPQTNPLWVRISATDWVDGGWDIEQSIALSDKLKSLGVDLIDTSSGGIIPGVKIPIQPGYQTQFAERIRREANIHTGAVGLITAPEDADEIIRTEVADIVLLGRELLRNPYWPHLAAKQLGHDKLWPVQYDRAWL

SEQ ID NO: 3162 - protein, 631 aa, Dianthus caryophyllus
MELCDCIDTQWQDELLVKYQYISDFFIAVAYFSIPLELIYFVQRSAFFPYRWVLMQFGAFIVLCGATHLINLWTFSMHTKNVAIVMTIAKMATAAVSCVTALMLVHIIPDLLSVKTREMFLRHKAEKLDKERGLILTQEETGRHVRMLTHEIRSTLDRHTILKTTLVELGRTLNSEECALWTPSQTGMTMRLSHTLNHSMVVGSTVSMNLSVISEVFNNTGAVRIPHTCPLVRTRPVSDRYRAPDVVAVRVPLLHHSNFQINDWPDNSAKNYAVMVLISPSDGIRKFRDHELELVEVVADQVAVALSHAAILEDSMRARDQLMEQNVALDLARREAEMAIRARNDFLAVMNHEMRTPMHAIISLSSILLETELTPEQRMMLEIILKSSNLLSTLINDVLDLSRLEDGSLELDPTVFNLHAVFTEVIQLIKPIASVKKLSLTLGLAPEVPVYAVGDEKRLMQTILNVVGNAVKFTKEGFISVSASVARPESLTDWRASEFYPDLTDSQFYLRVQVRDSGCGINPQDIPLIFNKFTQFNRNSNGIGLGLAISKRFVNLMGGQIWIESDGHDKGSISTFVVKLGTCKGSSDTLTPATVRTHSEHGNTEFISNKQLFRGDDSINSIFKPYERSFR

SEQ ID NO: 3163 - protein, 237 aa, Acorus americanus
MGRGRVELKRIENNINRQVTFAKRRNGLLKKAYELSVLCDAEVALIIFSNRGRLFEFCSSSSMLKTLDRYQKCSFHAAESSAPSRELQSSYQEYLKLKAKVEALQRSQRNLLGEDLGPLNSKELEQLESQLEMSLKQVRSTKTQYMLDQLCDLKRKEQMLQEANKSLKRKLDEYNSENPLQLSWDNGGSNVPYGRQPTHSEDFFQPLSVDPSLHIGYQVNAAATGQNVNGFIPGWMT

SEQ ID NO: 3164 - protein, 478 aa, Listeria monocytogenes
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 3165 - protein, 154 aa, Zea mays
MDARMFGLETPRVAALHHLLDVPDGDKAGGGATRTYVRDARAMAATPADVKELAGAYAFVVDMPGLSTGDIRVQVEDERVLVISGERRREEREDAKYLRMERRMGKFMRKFVLPDNADVDKVAAVCRDGVLTVTVEKLPPPEPKKPKTIEIKVA

SEQ ID NO: 3166 - protein, 440 aa, Myxococcus xanthus
MGATVYAGGTTFRVWAPMASRVFVSGDFNGWGTWIELGNEFNGNFSGDVAGAVKGQKYKFITRNQWGSDAWRADPRSAWQENSTGSSIIYDHGEYWWNAQQYSSPGFNEMIIYEMHVGTFHDSPGFGPGNWNSAIARLDHVRDLGANMIKVMPAYEFAGDFSWGYNAAFPFAPESAYGHPNDMKRFVDEAHMRGIGVIFDVVHNHYGPSDLPMWCFSGDCLGSGGEYFYNDWRKSTPWGDTRPDYGRPEVRAYIRDSMMNLTHSFRGDGLRWDATKYMRTQNGSDTTAIPDAWRVFRSINREINATQPWKISIAEDFGGGDFITNDATSDTSGGAGFDSQWGGDFVHAIRAAVIASNDSGRDMNSVRNAITQRYSGRHTARVIYSESHDEVANGKARVPEEIWPGNAGSWAAKKRSTLAAGVVFTSPGIPMIFQGQEFLE

SEQ ID NO: 3167 - protein, 447 aa, Arabidopsis thaliana
MSGSRRKATPASRTRVGNYEMGRTLGEGSFAKVKYAKNTVTGDQAAIKILDREKVFRHKMVEQLKREISTMKLIKHPNVVEIIEVMASKTKIYIVLELVNGGELFDKIAQQGRLKEDEARRYFQQLINAVDYCHSRGVYHRDLKPENLILDANGVLKVSDFGLSAFSRQVREDGLLHTACGTPNYVAPEVLSDKGYDGAAADVWSCGVILFVLMAGYLPFDEPNLMTLYKRICKAEFSCPPWFSQGAKRVIKRILEPNPITRISIAELLEDEWFKKGYKPPSFDQDDEDITIDDVDAAFSNSKECLVTEKKEKPVSMNAFELISSSSEFSLENLFEKQAQLVKKETRFTSQRSASEIMSKMEETAKPLGFNVRKDNYKIKMKGDKSGRKGQLSVATEVFEVAPSLHVVELRKTGGDTLEFHKFYKNFSSGLKDVVWNTDAAAEEQKQ

SEQ ID NO: 3168 - protein, 192 aa, Torreya nucifera
DDHGEVISEIRKSELEPYLGLHYPATDIPQASRFLFMKNRVRMICNCCSPPVRVVENKRLPRELNMCGSTLRAPHACHAQYMSNMGSIASLVMAVIINEKEEEQGESDGQQQQKGRRLRGLIVCHHTSPRFVPFPLRYACEFLMQVFGIQLNKEVESAAQLREKHILRTQTLLCDMLLRDAPMGIVTQKPNI

SEQ ID NO: 3169 - protein, 483 aa, Streptomyces avermitilis
MTQGPLTTEAGAPVADNQNSETAGVGGPVLVQDQLLLEKLAHFNRERIPERVVHARGAAAYGTFTLTRDVSQWTRAAFLSEVGKQTETFLRFSTVAGNLGSADAVRDPRGWALKFYTEEGNYDLVGNNTPVFFIKDAIKFPDFIHTQKRDPYTGSQEADNVWDFWGLSPESTHQVTWLFGDRGIPASYRHMNGYGSHTYQWNNEAGEVFWVKYHFKTDQGIKNLTTEEAVNVSGLDPDSHQRDLRESIERGDFPTWTVQVQIMPAAEAAGYRFNPFDLTKVWPHEDYPPIEIGKLELNRNPENIFAEVEQSIFSPAHFVPGIGPSPDKMLQGRLFAYGDAHRYRVGINADHLPVNRPHATEARTNSRDGFLYDGRHKGTKNYEPNSFGGPFQTDRPLWQPISVTGVTGDTEAPVHTEDNDFVQAGNLYRLMSEDEKTRLVDNLAGFISKVSRDDIAERAINNFRQADGDFGKRLEAAVQALRG

SEQ ID NO: 3170 - protein, 497 aa, Micrococcus luteus
VPHATGSTRENGAPAVSDRESLTVGSEGPIVLHDVHLLETHQHFDRMNIPERRPHAKGSGAFGVFEVTEDVSSYTKALVFEPGVETEVLLRFSTVAGENGSPDTWRDTRGFALRFYTSEGNYDLVGNNTPIFFLRDPMKFTHFIRSQKRLPNSGLRDATMEWDFWTNNPESAHQVTYLMGPRGLPRTWREMDGYGSHTYLWVNAEGAKHWVKYHFISQEGVHNLSNDEATQIAGENADFHRQDLFEVIAKGVFPKWNLYIQAIPYSQGKTYRFNPFDLTKTISQANYPRIKVGVNTLNRNPKNFFAEIESAAFSPSNTVPGIGLSPDRMLLGRAFAYHDAQLYRVGAHVNQLPVNSPDDATHNYAFEGEMWEDHTGNRSTYVPNSDGNSWSNEVGPTNNGWEAVGVLTREAEALRANDNNFGEAGTLTREVFSNEERNNFVQTVAGALKGVRSNVEAEAFVYWKLVNATNGERIQNTVKRKSGNGIPGVEAGGEARM

SEQ ID NO: 3171 - protein, 140 aa, Archaeoglobus fulgidus
MGMLIDPFEELRRMQERFNRLLEEFGRFPEVKEFRVTMPVDVIDEGEQIRVVADLPGFSKEDLEIYFEDGDLVIKAEKKEEFEEKKGEYLRRERRMGKVYRRIALPAGLDIDAVKAKYNNGVLEITIPKLKKDRKAVQIE

SEQ ID NO: 3172 - protein, 195 aa, Torreya nucifera
DEHGEVVAEIRRSDLEPYLGLHYPATDIPQASRFLFMQNRVRMICDCRATPVKVKQAEELKQPLCLVGSTLRAPHGCHAQYMANMGSIASLVMAVIINGNGIDEDGVSGSGSGSGRSSLKLWGLVVCHHTSPRAVPFPLRSACEFLMQTFGLQINMELQLAAQLIENSILRTQTLLCDMLLRDAPIGIVTQSPSI

SEQ ID NO: 3173 - protein, 499 aa, Hordeum vulgare
MIGTRVLAHSRVDPAIRWGVAARGRVVFAAIRWGAAARGRVVFAAVRWGAAARGTKREAGQETSTSETKKTKRKWGRGFCGMASHEVEEPLTSETKKTKRKWGRGFCGMASHEAEEPLTSETKKKRKNVAASSEPDKKRWFKNKIWKKKKAKNEQLATLVKEISLATKLNSAMHVNINLSMNICPTQTYEEHSGTYLRNLAVIAVKQLDKDGLQGNREFLVEVLMLSLLHHPNLVTLLGYCTECDQKILVYEYMPLGSLQDHLLDLTPKSQPLSWHTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPLLDSKYPLKGLYQALAISSMCLQEEAISRPLISDVVTALTFLADPNYDPPDDIEPLPISVPNYDKGISLREAEISLSGFEEKQVEDS

SEQ ID NO: 3174 - protein, 607 aa, Leptospira interrogans
MSLKKGSTAFSLLLSTLLAIFILFCEPTSGKSPVKADFTLKDFDNVVSHVSRYYIDKNIDKNRAYREAAIYALLSLPHSIYLYPESYFKERDKYEEKDEIFPGKTFKISTDDSFILFDPDYAEVEKIRDRKLKEDANKSKVSDEEVKKIVEREKIRKNVLASKWERTGFNKKDFDRVLAFIETNLDKYKDSPLKDPFGESEEKSKEPFTMNDVMLAAANGYLSSLDPHSNVFLRSAWEESMAKIQDGSFEGIGAILSGGGNKEVVVENPLEGRPAVNAGIRSGDVILAVDGKSIKGILLDKVVEKIKGKKGSKVALTIQRKGVPGTLHIEVVRDTIEIKNLSSKLIEGHEHIGYIKLTGFVKSEEGPSVDREIIEKYKELDKEAQAKGTRLKALILDLRNNAGGYLDLAIDIADMFIEKGLIVSTKSPNRSPEDAYAKNKDITNLPLAVLINAKSASASEIVASAIKHHGRGILLGERTFGKATVQKLMPLGNDYLIKLTQARYYSPSGNTIQVVGVKPDIDISSEEDGSFPFRFREENMWNHLSELPPEAEEKSSFDVKKLEAWVQKNGKASDFIASHKNDPIKPDYQLIRSLDYIEALLSTQKKK

SEQ ID NO: 3175 - protein, 376 aa, Oryza sativa
LISPAARGGREAKEMDRAALTVGPGMDMPIMHDGDRYELVRDIGSGNFGVARLMRSRADGQLVAVKYIERGDKIDENVQREIINHRSLRHPNIIRFKEVILTPTHLAIVMEYASGGELFERTCNAGRFSEDEARFFFQQLISGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPDEPKNFRKTIQRILGVQYSIPDYVHISPECRDLIARIFVANPATRISIPEIRNHPWFLKNLPADLMDDSKMSSQYEEPEQPMQSMDEIMQILAEATIPAAGSGGINQFLNDGLDLDDDMEDLDSDPDLDVESSGEIVYAM

SEQ ID NO: 3176 - protein, 106 aa, Brassica napus
MEPIPLLTPYKMGQLNLAHRIVLAPLTRQRSYGNVPQPHAALYYSQRASAGGLLITEATGVSDTAQGYRDTPGVWTAEHVEAWKPIVDAVHAKGALIFCQIWHVGA

SEQ ID NO: 3177 - protein, 218 aa, Glycine max
  misc_feature (176)..(176): Xaa can be any naturally occurring amino acid
MVLRKVGKYEIGRTVGEGTFAKVKFAQNTESGESVAMKVLDRSAIIKHKMVDQIKREISIMKLVRHPYVVRLHEVLASRTKIYIILEFITGGELFDKIVSHGRLSEAESRRYFQQLIDGVDFCHSKGVYHRDLKPENLLLDSQGNIKISDFGLSAFPGQGVSLLRTTCGTPYYVAXGVLSTRGYYGASPDVWSCGVILYVLLAGYLPFDELDLPTFVQ

SEQ ID NO: 3178 - protein, 326 aa, Fusobacterium nucleatum
MDNSMIFLNACKNGQKGVVEAFIKKGGLDFNKRDSLGNTALFYACMKGSKDIVKLLLSNGADGSLANNNSMIPLHAVSKSGNKEIISLLLDKGSDINTTDKEGRTPLIYTLMENRTEAAKLLLEKGADTQIKDNDGHKAIDYATANGLRDIITLLLKNENNDNKNNSGNTPLHQACYNNQSEVVRELLKQDGIELNIVNDNGNTPLIIAAIESNLLIVQLLLKAGADAKQRLLNGNTALHFAAENGNQYIGKALLEAGAEIDGQNEMGETALLIAAMEGYNDFVKLLVENGANVNIIDNSQNSPLFYASEKGYTEIVEILLLAGAE

SEQ ID NO: 3179 - protein, 551 aa, Buchnera aphidicola
MSKMGAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNPMRGIVKVAAVKAPGFGDRRKAMLQDISILTGGSVISEELAMDLEKSTLEDLGQAKRVVINKDTTTIIGGSGEKQAIQSRIGQIRQEIQEATSDYDKEKLNERLAKLSGGVAVLKVGAATEVEMKEKKARVEDALHATRAAVEEGVVAGGGVALVRVAGKISNLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPREDKSSDVASSPAGGMGGMGGMM

SEQ ID NO: 3180 - protein, 365 aa, Sapria himalayana
TSFRLAAKAISRLQAISSGSISKLCNVLVKEVSHLTCYDRVMVYKFHEDEHGEVIAECIRPDLEPYLGLHYPATDIPQAARFLFMKNKVRMICNCMASPVKVLQAEGLDKPLSLCGSTLRSPHRCHEQYMANMNSIASLVLSVTINEEDGEMESTQSRPARLWGLVVCHHTSPKFVPFSLRYACEFLIQVFGIQINKEVELEAQRKEKHILQTQTLLCDMLVRDSPVGIITKSPNVMDLVKCDGAALFYRNKIWLLGLAPSEMQIRDIAEWLLECHGKSTGLSTDSLMESGYPGASLVGSSVCGMAAIRVTSKDFIFWFRSHIAKEFKWGGAKHGRHDKDDGRKMHPRSSFKAFLEVVKWRSLPW

SEQ ID NO: 3181 - protein, 237 aa, Persea americana
MGRGRVELKRIENKINRQVTFAKRRNGLLKKAYELSVLCDAEVALIVFSTRGKLYEFCSTASMLKTLERYQKCNYGAPETTVSSRELQSSHQEYMKLKARVEALQRSQRNLLGEDLGPLTGKELDTLEKQLDVSLKHIRSTRTQYMLDQLGDLQRREHMLSEANKSLRRRLEEGMQENPNHAWDPNGYVRQQAPPQSDGFFHPIECEPTLQIGYQSSQITIAAPGPNVNNYMPGWLA

SEQ ID NO: 3182 - protein, 237 aa, Neurospora crassa
MATATESAPRNHLADKPENSMGGRNLSIITPTIQMSAPPGDPMDITSSNSNSSSNSNSSSINNNNATMAAPSNSDSLPPPKSPVEDTLNAQAAPNGRPQLSSANDQLSPDNIIMPAPAAAAPAVHQPKIVQTAFIHKLYNMLEDKSIQHLISWSPTSESFVMQPSQEFSKASSQYFKHTNISSFVRQLNMYGFHKGKESPDVAGYQQSLTWSKSERCLPPWSSRRYHLGVQAWQRQL

SEQ ID NO: 3183 - protein, 207 aa, Tetrastigma dubium
RFLFMKSKVRMICDCLAQPVKVIQDKTLAQPLSLCGSSLRSPHGCHAQYMSNMGSIASLVMSVTINEEDDDTESEQYRSRKLWGLVVCHHASPRFVPFPLRYACEFLVQVFGVQISKEMELAAQMKEKHILQTQTVLCDMLLRDAPVGIVTQSPNVMDLVRCDGAALYYQKKFWLLGVTPTEAQIRDIAEWLLEYHSGSTGLSTDSL

SEQ ID NO: 3184 - protein, 635 aa, Cochliobolus heterostrophus
MLENPSDESVVRWGNDGDSFVVLENEKFTKHILPKHFKHSNFASFVRQLNKYDFHKVRHNNEENGQSPYGPGVRFAHALCGYCPLGAWEFKHPDFKMNNKDALDNIRRKAPAPRKPNQAAAEDFAPSQQMDMVSGQLMATQAQLHQLEGRYNELNIHHSMLLQEVIGLQKTVVNHEHVMQQIMTFLHGVDATQRRNSKLVFNGGEAQNGNMDPPSNNDDDNPASPLQHASKLLSETNADAMLNPRNLEHMNEITMRMNGTLTTPPPDFARAQMRPTSRGPPSATSTNSMRLDNLDNLVYPVGSSNGIDPMYSEHINNIPYAAPPKAVDQNEPKVPEGKKKSAFPDPGWIRPPQILLVEDDPTCRRIGSKFLYAFHCSIDSALDGLEAVNKMNAGSKYDLVLMDIIMPNLDGVSACHLIRQFDTTPIVAMTSNIRSDDISMYFQHGMNDVLPKPFTKEGLLHMLEKHLVHLKKPSAQGDGSMVAPQPVPIARQLVLKEEESPGKSPQAVSNWNSPNQIPGVSPVGTSVPEDFAQAMRGQPVQHPNSYGVNPMQGNMGYNASSHMQIQSQQQQQQQQQQQQQQQQQQQQQQQAQLQGHRRQVSEISGGDDMNNPAKRQQMYPPQMQQQMGGMQPRPH

SEQ ID NO: 3185 - protein, 242 aa, Persea americana
MGRGRVELKRIENKINRQVTFAKRRNGLLKKAYELSVLCDAEVALIIFSNRGKLYEFCSSSSMLKTLERYQKCNYGAPETTVSTRETQSSHQEYLKLKARVEALQRSQRNLLGEDLGPLTSKELDTLEKQLDASLKQIRSTRTQYMLDQLADLQRREQMLSEANKNLKRRLEEGMQANPQVWDPNGHPVTYGRQQAPPQSDGFFHPLDTCEPTLHIGYQPADQITIAAPGPSVNNYMPGWLA

SEQ ID NO: 3186 - protein, 207 aa, Tetrastigma hypoglaucum
RFLFMKNKVRMICDCLAQPVKVIQDKKSAQPLSLCGSTLRSPHGCHAQYMSNMGSIASLVMSVTINEEDDDTESEQYRSRKLWGLVVCHHASPRFVPFPLRYACEFLVQVFGVQISKEMELAAQMKEKHILQTQTVLCDMLLRDAPVGIVTQSPNVMDLVRCDGAALYYQKKFWLLGVTPTEAQIRDIVEWLLEYHSGSTGLSTDSL

SEQ ID NO: 3187 - protein, 426 aa, Thiobacillus denitrificans
MFCLEFTHWEIAVTADKKPRLRTIQKSTKLDNVCYDIRGPVMARARQMEEEGQRIIKLNIGNPAPFGFEAPEEIVQDVILNLPNASGYSDSKGLFAARKAIMHETQRKGIAGVTIDDIIVGNGVSELIVMAMQALLNNGDEVLVPAPDYPLWTAAVSLGGGKPRHYLCDEGAGWLPDLDDIRAKITPSTRAIVIINPNNPTGALYPTELLREILEIARQHQLIVYADEIYDKVLFDGVVHTSIASLADDLLIVTFNGLSKNYRACGYRSGWLVVSGDKRHAKDYLEGLNMLASMRLCSNVPGQHAIQTALGGYQSINDLVAPSGRLTRQRDLAHELLTLIPGVSCVKPKAAMYLFPRLDPKLYPIHDDQKFILNLLEEERVLVVQGTGFNWPRPDHLRVVFLPHEEDLTEAIGRMSRFLDRQRAHR

SEQ ID NO: 3188 - protein, 359 aa, Unknown
  Vitis sp. Qiu 94-046
AGALKSYKLAAKAISRLQSLPSGNISLLCDVLVKEASELTGYDRVMVYKFHEDEHGEVIAECRRPDLEPYLGLHYPATDIPQASRFLFMKNKVRMICDCLAPPVKVIQNKRLAQPLSLCGSTLRSPHGCHAQYMANMGSVASLVMSVTINEEDDDTESEQQKGRKLWGLVVCHNTSPRFVPFPLRYACEFLVQVFGVQISKEMELAAQMKEKHILQTQTVLCDMLLRDAPVGIVTQSPNVMDLVRCDGAALYYQKKFWLLGVTPTEAQIRDIVEWLLEYHSGSTGLSTDSLMEAGYPAASLLGDAVCGIAAVKINSNDFLFWFRSHTAKEIKWGGAKHDPDDKDDGRKMHPRSSFKAFL

SEQ ID NO: 3189 - protein, 406 aa, Arabidopsis thaliana
MDLVSSRDTLGDPSTSTKALLLGFSRSRSDHCIIMSGESSSGSTEHCIKVVPTHGGRYVQYNVYGQLFEVSRKYVPPIRPIGRGACGIVCAAVNSVTGEKVAIKKIGNAFDNIIDAKRTLREIKLLRHMDHENVITIKDIVRPPQRDIFNDVYIVYELMDTDLQRILRSNQTLTSDQCRFLVYQLLRGLKYVHSANILHRDLRPSNVLLNSKNELKIGDFGLARTTSDTDFMTEYVVTRWYRAPELLLNCSEYTAAIDIWSVGCILGEIMTGQPLFPGKDYVHQLRLITELVGSPDNSSLGFLRSDNARRYVRQLPRYPKQQFAARFPKMPTTAIDLLERMLVFDPNRRISVDEALGHAYLSPHHDVAKEPVCSTPFSFDFEHPSCTEEHIKELIYKESVKFNPDH

SEQ ID NO: 3190 - protein, 571 aa, Ashbya gossypii
MCGIFACYRKDDIESFKPTALRLSKRVRHRGPDWSGNVIKNDTILVHERLAIVGLDSGAQPINSPDGNYVLCVNGEIYNHIHLREECSDYEFTSLSDCEPIIPLYLKYDVETPQHLDGMFAWCLYDVQRDRIVAARDPIGVTTLYMGKSSSSPRTRYFASELKCLVDECDEITAFPPGHVYDSDTDKLTRYFKPDWIDETRIPSQPVDYKAVRTTLEKAVRKRLMAEVPYGVLLSGGLDSSLIASIAARETERANREAGDVYADGKHLAGMDDRGLLHTGGWSRLHSFAIGLPNAPDLQAARKVAKFIGSIHHEHTFTLQEGLDALDDVIHHLETYDVTTIRASTPMFLLSRKIKAQGVKMVLSGEGSDEIFGGYLYFAQAPSPAEFHTETVKRVNNLHLADCLRANKSTMAWGLEARVPFLDREFLQLCMNIDPAEKMIAPQKGRIEKYILRKAFDTSDEPGVDPYLPEEILWRQKEQFSDGVGYSWIDGLKDAAERAISDEQFANPNPAWGDDIPTTKEAFWYRLKFDALFPQPTAAATVMRWVPKADWGCAEDPSGRYAKIHDQHISS

SEQ ID NO: 3191 - protein, 616 aa, Chromobacterium violaceum
MCGIAGWVSFERDLSTQRAVAETMTKTMALRGPDDEGLWLDRRAALGHRRLSIIDLEGGRQPMTADEDGRTLACLVYTGEVYNFRELRLELQGLGHAFRTRSDTEVVLRAYLQWGEAMLERLNGMYAFALWDAREQRLLLVRDRMGVKPLYYYPMPDGVLFGSEPKAILAHPEAERRVTAGGLREMLDLVKTPEAAAFAGMHEVRPGQVVTIDRGGLRKRRYWQLEAREHTDDLPTTIRTVRELLDDIVERQIIADVPLCTLLSGGLDSSVVTALAARSMRRQGKGTVRSFSVDFVKHGAAFEADYLRGSPDAPFVRDLAAHAGTEHREILLESRELADPRLRAAVLGAQDLPPAYWGDMLPSLYKLFEAIRAQSTVALSGESADEVFGGYRWFHDAAAVDGDAFPWLAGSSGAFFDGQSLIAPGLLRELDMPGFRRDSYAQALAEVPRLASDSTRERRMREISHMHLTRFVQALLDRKDRMSMAVGLEVRVPFCDHRLVEYVFNAPWSMKNFDGREKSLLRAAGKDVLPESIVRRVKSPYPATQDPAYEQALRQGLARVLDDSRSPALPLLDKAAAWKLLDRPFGKTSTSPERAGLEMALGLDEWLRHHQVSLDL

SEQ ID NO: 3192 - protein, 397 aa, Oryza sativa
MRMEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNALVVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 3193 - protein, 553 aa, Azospirillum brasilense
MAWLGHRRLSINDLSPAGNQPLLHAGGGTGDVLALVCNGEIYNAPTLRTELEALGHAFASRSDNEVILHGYRAWGDAVVDRLTGMFAFVLWDDRRRRLLAARDRVGIKPLYWAEPGDGGIAFASEARPLATLPGIGPAVELRALGHALTLGYVPAPLSAWRGIHKLEPGRLLVWEPGQGAALRRYWEAPRSLAAAGDGDAGWAGLFDRAVADHLLSDVPAGLFLSGGLDSAAVATAAVGAGLRPAAYTLCYPGRPDAEAEVAAAVARHLGLEHRLVPAPTDGLADRLAGVAALFDEPQGYSALVTMAGIARAAAAEHKVVLSGDGGDEVLGGYAWYAGLDPDGPPPGAEAGDAHAAFAARSVLHRHAMRLFPRFLPDEVEALFAPAGLRFGEEEMLAPLEAAFEPGLPLRRALQRVDLATFCADSILAKVDRASMAYGLEVRVPFLDHRLVEWGLSRPPAAEEAVHGKPVLRRYLAGRVPERVFGHPKTGFSLKDTGPFDWNAALDRVAAGPLVRHGLLDPGFRRIVEARSPYRQARIWALLALSLWAGSWME

SEQ ID NO: 3194 - protein, 404 aa, Erwinia carotovora
MSPIEKSKKLENVCYDIRGPVLKEAKRLEEEGNKVLKLNIGNPAPFGFEAPDEILVDVIRNLPTAQGYCDSKGLYSARKAIVQHYQARDMRDMTVEDVYIGNGVSELIVQSMQALLNPGDEMLVPAPDYPLWTAAVSLSNGNAVHYLCDESSDWFPDLDDIRKKITSNTRGIVIINPNNPTGAVYSKELLLDIVAIAREHSLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRNRSWELINQIPGVSCVKPRGALYMFPRIDAKRFNIHDDQKLVLDLLLQEKVLLVQGTAFNWPYPDHVRIVTLPRIDELDMAIHKLGRFLGHYHQ

SEQ ID NO: 3195 - protein, 1124 aa, Mougeotia scalaris
MSSSKRSQSSGRSSTQTRIQNRVTQASADAKLSTAFEVSSSSGGDSFDYTKSVTASLNPTEPLAAKSVTAYLQRMQRGSIIQSFGCMMAVEPGTFRIIAYSENVSEMLGVTPQSVPTGDQQNAIGIGTDVRSLLSPSSVSVVEKAVAANDVSMMNPITVYSLATQKPFFAILHMNDVGLVIDLEPISSSSDSAMFSAGAVQSHKLAAKAISRLQSLPGGDICGLCDVVVEEVRELTGYDRVMAYKFHDDEHGEVVAEIRRSDLEPYLGLHYPATDIPQASRFLFIKNRIRMICDCTSPQVKVVQDSRIPQEMSLAGSTMRGVHGCHTQYMMNMGSTASLVMSVTINDTNEIAGGPGMKGRKLWGLIVCHHSTPRHIPFPIRSACEFLMQVFGLQLNMEVELAAQHREKHILRTQTLLCDMLLRDAPMGIVSQSPNVMDLVKCDGAALLFGGRCWLLGISPTQEQVKDIATWLISSHTDTTGLSTDSLVDAGYPKARELGVDVCGMAAARITENDFLFWFRGHAQKEVKWAGAKDGGSEEDGSRMHPRSSFKAFLEVVKQRSLPWEDVEMDAIHSLQLILRGSFQDIEDKEDRKIVHARLKEMHLQGMEELSSVASEMVRLIETATAPILAVDTAGCVNGWNFKISELTGLSIPEVMGKSLVKDLTHPSSKDTVEKLLYMALNGEEEQNVEIRLKTWGMQQGKGPVILMVNACASRDVSEKVVGVCFVAQDVTGEKIVQDKFTRIQGDYTTIVRSHNSLIPPIFGSDESGFCVEWNPAMERLSGVKREEAIGKMLTRELFGGILRLKNVDGLTKFMIVLNAAMSSHDTDKFPFTFYDRSGKIVEVLLTTSKRCNSEGVVTGVFCFLHTASSELQQALTVQKAAERVAEVKAKELAYIRQEIQNPLDGIHFARSFMEHTVLSEDQKQLIETSATCEKQLRRILADMDLASIEKGYLELETGEFSMATVMNSVVSQGMIQSTQKNLQLYCDTPPDFKSLSVFGDQVRLQQVLADFLLNAVQFTPPSGWVEIKVEPVVKKLPGGVSVAKLDFRVSHPGEGLPEDLIDQMFDRADARVKSQEGLGLSICRKLVRLMNGEVQYRREGERNFFLLQLELPLAQRDDQASMK

SEQ ID NO: 3196 - protein, 451 aa, Pichia angusta
MGTKSMTDVTAEELSKDSVAMMLAKDRELKNKYLKQKHISEQPWTWENWHRHINWLNFTLVLAVPLAGLISTKWVPLKLHTFVTAVILYCFGGLSITAGYHRHWAHRAYDCRLPVKIFFALFGASAVEGSIKMWGHQHRVHHRYTDTPRDPYDAKRGFWYSHMGWMLLVPNPRYRARADISDLLDDWVVRVQHRHYLLLMVVMAFFFPAILTHFLFNDFWGGFIYAGLLRAVFIQQATFCVNSLAHWIGEQPFDDRRTPRDHILTALVTFGEGYHNFHHEFPSDYRNALKWYQYDPTKVVIYLLSKVGLAYNLKRFSQNAIDQGILQQQQKKLDRMRAKLNWGPQLSELPVWDKSTFFEKAKEQKGLVIISGIVQDCSNFLTEHPGGQALLKTSFGKDATMAFNGGVYAHSNAAHNLLATMRVAVIRDGGANGDTFDAQLRYLASKENKKE

SEQ ID NO: 3197 - protein, 493 aa, Prochlorococcus marinus
MTKFQSIFWHRRDLRFGDNIGLFEASKNSKSLIGVYVLDPKLLDLNRTTSEAKNWFLGESLIELQKNWEIRGSRLLILNGDPIELISKLAELVHAECIYWNENIEPYEINRDKQIAEKLSKEKRKVYTFLDQLIVNPSNIKTNNDEPYKVYGPFYRKWIDLINITKSSENNLIQTSETAKQLTGLNERELSSIKNSDLNYCITNKSKSIYELLSLNRFNKTNLCPCKPGESESIKQLNSFIHSGVINSYNKARDIPSLENTSHLSAALSLGTISCRVVWNGAQVSKNATDDEYKINSIDTWIKELAWREFYQNALINFPELEKGPYREKWLDFPWQNRPDWFEAWGDGLTGIPIIDAAMRQLKCSGWMHNRCRMIVASFLVKDLLIDWRLGELFFMKSLVDGDLAANNGGWQWSASSGMDPKPMRIFNPFRQASKFDEDGEYIRKWIPELSHISTPNLLSGEISSAERNSYPKPIISHKNQTSIFKELYSNIK

SEQ ID NO: 3198 - protein, 567 aa, Kluyveromyces lactis
MLHKEKDIEESKRFFHHSTSGMEGNPDGFGLLPDGSKLESVKDTRIDKFAVPKKGLHSEHVYNLVKNELKLDGNPVLNLASFVNTFTDQFAQKLIDENLNKNLADNDEYPQLIHMNERCISMLAKLWQSDTDRDTPLGCATTGSSEAIMLGGLAMKRQWEKKMRAANKSTEKPNIIMSSACQVALEKFARYFDVECRLVPVDTEHGYHLNPNKLWDYVNENTIGIFVILGTTYTGHLENIEQVAEVLEHIEAQHPDWSNKDIPIHVDGASGGFIVPFAFTEAQMESYGLGRWGFNHPRVVSINTSGHKFGLTTPGLGWIVWKNDEYLLPELRFKLKYLGGIEETFNLNFSRPGFQVIHQYYNLLTLGQQGYYEKFNQSIFVARAFAWKLLQDPDMRDVFEVVSCLHENLDNSSIAESLDDYWKNPHDYKPGIPLCAFKLSEKFKSEHPEIPQSIISTLLRQKGWIIPNYPLPESTDGSDKKEVLRVVFRIEMKLDMALLLVQDVFEVVQKLLKSYEYLNIRTENDNHAVFKVLSTLSNADVSELEHELTDSQKEKEQHIKKNYRGTC

SEQ ID NO: 3199 - protein, 477 aa, Listeria monocytogenes
MTESKFPKDFLWGGAVAANQCEGAYLEDGKGLSLVDILPTVEDGRWEALFNPSKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEDNPEEVKYQAAHHQLVASALATKLGHEINPENQIGCMLAAGNTYPMTCNPKDVWKSIEADREGYFFIDVQARGYYPSYTKRFFKEHNINIKMEDGDLDVLRDHTVDYVAFSYYSSRLTSADPEKNKETEGNVFATLKNPYLKASEWGWQIDPLGLRITMNTIYDRYQKPLFIVENGLGAVDTVAEDGSITDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 3200 - protein, 180 aa, Triticum aestivum
  misc_feature (17)..(17): Xaa can be any naturally occurring amino acid
QAPSSHRPYYQLIRHGXEGYRNIMENCQENAMVVKEGLEKTGRFNIVSKDEGVPLVAFSLKDHSRHDEFEISDMLRRFGWIVPAYTMPADAQHVTVLRVVIREEFSRTLAERLVLDIDTVMAQLDALPSKLAPPALLPATLPKTVVVANGHVKKTELETQKSVTEAWKKFVLAKKTNGVC

SEQ ID NO: 3201 - protein, 252 aa, Gloeobacter violaceus
MLVHRLNALKDNYVFVLEDEAARTAAVVDPAEARPVLEALVRLGLKLVAIFNTHHHHDHVGGNRELLEAYPGIAVYASRRDRGRIPGQTVELEDGDTVAFGCERARVIFVPGHTHGHIAYHFAGCGHLFCGDTLFAGGCGRLFEGTARQMQHSLGRLRELPGETQVWCAHEYTLGNLRFAHTLEPDNAELAERLRTVEVLRARKIATVPSTMAAERATNPFLRWESRQLQRAAGAIEPEEVFAHLRALKDRF

SEQ ID NO: 3202 - protein, 462 aa, Glycine max
  misc_feature (308)..(308): Xaa can be any naturally occurring amino acid
MESKPHVLMQRYELGRLLGQGTFGKVYYARSTITNQSVAIKVIDKDKVMRTGQAEQIKREISVMRLARHPNIIQLFEVLANKSKIYFVIEYAKGGELFNKVAKGKLKEDVAHKYFKQLISAVDYCHSRGVYHRDIKPENILLDENGNLKVSDFGLSALVDSKRQDGLLHTPCGTPAYVAPEVIKRKGYDGTKADIWSCGIVLFVLLAGYLPFHDPNLIEMYRKISKAELKCPNWFPPEVCELLGMMLNPNPETRIPISTIRENSWFKKGQNIKNKRPVVENNTVSSSSTVLLDQNDCDGLAAEANGEXVVPLSINAFDIISRSVGFDLSRFFDESFKIKEARFSSRLPANVIISKLEDIAKQLRMKIKKKAAGLLKLESLNEGRKGVLSIDAEIFEVIPCFHMVEVKKSNGDTLEYQKILKEDIRPSLHDIVWVWQSDQQLQSQQSEQHQHTDDQQQQQPQS

SEQ ID NO: 3203 - protein, 574 aa, Candida glabrata
MLRSTTSKSLSKMPHAIPPQCRRSHSSSIFQTKKRLAHLESDRPYLTHLPRSMNSSPNLRFHSSASSSSLRSSFLNTEIHHHSHNNLPFLPAEQATLKDVNECVLNAKYAVRGAIPMRAEELKTQLMENPHSLPFNDIINANIGNPQQLKQKPLSFYRQVLSLLQYPELIPTLENNPQTMIKQDAIDRAKRLLDDIGGSVGAYSSSQGVLGIRKTVADFITNRDDGIIAYPEDIFLTAGASSAVDYLLSIFCRGEETGVLIPIPQYPLYTATLALQNSHALPYYLNEETGWSTDPEELESIILDSIENNIKPSVLVVINPGNPTGAVLSEEAIEQIFTLAAKYGIIVIADEVYQENVFEDVKFHSMKKVLRQLQMKQPGLYDNVQLASLHSTSKGVSGECGQRGGYMELVGFTHDIRQVVLKLASISLCPVVTGQALVDLMVCPPQKGEESYEQDQEERRNIHKELHKRATLLHDAFVKLDGISCQKPQGAMYLFPKLELPYKAIQEALHQDMSPDEFYCKSLLEKTGICTVPGSGFGQEPGTYHLRTTFLAPGTKWIEDWVDFHQEFYNKFKN

SEQ ID NO: 3204 - protein, 203 aa, Arabidopsis thaliana
MGRKKRAMWERKWKRLDIVKAFASLFVHFLCLLAPFNFTWPALRVALIVYTVGGLGITVSYHRNLAHRSFKVPKWLEYFFAYCGLLAIQGDPRQRVRTHRYHHQFTDSDRDPHSPNEGFWFSHLLWLFDTGYLVEKCGRRTYVEDLSRQWYYKFLQRTVRYHIPTFGFLLYYFGGLSFPTWGMGNILYSFPFIFKKFPTKTLK

SEQ ID NO: 3205 - protein, 743 aa, Pseudomonas fluorescens
MSFSNREQGHAKERLLPTAKDIDALVRAEHHDPFSILGPHGDGAGGQFIRAYLPGALSVSVVDKNSGEELGPLEATETPGLFVGHFEGSRPYLLRTRWAGGEQVAEDPYSFGQLLGEMDLYLFAEGNHRDLSSCLGAQLKTVDGVDGVRFAVWAPNARRVSVVGDFNVWDGRRHPMRLRHPSGVWELFIPRLQAGELYKYEILGAHGILPLKADPMALATSLPPDTASKVASPLQIDWQDQDWMSGRRERQQHNAPLSIYELHAGSWQCELDDLGEVARQYTWPELAERLIPYVKELGFTHIELMPIMEHPFGGSWGYQLLSQFAPSARYGTPEQFGEFVNACHQAGIGVILDWVPAHFPTDTHGLAQFDGTALYEYGNPLEGFHQDWDTLIYNLGRTEVHGYMLASALHWLKHFHIDGLRVDAVASMLYRDYSRKAGEWVPNRHGGRENLEAIDFLRHLNDVVALEAPGALVIAEESTAWPGVSQSTQQGGLGFAYKWNMGWMHDSLHYIQQDPVYRAHHHNELSFGLVYAWSERFILPISHDEVVHGKHSLIDKMPGDRWQKFANLRAYLSFMWTHPGKKLLFMGCEFGQWREWNHDQQLDWYLLQYSEHKGVQKLVSDLNRLYREEPALHEQDDAPQGFQWLIGDDAINSVYAWLRWSKDGTPVLVVANFTPVPRQSYRVGVPFAGRWKELLNSDADTYAGSNYGNGGGAFTEEVASHGQALSLELNLPPLAVLILKPEV

SEQ ID NO: 3206 - protein, 252 aa, Brassica napus
MAYQMELGGESSPQRKAGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPSMSLMPGGSNYEQIMPPPQTQPQPFDSRNYFQVAALQPNNHHYSSAGREDQTALQLV

SEQ ID NO: 3207 - protein, 454 aa, Streptomyces avermitilis
MTKRDVAALFGNRFLTEPAPSQTFPEEGMTATDTMRLLDEDLVMEGDPQRNLATFVTTWMEPEAQRIIAENLHRNFIDHAEYPISAEIEQRCVRMLADLFHAPGKTTGCRTQGSSEAIMLGALSLKWKWRERRQAANLPADRPNLVFGGDVHVVWEKFCRYFDVEPRIVPLAEDKYTIGPEDVEPHIDENTIGVVAVVGTTFTGHKDDVVGIDKLLRDVRKERDLDIPIHVDGASGGFVWPFLYPDSKWDFRLEQVRSINVSGHKYGLVYPGIGWLVFREESDLAKDLVFYENYLGKTDATFTLNFSTGASMVLAQYYNFVRLGRQGYTYVMETMQKNAHALADNLRSSGRFEVIGSDLEQLPLVAFRLAGEHAYDESDIAWQLSAERGWMVPAYTLPPNAERVKILRALVKETLSREQIERLTQDIADACATLDHKGGTTEVERAQIKRGTGY

SEQ ID NO: 3208 - protein, 719 aa, Kluyveromyces lactis
MTGDNNDIPENVRGVVEIDSWLTPFAKVLSERRYLADEWRYKIEHSTNSEGRDTTLAQFARDAYKSFGLHADPGSLEIRYKEWAPNAVRAFLIGEFNSWNENANEMQRDEYGIFTTVVPPVVDDSGNKQYGIPHDSKVKVCFQLADGSRIYRLPAWITRATQPDKETAKQWGPSYEARFWNPPVHYSFKNKRPGFMRDTDSLRIYEAHVGISTPEPKVGSYKEFTQNVLPRIKDLGYDAIQLMAIMEHAYYASFGYQVTNFFAASSRFGTPDELKELVDTAHGMGILVLLDVVHSHASKNVTDGLNQFDGSDHQYFHSLASSRGEHPLWDSRLFNYGHFEVQRFLLANLAFYIDVYQFDGFRFDGVTSMLYLHHGVGEGGAFSGDYNEYLSSERSFVDHEALAYLMLANDLVRELLPDNGITIAEDVSGYPTLCMPRHLGGAGFDYRLAMALPDMWIKLLKESRDEDWEMGHIVHTLVNRRHREKVVAYTESHDQALVGDKTLAFWLMDAAMYTDMTILKESTPVVDRGIALHKLIRLITHSLGGEAYLNFEGNEFGHPEWLDFPNVNNGDSYHYARRQFNLVDDPLLRYQYLYQFDKAMQTTEKNYKWLNTPQAYVSLKHEVDKVIAFERNGLLFIFNFHPTESFTDYRIGVNEPGCYRIVLNSDKHEYGGWDRIDESQSKYFTTDLKWNERNNFIQVYIPNRTALVLALDSRVRNGN

SEQ ID NO: 3209 - protein, 782 aa, Gibberella zeae
MVQYVFTPWRDRYELLLVREQMYTGITTNARDPKQKLGQDASGSSEDMQIRQDIDDKEMRARQHQAVARVSMWMQRGNCPHLIESTALLMAAMLSDREAATRENAASSAYAIRATYSAAFSRFVTGLLDSHQDKQRKQSMYSVADTIGLPATFVELRHQCTHEQLPSLAKLRTAARKALLWIWDYHWKQLDEDSSDPCRMAILRYLKEGDATKLGTILDDFERWPKERLLKTIQEVRGSLPGNQVFLKCAQLTQQLKGAKVDKKATNPGAMDTTMKDHEVDTVIVVEEDDDFGWSQFQGPWKPKPIGIVYNGMYHVPSPASTNVMTAAGTGAMMLRTRGKPAISQTEDWIFINCREGSSNNYAYLVVDDKSKDAVIIDPANPPEVAPILKDAIQAGKINLTAILAELGTPKLDIIGGKDCEGVTKTPGHGETFKLGDITFKGVHTPCHTQDSICFFAQDGNDKAVFTGDTLFIGGCGRFFEGDAKEMHKALNERLAALPDDTVVYPGHEYTKANVQFAASISQREAVQSLHSFAENNKVTTGKFTIGDEKEHNVFMRVEDPEIQKQTGETEPVAVMAKLREMKNNFNPVGNLISPPKRKTPAASGSAAPKTRQSKLAKEHNVTPQEEGEIREAFSLFAEPMDGEKYGVLPIDDVKSALIALGVPPSSYAELKEFVSILDPDNDGYATFEPFFAICALKFHTREHDSDAHRAEVEEAFRLFTNGQDGPITLGHLRRVAAVLKEDVDEELLKDMILEANGGVGVARGVGAEEFDRVMKSAGVWR

SEQ ID NO: 3210 - protein, 801 aa, Streptomyces coelicolor
MRSSQGSGADPGARGRVDQRLRRGARPAPTSPHSPAKTNHPLRAAIIGGGPGGLYTAALLKRLAPDREVTVYERNAPDDTFGFGVVLSDETLGGIEHADPTVYEALKAHFVRWDDIDIVHRHTRHTSGGHRFAALGRRRLLEILHDRCRDLGVELRFRTEAPPPDRLARTHDLVVAADGVHSATREAYRDVFRPRLTPHRCRYIWLAADFAFDAFRFEIAETEHGVMQLHGYPFAPDASTVIVEMREEVWRAAGFDELDETESTARCAKIFADALGGRPLRSNKSAWTTFRTVVNERWSHGNIVLLGDAAHTAHFSIGSGTKLAVEDALALAACLAERPTLQEALTAYEEERRPVVASTQRAAKASLEWFEDLDRYLAQPPRQFAFNLLTRSRRVTHENLRLRDAGFTESVEREFGCPPDTPPMFTPFRLRGLTLRNRVVVSPMDMYSATDGVPGDFHLVHLGARALGGAALVMTEMVCVSAEGRITPGCAGLYTGRQGEAWRRITDFVHDGAPGTAIGVQLGHSGRKGSTRLMWEGMDEPLPDGNWPLVAPSPLPYRPGGQVPRELSRAQLADVREQFRAAAERAAGAGFDLLELHCAHGYLLSGFLSPLTNHRTDAYGGSPENRLRFPLEVFDAVREVWPDERPMTVRISATDWAEGGTSAEEAVEIARAFAAHGADAIDVSTGQVVSGERPEFGRSYQTPYADRIRHEAGVPVIAVGAISSWDDVNSLVLAGRTDLCALARPHLYDPHWTLHAAAEQGYDGPGARWPAPYRAGSRPPRTGRTDAPRPRLTLHGPGQDG

SEQ ID NO: 3211 - protein, 178 aa, Zea mays
MATTHDDCVSLCLMALAAAGGGGMTTQSYAPSTAAWTTQECELRFRCSVCGKAFASHQALGGHKASHRKPTHLQTQQASSSSVTTSSAGSGGGQGRHRCSVCHRSFATGQALGGHKRCHYWDGLSVSLTASGSGSTVKGFDLNLMPATRWGEEEEVQSPLPIKKRRLSGPSLDLSLTI

SEQ ID NO: 3212 - protein, 392 aa, Zea mays
  misc_feature (315)..(315): Xaa can be any naturally occurring amino acid
MRMEGAGGGAGGGGAGAGGCLGMGHGGEAQIKGTHTHGGRYVQYNVYGNLLEVSAKYVPPIRPVGRGACGIICAAVNAQTREEVAIKKIGNAFDNQIDAKRTLREIKLLRHMNHENVISIKDIIRPPRRENFNDVYIVYELMDTDLHHLLRSNQQLTDDHCQYFVYQLLRGLKYVHSANVLHRDLRPSNMLLNAKCDLKIGDFGLARTTTETDFMMEYVVTRWYRAPELLLNCSEYTQAIDMWSVGCIFGEMVTREPLFPGKDYVHQLRLITELVGSPDDTSLGFLRSDHARRYVRSLPQHPKQQFRVRFPTMSXSGAMDLLERMLVFDPSKRITVDEALCHPYLASLHEVNDEPICPAPFSFDFEQPSLTEEAIKELIWKESLKFNPDPIH

SEQ ID NO: 3213 - protein, 572 aa, Aspergillus nidulans
MASSVVPVALQNKLLGYGRAPSAQLAVLNLDLVRNIVFALFLFRYVRKTFYSLRGYGFFGSIHNVYLAIRLFLYSIFLRFPGVRGQVDKQVTAAIEGLESKLVANGPGVTRYLTLPKEGWTHEQVRAELAKLGNMEHTRWEDGRVSGAVYHGGKDLLKIQAEAFEQFGVANPIHPDVFPGVRKMEAEVVAMVLAMFHGPSDGAGVTTSGGTESILMACLAARNKARAERGVTEPEMIIPDTAHAAFIKASSYFGIKLHRVPCPAPDHKVDIAKVRRLINSNTVLLVGSAPNFPHGIVDDIPALSRLATHYKIPLHVDCCLGSFVIALLKKAGFPSPYEEEGGFDFRQPGVTSISVDTHKYGFAPKGNSVLLYRNKTYRSHQYFIYPDWSGGVYASPSVAGSRPGALIAGCWASLMSVGESGYIKSCLDIVNAAKKFESAINEDARLSPNLQVVGQPMVSVIAFESKNDAVDIYDIADDLSAKGWHLNALQSPPAMHVAFTIPTAAAVDTLISDLVAVVEKELEKAEERKRQGKSYVVKRGDTSALYGVAGSMPDKSIVSRLAEGFLDTLYKA

SEQ ID NO: 3214 - protein, 411 aa, Arachis hypogaea
MLEGGAKFPGLIDLNKHTTDNYYDFSQGFYHKLGEGTNMSIDSMQTSNGGGSVAMSIDNSSVGSNDSHTRILNHQGLRRRANDNYSVQNSVNRRGRVTHALSDDALAQALMDSSSPTEGLENFDEWTIDLRKLNMGEAFAQGAFGKLYRGTYNGEDVAIKILERPENELSKAQLMEQQFQQEVMMLATLKHPNIVRFIGACRKPMVWCIVTEYAKGGSVRQSLMKRQNRSVPLKLAVKQALDVARGMAYVPWLGLIHRDLKSDNLLIFGAKSIKIADFGVAGIEVQTEGMTPETGTYRWMAPEMIQHRPYTQKVDVYSFGIVLWELIPGMLPFQNMPAVQAAFAVVTKNVRPIIPNDCLPVLRDIMPRCWDPNPDVRPPICRNCRNAETEIMTTVRKARFRCCMTQPMTAD

SEQ ID NO: 3215 - protein, 360 aa, Pseudomonas syringae
MSEKTLFQPYALGNLTLTSRIVMAPLTRNRAGAGLAPTDLAATYYAQRASAGLIITEATQISPQAQGYQDTPGLYTPEQIAAWRVVTDAVHAEGGRIFVQLWHVGRVSHVDLQPGGAAPVAPSAIRAQTKTFVNNAFTDVSEPRALELSELPGIVNDFRQAAANAIEAGFDGVEIHGANGYLLDQFIKDSANVRTDAYGGSVENRARLLLEVVTAVVKEIGAHRTGVRISPVSPANGVASSDPQPQYEYIAEQLSEQGIAFLHVVEGATGGPRDVAPFDYDALRQRFKHTYLANNGYDLDLATARVNANKADLVAFGRPFISNPDLIERLKTGAPLAELNPATLYGGGAEGYTDYPTIAG

SEQ ID NO: 3216 - protein, 461 aa, Helicobacter hepaticus
MRPKRNMSTEFYITKAVSMMNKSRVVVAGIIVSLLASSALFVGLSADESHKAKPKVQEVNKLESFKKLRRIMAIVEESYVDELSLDEIVNKAIDGLLSNLDAHSNYLNKKKFDDLRANIDGEFGGIGITVGLKDGALTIIAPVDGTPGDKAGLKSGDVIVKVNDKSTIDMSIDDAVNLMRGTPRTKVELTIVRKGEAKPLNFSIVRDIIKMDFVKVRKIQDTDFAYVRVASFDKNVTRNVLSSLKQMGKVKGIVLDLRNNPGGALDQAVDLSRLFIKNGVIVTQKGRNKNDNVEYRATNAPYASVPIVVLVNGGSASASEIVAGALQDHKRAVLIGEQTFGKGSVQTFMQLDQNEGLKLTTAKYYLPSGRTIQAVGVTPDIIVYPGVAPENENSFSIKESDLKRHLQGELEKVNEQNTKTETASDDKKNITQAMIYQDIQLKSAIDVLKAWGVIGALNPNK

SEQ ID NO: 3217 - protein, 331 aa, Arabidopsis thaliana
MPVISKASSTTTNSSIPSCSRIGGQLCVWPGLRQLCLRKSLLYGVMWLLSMPLKTLRGARKTLKITHFCSISNMPSSLKIELVPCSKDNYAYLLHDEDTGTVGVVDPSEAAPVIEALSRKNWNLTYILNTHHHDDHIGGNAELKERYGAKVIGSAVDKDRIPGIDILLKDSDKWMFAGHEVRILDTPGHTQGHISFYFPGSATIFTGDLIYSLSCGTLSEGTPEQMLSSLQKIVSLPDDTNIYCGRENTAGNLKFALSVEPKNETLQSYATRVAHLRSQGLPSIPTTVKVEKACNPFLRISSKDIRKSLSIPDSATEAEALRRIQRARDRF

SEQ ID NO: 3218 - protein, 406 aa, Triticum aestivum
  misc_feature (30)..(30): Xaa can be any naturally occurring amino acid
FLRAPGARTPVIVRFSTVIHERGSPETIRXPRGFAVKFYTREGNWDLLGNNFPVFFIRDGIKFPVVMHAFKPNPKCHVQEYWRVFDFLSHHPESLHTFFFLFDDVGIPTDYRHMDGFGVNTYTFVTRAGKSHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRQAEPASFPVPTRPVVGRREKTRIKKENDFVQPGERYRSWAPDRQDRFVRRFADALAHPKVSHELRVIWIDFLSKCDKSCGMKVANRLNVKPSM

SEQ ID NO: 3219 - protein, 153 aa, Lilium longiflorum
LKPLKSMDSKFEVDHSLIAKLNQLTEFLANRNQPLRAPFVPDARAMPAAATDIKDMPGAYVFIIDMPGVESEEIKIDVEEGNMLVISGERKREEEEERYLEMQRRMGKMMRKFKLLENANSGAISAVCKNGVLTVTVEKLPSQEPKAIEIKIA

SEQ ID NO: 3220 - protein, 293 aa, Ashbya gossypii
MCPACCKAHRSSSFMYRQLRKMHVKAIKMRWLTGGVNYSYLVSTQDKKASWLIDPAEALEVLPALSHDEKQSIRAIVNTHHHYDHAGGNLAIRAALKREGVAVPVIAGSTTSPVSTDIPEHLQKYTLGDSVEVLCIRTPCHTQDSICYFMRDTKTGQQALFTGDTLFTAGCGRFFEGTAEEMDAALNSRLLEHVQDHAATKVYPGHEYTKGNVHFIRSAIYMSEGDNPAFDRLESFANANAVTTGQFTLQDETEYNPFMRLDDPTIRRRVGDLHRTWARADVMAKLRSMKNTM

SEQ ID NO: 3221 - protein, 631 aa, Alkalilimnicola ehrlichei
MCGITGIFDLQAQRPIDVPLLEAMNQTQYHRGPDEGGLHHEPGVGLAHRRLSIIDLSSGQQPLFNEDGSVAVTYNGEIYNFPELTRTLQSAGHTFRTHCDTEVIVHAWEEWGEACVERFRGMFAFALWDRNRETLFLARDRLGIKPLYYAALPDGHLLFASELKALMAHPDLPRQLDPCAVEEYFGFGYVPEPRSIFAGVHKLPPGHTLTVRRGQGGVPASRAYWDVPFAPLPAMGEAEAAEELVRRLREAVEIRLVAEVPLGAFLSGGVDSSAVVAMMAGLSPDPVRTCSIGFDDPRYDESEYARMVAERYRTAHRLDQVNPDDFDLLGKLGALYDEPFADSSALPTYRVCEQARRQVVVALSGDGGDENLAGYRRYRHHLGEERLRGLLPLGLRRGLFGSLARVYPKADWAPRVFRAKATFQALARDAVEGYFQGVSILRDDLRRHLFSSGFRSELQGYSAVDVLRRHAAQAPTDHPLSLVQYLDMKTYLPGDILTKVDRASMAHALEVRVPILDHKLVEWMSGLPPEMKLNGSEGKHLLKKAMEPHLPHEVLYRKKRGFAVPVAEWFRGPLRQRVRDQVLGPRIGESGLFDMDFLNRLVDEHTRGARDHSPALWSLLMFDEFLAKARP

SEQ ID NO: 3222 - protein, 463 aa, Listeria monocytogenes
MSNNFLWGGATASYQCEGAWNVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTQKTMIAAYNVMYASALGVKAFKEGGYPGQIGIVHSYTPVNGVDESIETKIAMRYADNYCNNWILDTAALGEFPVDLVAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIESQGKLIKRREF

SEQ ID NO: 3223 - protein, 687 aa, Ralstonia eutropha
MRYPHLFKPLQLNQLTLRNRIVSTAHAEVYAEPGGLPGDRYIRYYEEKAKGGVGLAICGGSSPVSIDSPQGWWKSVNLSTDKIIDPLSRLAETMHRHGAKIMIQATHMGRRSAFHGEHWPHLMTPSGVREPVHRGNAKIIEVEEIRRIIADFAAAAKRVKDAGMDGIEISAAHQHLIDQFWSPRTNFRADEWGGSLENRMRFGVEVLQAVREVVGKDFCVGLRMCGDEFHEDGLDHEQLKEIAQAMSESGLVDYIGVVGSGADTHNTLANCMPPMALPPEPFVHLAAGIKSVIKVPLMHAQSIRDAGQAERLLANGMVDLVGMTRAQIADPHMVIKIRDGREDEIKQCVGANYCIDRQYNGLDVLCVQNAATSREATMPHIIEKSRGPKRKVVVVGAGPAGLEAARVARSRGHDVVLFEKNTEVGGQILLAAKAPQREQMQGIVRWFDMETKRLGVDRRLGVEADAKMIMAEKPDIIVLATGGRAFSDQVPGWAVAEGLAVSSWDVLAGRVEAKENVLVYDGVSTHAGAGVADYLASRGAKVEIVTPDVKVADDCGGTTFPIFYRRLYAQGVIHTPNYWLDRVYEEGGKKIAVLRNEYTEELEERAVDQVVIENGSTPNDALYWKLKPESLNRGQVDVHKLFASEPQPSLSETLGNGRFLLFRVGDCISMHNIHGAIYDALRLVKDF

SEQ ID NO: 3224 - protein, 464 aa, Malus sylvestris
FNSHGEDSSYFLGWQEYEKNPYHEVHNTNGIIQMGLAENQLCFDLLESWLAKNPEAAAFKKNGESIFAELALFQDYHGLPAFKKAMVDFMAKIRGNKVTFDPNHLVLTAGATSANETFIFCLADPGEAVLIPTPYYPGFDRDLKWRTGVEIVPIHCTSSNGFQITETALEEAYQEAEKRNLRVKGVLVTNPSNPLGTTMTRNELYLLLSFVEDKGIHLISDEIYSGTAFSSPSFISVMEVLKDRNCDENSEVWQRVHVVYSLSKDLGLPGFRVGAIYSNDDMVVAAATKMSSFGLVSSQTQHLLSAMLSDKKLTKNYIAENHKRLKQRQKKLVSGLQKSGISCLNGNAGLFCWVDMRHLLRSNTFEAEMELWKKIVYEVHLNISPGSSCHCTEPGWFRVCFANLPERTLDLAMQRLKAFVGEYYNVPEVNGGSQSSHLSHSRRQSLTKWVSRLSFDDRGPIPGR

SEQ ID NO: 3225 - protein, 208 aa, Streptomyces avermitilis
MTARGTVRVERVVTSGTFSLDGDTFDVDNNVWLIGDDEEVLIVDAAHDARTIHEAVAGRHVTAIVCTHAHDDHIDAAAELSVLTGAPVLLHPGDNELWSLTHPGRKPDGELSDGRVLTVAGIELQVIHSPGHTWGSCSLHAPFLNAVFTGDTLFHGGPGATGRSYSDRPTIEASLRNRILTLPGGTVVHTGHGEDTTIAAERLNVPAV

SEQ ID NO: 3226 - protein, 548 aa, Photorhabdus luminescens
MAAKDVKFGSDARVKMLRGVNILADAVKVTLGPKGRNVVLDKSFGAPAITKDGVSVAREIELEDKFENMGAQMVKEVASKANDAAGDGTTTATVLAQSIVTEGLKAVAAGMNPMDLKRGIDKAVVAAVAELKKLSVPCSDSISIAQVGTISANSDETVGKLIAEAMDKVGKEGVITVEEGTGLEDELDVVEGMQFDRGYLSPYFINKPENGSVELENPYILLVDKKISNIRELLPVLEGVAKASKPLLIVAEDVEGEALATLVVNTMRGIVKVAAVKAPGFGDRRKAMLHDIAVLTNGNVISEEIGLELEKATLEDLGQAKRIVINKDTTTIIDGVGEEDAIKGRVSQINQQIKESTSDYDREKLQERVAKLAGGVAVIKVGAATEVEMKEKRARVDDALHATRAAVEEGVVAGGGVALVRVAAAIVGLKGDNEDQNVGIRVAMRAMEAPLRQIVDNSGEEPSVIANSVKAGEGNYGYNATTEQYGDMIAMGILDPTKVTRSALQFAASIAGLMITTECMITDLPKDDKADLGAAGGMGGMGGMGGMM

SEQ ID NO: 3227 - protein, 600 aa, Pseudomonas fluorescens
MPSRTPESWPHGAIMLDAEHTQFALWAPDAFYVSVELDNGQSLPMLPQGDGWFVIKTRCPAGSRYRFNIDGELEVPDPASRAQDGDLDRHSVVVDPHLYSWRNTTWQGRPWNEAVIYELHVGALGGFAEVEQHLSRLAELGITAIELMPIAQFPGDRNWGYDGVLHYAPQASYGTPEQLKHLIDSAHGYGLAVILDVVYNHFGPDGNYLHRYAKGFFREDKHTPWGAAIDFRRREVRDFFVENALMWLLEYRFDGLRLDAVHAIQSPDFLPELARRIRQQIDPSRHVWLTIENELNQSSLLEENYDAQWNDDGHNALHVLLTGETDAYYADYALQPTEQLARCLSQGFVFQGHITRHGELRGEPSEHLPSTAFVLFLQNHDQIGNRAFGERLHQLAEPRAVDAATALLLLSPMIPLMFMGDEYAAQQPFLFFTSHHGELAKLVREGRRNEFAAFSAFSDPHKREQIPDPNAEQTFHASQPRLTGNGTPRQQATLALYRQLLQLRHQYIIPNLSGTQALGAQVLGPGAVSARWRLGDGSELRIDLNLSDTPVVNLPQADSAWLFRQPSDAGLSDEGQLPPYCALVSLTAATPLPPLDGERL

SEQ ID NO: 3228 - protein, 176 aa, Zea mays
MTMPRRALLFAAVLLAASAAAVSGFHLAGDESGLVRGVLTAVRERAEAEAEDAARFAVAYHNRNQGAALEFTRVLKSKRQVVTGTLHDLILEAADAGKKSLYRAKVWVKPWEDFKSVVEFRLAGDSESEPEPSVASDEGSGQGVAKLSLEADIIHEEAHLHTIENDGLSSDFASSA

SEQ ID NO: 3229 - protein, 638 aa, Geobacillus stearothermophilus
IAVGPTDLEIYLFHEGSLYKSYELFGAHVIKKNGMVGTRFCVWAPHAREVRLVGSFNEWNGTNFNLMKVSNQGVWMIFIPENLEGHLYKYEITTNDGNVLLKSDPYAFYSELRPHTASIVYNIKGYQWNDQTWRRKKQRKRIYDQPLFIYELHFGSWKKKEDGSFYTYQEMAEELIPYVLEHGFTHIELLPLVEHPFDRSWGYQGIGYYSATSRYGTPHDLMYFIDRCHQAGIGVILDWVPGHFCKDSHGLYMFDGAPAYEYANMQDRENYVWGTANFDLGKPEVRSFLISNALFWMEYFHVDGFRVDAVANMLYWPNSDVLYKNTYAVEFLQKLNETVFAYDPNILMIAEDSTDWPRVTAPTYDGGLGFNYKWNMGWMNDILTYMETPPEHRKYVHNKVTFSLLYAYSENFILPFSHDEVVHGKKSLLSKMPGTYEEKFAQLRLLYGYLLTHPGKKLLFMGGEFGQFDEWKDLEQLDWMLFDFDMHRNMNMYVKELLKCYKRYKPLYELDHSPDGFEWIDVHNAEQSIFSFIRRGKKEDDLLIVVCNFTNKVYHGYKVGVPLFTRYREVINSDAIQFGGFGNINPKPIAAMEGPFHGKPYHIQMTIPPFGISILRPVKKGSVKSFMKTPHPPSHGAS

SEQ ID NO: 3230 - protein, 606 aa, Unknown
  Delphinium x belladonna
MDSCACIDTQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDKHTILKTTLVELGRTLGLEECALCMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVFKNSNLLAALINDVLELSRLEDGSLELDIRTFNLHGIFREVLNMIKPITAVKKLSLTLMLSPDLPVVAVGDEKRLMQIMLNVVGNAVKFTKEGYVSVIASVAKAESLRDWQAPEIFMVSSDSHFHLCVQVKDSGCGISPQEIPHLFTKFTQLRSGQNRGNDGAGLGLALCKRFLNLMEGHIWVDSDGTDKGCTVTIIVKLGICEGQPEPSNLQVVSRPRLS

SEQ ID NO: 3231 - protein, 596 aa, Unknown
  Delphinium x belladonna
MMGSCDCIDTRWPANDLLVKYQYLSDFFIAVAYFSIPLELIYFVQKSAFFPYRWVLMQFGAFIVLCGATHLISLWTFSMHSKTLAMVMAIAKGATALVSCATALMLVHIIPDLLSVKTRELFLRNKAEALDRDLGLIRTEEETGRHVRMLTHEIRSTLDRHTILKTTLVELGRILDLEECALWMPSRNGMNLQLTHTLHHHIPVGSTVATNLPVVNLVFNSTEAIQIPPTCPLARIKPHTGRYLPPEIVAVRVPLLHLSNFEINDWPELSAKSYAVMVLMLPIDSARKWHDHELDLVEVVADQVAVALSHAAILEESMRARDKLMEQNIALDLARQDAERAIRSRNDFLAVMNHEMRTPMNAGMALSSLLLEIELTPDQRVMIESVLKNSNILETLINDVLELSRLEDGSLELNVKTFNLREAFREVLKLLKPIAAVKKLSLTLKVAPDLPVWAVGDETRIMQIILNVVGNAVKFTKEGHISVAACVAKAESIRGGLTPESHPLSSDSHFYLRIQVKDSGCGISSQDIPHLFTKFAQSRGGQIRNNDGAGIGLALSKRFLHLMGGHVSIESDGTGKGSTVTMVLKLGTSDGPNPQI

SEQ ID NO: 3232 - protein, 170 aa, Triticum aestivum
  misc_feature (155)..(155): Xaa can be any naturally occurring amino acid
MPLLRRIPLNADRAKTSLFSPYLHFSELSVRKVFHQVRMKQLTWSNESNRDGEEGCSLFLRSIGLREYSRYLAFNHPCSHEKPLLAHLRFFPWVVNEVYFKVWRQGRTGYPLVDAGMRELCGTGWLHDRIPVVVSSFFVKVLHLPWRWGIKYFWXPLLDADLENQPRWAG

SEQ ID NO: 3233 - protein, 485 aa, Mycobacterium avium
MTENFTTTNAGAPAPSDELSLTLGPDGPVLLQDFYLIEQLAAFNRERVPERQPHAKGTGAFGRFEVTNDLSAYTKAAVFQPGTKTDVFVRLSGNAGERGSADTVRDTRGFSVKFYTTEGNFDLVGLDFPVFVIRDPIKFPQMVRSAKRRANNDCRDHNMQWDFWTLSPESAHQVAMIMSDRGIPKTFRHMHGFGLHTFSFLNAAGEISWVKFHFKSNQGIEWLTQEEGDRLAGTDPDYCIRDLYEAIERGDHPSWSVKVQIMPFEEAKTYRFNPFDVTKVWPHADYPLIDLGTMTLDRNVTDHHTEVEQVTFAPHALVPGIGLSPDKLLLGRSFAYADAHRYRVGANHNQIPVNAPRCPVRSYSKDGQMRFVNSTDPVYAPNSYGGPKADPDRASVVKWAVDGGMMVRAPYTLRPDDDDWGQAGALVRDVMDDAERERLVHNIVHHVTDGVKEPVLSRVVEYWYNIDADIGKRVEDGIRAANLGR

SEQ ID NO: 3234 - protein, 484 aa, Mycobacterium avium
MAENHTTTNAGAPAPSDELSLTVGPDGPLLLQDSYLVEQMAAFNRERVPERQPHAKGAGAYGRFEVTADVSEYTKAAFLQPGAVTEVFARFSSGNSGERGSADTARDNRGFSVKFYTTEGNFDLVGSDVPVFAIRDPMKFPNLIRAGGRRADNDLHDHNMVWDFWTSCPETAHLVTLVMGDRGIPRTFRHMNGFGLHAFSWVNSAGEIHWVKYHFKTDQGIQWLPQEEGRRLAGTHPDCCVRDLYEAIARGKYPSWSLQVQLMPFADAKTYRFNPFDVTKVWPHADYPPIEIGTMTLDRNVTDHHAEVEQAAFAPSNLVPGTGLSPDRLLLGRSFAYPDAHRARIGVNHDQLPVNAARCAVRSYAKDGRMRFVNTADPVYAPNSAGGPQADPARAGEVHWAADGQMLRAAYTLRRDDDDWGQAGTLVRRVMDDSQRERLVHNIVGHVSAGVNEPVLSRVFAYWRHVDADIGRKVEEGVRANLNS

SEQ ID NO: 3235 - protein, 475 aa, Cucurbita maxima
MGILSRKATCNSHGQDSSYFLGWEEYDKNPYDEILNPKGIIQMGLAENQLCFDLLERWLKENPDAAGFKRDGKSIFRELALFQDYNGLPAFKKALAEFMSEIRGNRVTFNPDHIVLTAGATSANETLMFCLAEPGDAFLLPTPYYPGFDRDLKWRTGIEIVPIHCSSSNGFRITESALLEAYQSAQSRDLKVKGVLVTNPSNPLGTTITTQELNLLLQFIASKNLHLISDEIYSGTVFRNPGFVSVMDILNQNYKHNHQIRKQVHIVYSLSKDLGLPGFRVGAIYSNDDVVVAAATKMSSFGLVSSQTQYLLSAMLSDKKFTKNYIKENQKRLEKRQKMLVRGLQKAGIKCHKGNAGLFCWVDMRHLLGANTFESEMELWRKIVFEGAVERVARTVVPLLRTRLVPCLFCQHVRGNVGPCNAETKGFWVYSTELHSPTTTTTTNHLPTKRKNMVKWVFRLSFNDRVVDHTNDNLG

SEQ ID NO: 3236 - protein, 439 aa, Oryza sativa
MEGVGGGKRRGDDGAEATPRWRFSRPSSQGGPLAAAGLTSIRAVLNRVNSSVDAAAAGGPRPVLRLGNGDPTASACYRTAPAAEDAVVDALRSGAHNGYSLTVGVLSARRAIAEYLSRDLPYELSANDIYLTSGCVQAIEVMISVLAQPGSNILLPKPGFPLYESRTTFSNLEVRHFDLIPERGWEVDLEGVQAIADENTVAIVVINPSNPCGSVYSYDHLAKIAETARKLGLLIIADEVYDHLAFGNNPFIPIGVFGKTVPVITLGSISKRWLVPGWRLGWIATCDPNGILKEAKVNQSIENYINISTDPATFVQGAIPQIIANTKEDYFNKILDQLRNAADLCYDKIKDIKGITCPHKPEGSMFVMVKLDLSYLDGFHDDMDFCCRLAKEESVIVLPGSALGLKNWVRITFAIDIPSLVDAFERIKSFCQRHGKLET

SEQ ID NO: 3237 - protein, 428 aa, Lycopersicon esculentum
ILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEK

SEQ ID NO: 3238 - protein, 291 aa, Brassica napus
PARYTGTLEPRKKRKGIRERGLFVYIYIEEGRDRRVREKEKNGTTHASGRVELKRIENTINRQVTFAKRRGGVLKKAYELSVLCDAEVALIIFSNRGNLFEFCSNSRSMLKTLERYQKCNYGPPEPNVPSREALAVELSSQQEYLKLKQRYDALQRTQRNLLGEDLGPLSTKELESLERQLDSSLKQIRGLRTQFMLDQLNDLQSKERMLSDTNKTLRLRLADGYQMPFQLNPNQEEVHVDYGHHQPQPQAFFQPLEYEPIFQIGYHQGQQQDHGMGAGPSANNYMLGWLP

SEQ ID NO: 3239 - protein, 716 aa, Pseudomonas syringae
MASKNAPPVTETPKSEMAGTDTLDRGNTNEKLESLEQFRSDATQQALRTNHGVKISDNQNTLKVGSRGPSLLEDFIMREKITHFDHERIPERIVHARGTAAHGYFQTYEDHGALSKAGFLRDPGKKTPVFVRFSTVQGPRGSGDTVRDVRGFAVKLYTDEGNFDLVGNNMPVFFIQDAIKFPDFVHAVKPEPHNEIPTGGSAHDTFWDFVSLVPESAHMVLWTMSDRAIPKSLRTMQGFGIHTFRFINTEGKSSFVKFHWKPKFGVCSLVWDEAQKLAGKDTDFHRRDLWESIEMGDYPEWELGVQIVAEEDEHKFDFDLLDPTKIIPEELVPVTPLGKMVLNRNPDNYFAETEQVAFCPGHIVPGIDFSNDPLLQGRLFSYTDTQISRLGGPNFHEIPINRPIAPNHNGQRDAQHRTTIDKGRASYEPNSIDGGWPKETPAGPVDGGFETYPERVEAHKVRERSESFGDHFSQATLFFQSMSHHEKEHIIAAYSFELGKVEREYIRARQVNEILANIDMDLAKRVAANLGLPAPAAGTVPARQTSVKESPALSQVNLLSGDIVSRKVAILVADGVDGKAVEAMKAALTAEGAHAKVLGPTSAPVKTADGKSLPVDASAEGLPSVAFDAVFVPGGKASIEALKGDGVALHFILEAYKHLKAISFAGEAKELLSLLRLEEDAGLLEVSDSTSFKPFFHAIAQHRVWDREAKAKAVPA

SEQ ID NO: 3240 - protein, 131 aa, Triticum aestivum
MFQKCFGDTLFSLSCGKLFEGTPEQMYSSLQKIVALPDVTKVYCGHEYTLSNSRFALSIEPGNEELQEYAASTADLRNRNTPTVPTTIAREKQCNPFLRTSSPEIKKRLSIPDHFDDARVLEVIRRAKDNF

SEQ ID NO: 3241 - protein, 488 aa, Archaeoglobus fulgidus
MDSSSVDIVLNKGGHNKSFEVKIYRIHTTKIMSFPNGSDAEGVLKRLEDYAKNDFEPHSRRMWGHIYYAGLKDVVELARKAYLMYMDKTMLDFTCFPSLLRMEREVVRMASSLLNGDEEVVGNFTYGGTESIMLALKAAREKFRKEEGGNVVPEIVLPATAHPAFWKSAEYLGMRCLRAKLDDELRADVETVKELVGDKTAMIVGSAPNYPFGVVDDIKALSDIAVDGKLWLHVDACLGGFHLPFFRELGEKIPDFDFSVEGVHSISADFHKYGLSPRGASVILYRNAKLREGQIFVMASWPGYPLVNTAVLSTRSAGTLAAAWAVMSYLGFDGYLKLAKKTLYAKKRLIDGLTELGLELLGSPEGAVLAFTSERHNLFKVSTLMAEKGWYVQSQPGSKKLGFPRSLHFSVIPGHAEVVDEFLEDMREVLPECECSYPEMSSFDVSKLKFGEDGLPEDSELISELIHSMPPEIVESVFKQFINELIFR

SEQ ID NO: 3242 - protein, 456 aa, Triticum aestivum
MGEQKGNILMGKYEMGKMLGQGTFAKVYHARNIETSQSVAIKVTDKEKVLKGGLTDQIKREISVMKLVKHPNIVQMYEVMATKTKIYFVLEHVKGGELFNKVQRGRLKEDAARKYFQQLICAVDFCHSRGVYHRDLKPENLLLDENSNLKVSDFGLSTISECRRLDGLLHTSCGTPAYVAPEVINRKGYDGAKADIWSCGVILFVLLAGYLPFQDKNLMNMYKKIGKAEFKCPSWFSSDIRRLLLRILDPNPSTRISIERIMEHPWFRKGLDAKLLRYNLQAKDAVPAADMTATSDSLSCSNSATEGKEQEAKKLSNLNAFDIISLSTGLDLSGMFEDNDKKRESKFTSTNSASTIVSKIEDIAKCMRLKLVKKDGGMMRMESFKPGRKGVMSIDAEIFEVTPDFHLVELKKTNGDTIEYQKVLNQEMRPALKDIVWAWQGEQQPQPQPQPQQQPC

SEQ ID NO: 3243 - protein, 542 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLEQFSAMNKLKKLALRVIAERLSEEEIAGLREMFKAVDTKNRGVITFGELREGLRRFGAEFKDTEIGDIMEAAHNDNNVTIHYEEFIAATLPLNKMEREEHLLAAFTYFDKDGSGYITVDKLRRACGEHNMEDSLLEEIISQVDQNNDGQIDYAEFVAMMPGSNVGLRWQTMESSLNVALRDAPQVH

SEQ ID NO: 3244 - protein, 345 aa, Bacillus cereus
MNYKLFSPYTIKDVTLKNRIVMSPMCMYSSENGDGQVTNFHLIHYGTRAAGQVGLVMIEATAVLPEGRISNKDLGIWDDSLIEGLHKTTTFIHDNGAKAAIQLAHAGRKAELETDALAPSAIPFNETMKMPIEMSKHQIKDTVLAFQQAAVRSKQAGFDVIEIHGAHGYLINEFLSPLTNKRTDEYGGSPENRYRFLREIIDSINEVWNGPLFVRISANDYHPDGLTVQDYVQYTKWMKEQGVDLIDCSSGAVVPARIDVYPGYQVQYAKHIKEHANIATGAVGLITTGAQAEQILNNNEADLIFIGRELLRNPYFPRIAANELGFELEEPYQYERAPGKISTNK

SEQ ID NO: 3245 - protein, 578 aa, Zea mays
MLHYISSSPLRPRFLLLPSPPSNLRFLTMSASPSSSSSRSVRGAAVSVPSLGADEACAVADEAFRRYTSPSLLRRGGVGVAVVWFRNDLRVLDNEALLRAWAASEAVLPVYCVDPRVFAGSTHYFGFPKTGALRTQFLIECLGDLKQSLRKKGLDLLVRHGKPEEILPSIAKAVSAHTIYAHKETCSEELLVERLVSKGLEQVQIAQGGASVPKRPLNPRLQLIWGATMYHIDDLPFPVSSLPDVCTQFRKAGIVGCSVRNCAKLPTSLGPPPSSSIDEIGGWGTVPTLESLGPSVTKSEKGMHFIGGESAALGRVHEYFWKKDQLKDYKVTRNGMLGPDYSTKFSPWLASGSLSPRYICEEVKRYEKQRVANDSTYWVLFELIWRDYFRFLSAKYGNAIFHLGGPRKVVSKWSQDQALFESWRDGRTGYPLIDANMRELSATGYMSNRGRQIVCSFLVRDMGVDWRMGAEWFETCLLDYDPASNYGNWTYGAGVGNDPREDRYFSIPKQAKSYDPEGEYVAYWLPELRSLAKERRNFPGASYIRQVVPLKFDGGNQRKDQQFNRQRRPNNVYIRQVK

SEQ ID NO: 3246 - protein, 459 aa, Bacillus thuringiensis
MGENYDKQRQSLLGKDFNENGERNEQAILHSQTVGSRGPVLEQDSVLHEALQEFIHEKILERPVHVKGFGAFGYFQTIYPMSEHTKLSFLQHSNEKVPVMVRFSLAVSTKGTPDTARNVRGFSTKFYTKEGIFDLLCNHIPVFSVRDPMRFPETIQALSPSPKNNLLDPNRFWSFVARAPESIHFVVHLYSDNGTAKSFRRIPGHSVNTYVWRNAEGNRKYVKYHWYPFEGVQSITNEEANKLAAENPDYSGKDLYDAIANGKPVEYGLYVQLMDPKDEAHLSYDPLDDTKAWDEKAYPLIPVGKMVLNKNPENYMEQVEKVAFSPSNLLDGAELSDDKMLQGRANIYSDSQRRRIGPEFRKLAINQQQDWTPANQITSGDGRYVEGKLERTSIPKQDDFTQAGEFYAKLQPIEKEHLAENLASDLKVISDDIRKVVLGYFHNVSADLVKRIESAMQQL

SEQ ID NO: 3247 - protein, 160 aa, Zea mays
  misc_feature (109)..(109): Xaa can be any naturally occurring amino acid
  misc_feature (122)..(122): Xaa can be any naturally occurring amino acid
ADEEGLVQADAARGRRLTRAASPAGAGGVAAAGVEARGGGLRLGWVALPERSDGSGDSRGEARARSLSDDDLEELKECVDLGFGFSYREILELCGTLPALDLCYFMSQXYLDEHHHRSTGHXEEAPPLAPDSWAQPCDTSNWKSYTPGDSPDEEKAKFKY

SEQ ID NO: 3248 - protein, 861 aa, Solanum tuberosum
MEINFKVLSKPIRGSFPSFSPKVSSGASRNKICFPSQHSTGLKFGSQERSWDISSTPKSRVRKDERMKHSSAISAVLTDDNSTMAPLEEDVKTENIGLLNLDPTLEPYLDHFRHRMKRYVDQKMLIEKYEGPLEEFAQGYLKFGFNREDGCIVYREWAPAAQEDEVIGDFNGWNGSNHMMEKDQFGVWSIRIPDVDSKPVIPHNSRVKFRFKHGNGVWVDRIPAWIKYATADATKFAAPYDGVYWDPPPSERYHFKYPRPPKPRAPRIYEAHVGMSSSEPRVNSYREFADDVLPRIKANNYNTVQLMAIMEHSYYGSFGYHVTNFFAVSSRYGNPEDLKYLIDKAHSLGLQVLVDVVHSHASNNVTDGLNGFDIGQGSQESYFHAGERGYHKLWDSRLFNYANWEVLRFLLSNLRWWLEEYNFDGFRFDGITSMLYVHHGINMGFTGNYNEYFSEATDVDAVVYLMLANNLIHKIFPDATVIAEDVSGMPGLGRPVSEGGIGFDYRLAMAIPDKWIDYLKNKNDEDWSMKEVTSSLTNRRYTEKCIAYAESHDQSIVGDKTIAFLLMDKEMYSGMSCLTDASPVVDRGIALHKMIHFFTMALGGEGYLNFMGNEFGHPEWIDFPREGNNWSYDKCRRQWNLADSEHLRYKFMNAFDRAMNSLDEKFSFLASGKQIVSSMDDDNKVVVFERGDLVFVFNFHPKNTYEGYKVGCDLPGKYRVALDSDAWEFGGHGRTGHDVDHFTSPEGIPGVPETNFNGRQIPSKCCLLREHVWLITELMNACQKLKITRQTFVVSYYQQPISRRVTRNLKIRYLQISVTLTNACQKLKFTRQTFLVSYYQQPILRRVTRKLKDSLSTNIST

SEQ ID NO: 3249 - protein, 367 aa, Archaeoglobus fulgidus
MDIIEELRAYREKDIPYSRVLSSMCTVPHPVAVEAHRMFIETNLGDPGIFRGTVELEAKLMRLIGDILHCETPAGYICSGGTEANIQGIRAARNVQKKENPNIVIPKTAHFSFEKIGDILGVKIKRAGVDEEYKVDVGQVEDLMDENTVAIVGIAGTTELGQIDPIVELSKLAEERQVELHVDAAFGGLVIPFMDNPYPFDFQNRGVSSITIDPHKMGMATIPAGGIIFRNESYLRALEVETPYLTSKTQFTLTGTRPGTGVASAYAVLKSLGFEGMREVVKNCLKNTRILVEEMRDLGFEPVIEPVMNVVSFRTDEAERIKEELYRMRWVISTIREPKAIRFVVMPHVTEEVIKNFISDFRKVLRR

SEQ ID NO: 3250 - protein, 230 aa, Spinacia oleracea
GRGKIEIKRIENTTNRQVTFCKRRNGLLKKAYELSVLCDAEIALIVFSSRGRLYEYANQSVKGTIDRYKKACSDQTGAGSVAEANAQYYQQEAAKLRNQIRTATENNRLLSRHMMGEGLSSLSMKELKNLETKLEKGISRIRSKKNELLFAEIEFMQKREIELHNNNQFLRARISENERAQQSMSLMPPGGSDYDLVPSQSFDSRNYFQVNALQPNSQYARQDQTPLQLV

SEQ ID NO: 3251 - protein, 446 aa, Arabidopsis thaliana
MTKKMRRVGKYEVGRTIGEGTFAKVKFARNTDTGDNVAIKIMAKSTILKNRMVDQIKREISIMKIVRHPNIVRLYEVLASPSKIYIVLEFVTGGELFDRIVHKGRLEESESRKYFQQLVDAVAHCHCKGVYHRDLKPENLLLDTNGNLKVSDFGLSALPQEGVELLRTTCGTPNYVAPEVLSGQGYDGSAADIWSCGVILFVILAGYLPFSETDLPGLYRKINAAEFSCPPWFSAEVKFLIHRILDPNPKTRIQIQGIKKDPWFRLNYVPIRAREEEEVNLDDIRAVFDGIEGSYVAENVERNDEGPLMMNAFEMITLSQGLNLSALFDRRQDFVKRQTRFVSRREPSEIIANIEAVANSMGFKSHTRNFKTRLEGLSSIKAGQLAVVIEIYEVAPSLFMVDVRKAAGETLEYHKFYKKLCSKLENIIWRATEGIPKSEILRTITF

SEQ ID NO: 3252 - protein, 92 aa, Bixa orellana
EQDRYMPIANVIRIMRKVLPTHAKISDEAKETIQECVSEFISFITSEANERCQREQRKTITAEDVLFAMSRLGFDDYVDPLSIYLQRYREFE

SEQ ID NO: 3253 - protein, 217 aa, Bartonella quintana
MTNLRTHIIPVTPFQQNCTLLFDNEQKVGVLVDPGGDWFRIQEVIRKTGIIVEAIWITHGHFDHVGAAMQAKEALNVKIIGSHRDDKPVMASVSESAKNYGITDACTCIPDQWLEDGDSVHFVGHVFHVLHTPGHSPGHVIYFNEKERFALLGDVLFRGSIGRTDFPFCSHKELMKSLREKILPLGDDVRFICGHGPESQLGYERQWNPFLQGLMDE

SEQ ID NO: 3254 - protein, 454 aa, Oryza sativa
MVKGGREALLGGYEMGRTLGEGNFGKVKYARHLATGGHFAVKILDRGRVVSLRAGDQIRREIATLKLLRHPHVVRLHEVAASKTKIYMVLEFVNGGELFERIAVKGKLSEKEGRRLFQQLIDGVSYCHDRGVYHRDLKPENVLVDQKGNIKISDFGLSALPQHLGNDGLLHTTCGSPNYIAPEVLQNKGYDGSLSDIWSCGVILYVMLIGYLPFDDRNIVVLYQKIFKGDTQIPKWLSHSAQNLLRRILEPNPMKRIDMAGIKSHEWFQKDYIPVLPYDDDDEDVQFGARLPAKEQINDEPGDKNSHQINAFQLIGMASSLDLSGLFEDEEVSQRRIRFTSTHPPKDAFDKIESSATELGFQVQRGHSKLKLMRNCKGSKNPESFMVSAEVFELGPSVNVVELRKSNGDPALYRQLCERISSDMGARNTEQIFATASLEDDLQNSNAGTPLFAL

SEQ ID NO: 3255 - protein, 489 aa, Arabidopsis thaliana
MAEKITRETSLPKERSSPQALILGRYEMGKLLGHGTFAKVYLARNVKTNESVAIKVIDKEKVLKGGLIAHIKREISILRRVRHPNIVQLFEVMATKAKIYFVMEYVRGGELFNKVAKGRLKEEVARKYFQQLISAVTFCHARGVYHRDLKPENLLLDENGNLKVSDFGLSAVSDQIRQDGLFHTFCGTPAYVAPEVLARKGYDAAKVDIWSCGVILFVLMAGYLPFHDRNVMAMYKKIYRGEFRCPRWFSTELTRLLSKLLETNPEKRFTFPEIMENSWFKKGFKHIKFYVEDDKLCNVVDDDELESDSVESDRDSAASESEIEYLEPRRRVGGLPRPASLNAFDIISFSQGFDLSGLFDDDGEGSRFVSGAPVSKIISKLEEIAKVVSFTVRKKDCRVSLEGSRQGVKGPLTIAAEIFELTPSLVVVEVKKKGGDKTEYEDFCNNELKPKLQNLTADDVVAEPVAVSAVDETAIPNSPTISFLPSDTE

SEQ ID NO: 3256 - protein, 479 aa, Bacillus cereus
MSKVIFPKGFLWGGAIAANQVEGAYVEDGKGLTTVDLLPTGENRWDIMKGNIHSFTPVEGEFYPSHEAIDFYHRYKEDIALFAEMGFKALRVSIAWTRIFPNGDDEKPNEAGLQFYEDLFDELLKHDIEPVVTMAHFDVPVHLVEKYGSWRSRKLVNFFETYAKTIFNRYKDKVKYWMTFNEINMLLHLPFMGAGLAFKEGDNKKQIQYQAAHHQLVASALAVKACHEIIPDAKIGCMLAAGATYPYTCNPDDVLRAMEQDRESFFFIDVQARGAYPGYAKRFFKDNNVTIEMEKEDEEILKEHTVDYIGFSYYASRATSTDPEVLKSITSGNVFGSVENPYLEKSEWGWTIDPKGFRITANQLYDRYQKPLFVVENGLGAIDELNDADAVNDAYRIDYLEKHIIEMSEAIQDGVDIIGYTSWGPIDLVSASTGEMKKRYGYIYVDKDNEGKGSLKRSKKKSFDWYKEVIKTNGESLES

SEQ ID NO: 3257 - protein, 278 aa, Zea mays
MARHFVLNTGAKIPSVGLGTWQSDPGVVGNAVYAAVKAGYRHIDCARVYGNEKEIGLALKKLFEEGVVKREDMFITSKLWNDHHAPEDVPEALNDSLNDLQLEYLDLYLIHWPFRVKKGTNTSPENFVTPDFPATWGAMEKLYDAGKARAIGQTKLHSFCQSTGVHLTAYSPLGSPGTTWMNGNVLKEPIIISIAEKLGKTSAQVALRWNIQMGHSVLPKSTNEERIKQNLDVYDWSIPDDLLAKFSEIKQARLLRGNFIVNPESVYKTHEELWDGEL

SEQ ID NO: 3258 - protein, 286 aa, Lactobacillus acidophilus
MVETFKLNDGNNIPAIGFGTFQIPDDGSTYKDVLNALKLGYRHIDTAVAYFNEDEVGKAIRDSGIPRDQIWVTSKLWLQDYAYEDAKKAINLSLKNLGLDYIDLYLIHQPYGKVDEAWKAMVEAKKAGKIRSIGISNVTPKIWHKWEDIFKENKPAVNQVEFNPYFQQKELRKIMAENQITLEAWAPLGQGNHNLFKEPVLNRLAKKYDKNVGQIMLRFEHQEGIIVFPKSVHEARIKSNKDIFDFELTSDEMDAIRALDKGKGMHDPDAPGVEEMLSKYDVHAND

SEQ ID NO: 3259 - protein, 274 aa, Haloarcula marismortui
MDDIQIQGTSVPALGLGTWQLTGQSCRETVETALGMGYRHIDTAQAYGNERQVGLGMDAAAVDREDVFLTTKLDGSNRDERSVRRSTRESLNKLGTDYLDLLLIHWPNTPWMASLSETLGAMNDVVEEGLVRHIGVSNFSPSLLDRARDISSAPIFTDQVQYHPYWDQRKLLDYCRIHDVLLTAYSPLARGGVLDDPALVQIGNKYGKSPAQVALRWLVQQDGVAAIPKASSREHLEANLAVFDFELTDAEMERIRDPSKVKTGVQFVRSQLPF

SEQ ID NO: 3260 - protein, 289 aa, Lactobacillus acidophilus
MTDIPKIKLNDGNEIPQLGFGVFQISNHDEAVKAVESAISNGYRLIDTAEAYNNQTAVGEAIKNSDVNRDDIFLTTKLWVSNFTYEKASKAIDEDLKELGTDYIDMMLLHQAYGDVAGAWRALEDAQKAGKTKSIGVSNFWPDQLMNLQLMSNVKPVVNQIEVNPWFQREPEVKWNQKDDVAVEAWAPFAEGKDGIFTNPVLTEIGKKYGKSNGQVILRWLIQRGIIVIPKSVHDARQKENIDIFDFELNNDDMQKIAALDKNVSQFFDHHDPTTIEQIFGSSLNQLRR

SEQ ID NO: 3261 - protein, 277 aa, Bacillus cereus
MSLTSLKDYTTLHNGVKMPWFGLGVFKVEDGSQVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDIFEIAEIKPMVNQVEYHPRLAQEELHAFCKEHNIQLEAWSPLMQGQLLDNPTLQDIAKKYNKSTAQIILRWDLQNEVVTIPKSIKEHRIIENANIFDFELSADDTKAIQALNEDRRVGPDPDNFNF

SEQ ID NO: 3262 - protein, 521 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISKDTTTIIGGIGEKHTIQSRISQIRQEIQEATSDYDKEKLNERLAKLSGGVAVLKVGAATEVEMKEKKARVEDALHATRAAVEEGVVAGGGVALVRVAGKISHLRGQNEDQNVGIRVALRAMEAPLRQIVSNSGEEPSVVTNNVKDGKGNYGYNAASDQYGDMIDFGILDPTKVTRSALQYAASVAGLMITTECMV

SEQ ID NO: 3263 - protein, 285 aa, Lactobacillus acidophilus
MNFNSLQDTYTLNNGVKIPIIGFGTWQTPDGEVAEESVLAALNCGYRHIDTASAYGNEDSVGRAIQKSGINRHELFITTKLWNSDHGYEKTKKAIDQSLLDLKLDYLDMYLIHWPNPSSMRDHWAEINAESWRAMEEAVRAGKIRAIGVSNFRKHHLDALMETAEIKPVVNQIFLNPSDLQSEVVTENKKLDLLSEAYSPLGTGGLLGNEVVKEVAANYGKSTAQVLIRWSLQHGFLPLPKSVHPEYIKANADVFDFEISPEDMAKLDNLHGVAGVANDPDKVDF

SEQ ID NO: 3264 - protein, 523 aa, Buchnera aphidicola
  misc_feature (439)..(440): Xaa can be any naturally occurring amino acid
  misc_feature (519)..(521): Xaa can be any naturally occurring amino acid
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDQAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGTVISEELAMELEKSTLEDLGQAKRVVITKDTTTIIGGIGEKHNIQSRISQIRQEVQEATSDYDKEKLNERLAKLSGGVAVLKVGAATEVEMKEKKARVEDALHATRAAVEEGVVAGGGVALVRVAGKISHLRGHNEDQNVXXRVALRAMEAPLRQIVSNSGEEPSVVTNNVKDGQGNYGYNAASDEYGDMINFGILDPTKVTRSALQYAASVAGLMITTEXXXTD

SEQ ID NO: 3265 - protein, 546 aa, Helicobacter pylori
MAKEIKFSDSARNLLFEGVRQLHDAVKVTMGPRGRNVLIQKSYGAPSITKDGVSVAKEIELSCPVANMGAQLVKEVASKTADAAGDGTTTATVLAYSIFKEGLRNITAGANPIEVKRGMDKAAEAIINELKKASKKVGGKEEITQVATISANSDHNIGKLIADAMEKVGKDGVITVEEAKGIEDELDVVEGMQFDRGYLSPYFVTNAEKMTAQLDNAYILLTDKKISSMKDILPLLEKTMKEGKPLLIIAEDIEGEALTTLVVNKLRGVLNIAAVKAPGFGDRRKEMLKDIAILTGGQVISEELGLSLENAEVEFLGKAGRIVIDKDNTTIVDGKGHSHDVKDRVAQIKTQIASTTSDYDKEKLQERLAKLSGGVAVIKVGAASEVEMKEKKDRVDDALSATKAAVEEGIVIGGGAALIRAAQKVHLNLHDDEKVGYEIIMRAIKAPLAQIAINAGYDGGVVVNEVEKHEGHFGFNASNGKYVDMFKEGIIDPLKVERIALQNAVSVSSLLLTTEATVHEIKEEKAAPAMPDMGGMGGMGGMGGMM

SEQ ID NO: 3266 - protein, 523 aa, Buchnera aphidicola
  misc_feature (17)..(18): Xaa can be any naturally occurring amino acid
MAAKDVKFGNEARIKMXXGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGSLIAEAMEKVGNDGVITVEEGTGLQDELEVVKGMQFDRGYLSPYFINKTETGIVELENPYILMADKKISNVREMLPILESVAKSGKPLLIISEDLEGEALATLVVNSMRGIVKVAAVKAPGFGDRRKAMLQDISILTGGTVISEELAMELEKSTLEDLGQAKRVVISKDTTTIIGGVGEKRTIQSRINQIRQEVQEATSDYDKEKLNERLAKLSGGVAVLKVGAATEVEMKEKKARVEDALHATRAAVEEGVVAGGGVALVRVAGKIAHLRGQNEDQNVGIRVALRAMEAPLRQIVSNSGEEPSVVTNNVKDGKGNYGYNAASDQYGDMINFGILDPTKVTRSALQYAASVAGLMITTECMVTD

SEQ ID NO: 3267 - protein, 445 aa, Zea mays
  misc_feature (34)..(34): Xaa can be any naturally occurring amino acid
MRMGKYEMGRTLGEGHFGKVRLARHADTGRPFAXKILDRQRILAMKIHDQIKREIATLETVQLPNVARLVQVSASKTKIYMVLEYVNGGELFDKIALKGKLTEKEGRKLFQQLIDAVGYCHEKGVYHRDLKPENVLVDAKGNIKVSDFGLSALPQNQQKDGLLHTTCGSPNYIAPEVLLNKGYDGSISDVWSCGVILYVMLTGNLPFDDQNVVVLYQKILKGNAHIPKWLSQGAQDILRKILDPNPVTRIDVDGIRAHDWFKQGYAPAMPFSDDEEDISMDEDSLNITEHNDIQDKIAINQINAFQLIGMSSCLDLSGFFEKEDVSERKIRFASNYSPAYLFEKIESIVRKMGFQVHKSNGKLKVIQDCKGLANSRGQESLLISAEVFEINESLYVVELKKSSGDCSLYRKLCETLSEDLGTCKSQQFLKQDSIRQDIGRYNSSF

SEQ ID NO: 3268 - protein, 435 aa, Arabidopsis thaliana
MPEIEIAAGSGDNNDALFGKYELGKLLGCGAFAKVFHARDRRTGQSVAVKILNKKKLLTNPALANNIKREISIMRRLSHPNIVKLHEVMATKSKIFFAMEFVKGGELFNKISKHGRLSEDLSRRYFQQLISAVGYCHARGVYHRDLKPENLLIDENGNLKVSDFGLSALTDQIRPDGLLHTLCGTPAYVAPEILSKKGYEGAKVDVWSCGIVLFVLVAGHLPFNDPNVMNMYKKIHKGEYRFPRWMSPDLKRFVSRLLDINPETRITIDEILKDPWFVRGGLKQIKFHDDEIEDQKVESSLEAVKSSNAFDLISYSSGLDLSGLFAGCSNSSGESERSLSEKSPEMLAEEVEGFAREENLRMKKKKEEEYGFEMEGQNGKFGIGICISRLNDLLVVVEARRRGGDGDCYKEMWNGKLRVQLIRVCDQTSSTNAAI

SEQ ID NO: 3269 - protein, 523 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISKDTTTIIGGVGEKHTIQSRISQIRQEIQEATSDYDKEKLNERLAKLSGGVAVLKVGAATEVEMKEKKARVEDALHATRAAVEEGVVAGGGVALVRVAGKISHLRGQNEDQNVGIRVALRAMEAPLRQIVSNSGEEPSVVTNNVKDGKGNYGYNAASDQYGDMIDFGILDPTKVTRSALQYAASVAGLMITTECMVTD

SEQ ID NO: 3270 - protein, 823 aa, Zea mays
MLCLVSPSSSPTPLPPPRRSRSHADRAAPPGIAGGGNVRLSVLSVQCKARRSGVRKVKSKFATAATVQEDKTMATAKGDVDHLPIYDLDPKLEIFKDHFRYRMKRFLEQKGSIEENEGSLESFSKGYLKFGINTNEDGTVYREWAPAAQEAELIGDFNDWNGANHKMEKDKFGVWSIKIDHVKGKPAIPHNSKVKFRFLHGGVWVDRIPALIRYATVDASKFGAPYDGVHWDPPASERYTFKHPRPSKPAAPRIYEAHVGMSGEKPAVSTYREFADNVLPRIRANNYNTVQLMAVMEHSYYASFGYHVTNFFAVSSRSGTPEDLKYLVDKAHSLGLRVLMDVVHSHASNNVTDGLNGYDVGQSTQESYFHAGDRGYHKLWDSRLFNYANWEVLRFLLSNLRYWLDEFMFDGFRFDGVTSMLYHHHGINVGFTGNYQEYFSLDTAVDAVVYMMLANHLMHKLLPEATVVAEDVSGMPVLCRPVDEGGVGFDYRLAMAIPDRWIDYLKNKDDSEWSMGEIAHTLTNRRYTEKCIAYAESHDQSIVGDKTIAFLLMDKEMYTGMSDLQPASPTIDRGIALQKMIHFITMALGGDGYLNFMGNEFGHPEWIDFPREGNNWSYDKCRRQWSLVDTDHLRYKYMNAFDQAMNALDERFSFLSSSKQIVSDMNDEEKVIVFEREDLVFVFNFHPKKTYEGYKVGCDLPGKYRVALDSDALVFGGHGRVGHDVDHFTSPEGVPGVPETNFNNRPNSFKVLSPPRTCVAYYRVDEAGAGRRLHAKAETGKTSPAESIDVKASRASSKEDKEATAGGKKGWKFARQPSDQDTK

SEQ ID NO: 3271 - protein, 403 aa, Pseudomonas syringae
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAMHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPIFNDEKFVLDLLLSEKLLVVQGTAFNWPYPDHFRVVTLPRVDELEQAIGRIGNFLKGYRQ

SEQ ID NO: 3272 - protein, 478 aa, Staphylococcus aureus
MTKLPQNFMWGGALAANQFEGGYDKGGKGLSVIDVMTSGAHGKARQITESIDPNHYYPNHEGIDFYHRYKEDIALFKEMGLKCLRTSIAWTRIFPNGDEDVPNEEGLAFYDRIFDELIAQGIEPVVTLSHFEIPLHLAKHYGGFRNREVVNYFVHFARVVFERYKDKVTYWMTFNEINNQMDTSNPIFLWTNSGVALTENDNPEEVLYQVAHHELLASALAVRLGKEINPKFKIGTMISHVPIYPYSCHPKDMMEAQIANRLRFFFPDVQVRGYYPSYAKKMLARKGYDFGWQEGDDSILQQGTVDYIGFSYYMSTAVKHDVDTTVENNIVNGGLNHSVENPHIATSDWGWAIDPDGLRYTLNVLYDRYQLPLFIVENGFGAVDEVVDGHIHDDYRIEYLKAHITAAIEAVDQDGVDLIGYTPWGIIDIVSFTTGEMKKRYGLIYVDRDNDGRGTMERLKKDSFYWYQQVIASNGDKL

SEQ ID NO: 3273 - protein, 903 aa, Arabidopsis thaliana
MVSLSNQTRFSFHPNNLVVSEKRRLGISGVNFPRKIKLKITCFAAERPRQEKQKKKSQSQSTSDAEAGVDPVGFLTRLGIADRIFAQFLRERHKALKDLKDEIFKRHFDFRDFASGFELLGMHRHMEHRVDFMDWGPGSRYGAIIGDFNGWSPTENAAREGLFGHDDYGYWFIILEDKLREGEEPDELYFQQYNYVDDYDKGDSGVSAEEIFQKANDEYWEPGEDRFIKNRFEVPAKLYEQMFGPNSPQTLEELGDIPDAETRYKQWKEEHKDDPPSNLPPCDIIDKGQGKPYDIFNVVTSPEWTKKFYEKEPPIPYWLETRKGRKAWLQKYIPAVPHGSKYRLYFNTPDGPLERVPAWATYVQPEDEGKQAYAIHWEPSPEAAYKWKYSKPKVPESLRIYECHVGISGSEPKVSTFEEFTKKVLPHVKRAGYNAIQLIGVPEHKDYFTVGYRVTNFFAASSRYGTPDDFKRLVDEAHGLGLLVFLDIVHSYAAADQMVGLSLFDGSNDCYFHYGKRGHHKHWGTRMFKYGDLDVLHFLISNLNWWITEYQVDGYQFHSLASMIYTHNGFASFNNDLDDYCNQYVDRDALMYLILANEILHVQHPNIITIAEDATYYPGLCEPVSQGGLGFDYYVNLSASEMWVSLLDNVPDNEWSMSKPVLQIVSTLVANKEYADKMLSYAENHNQSISGGRSFAEILFGGVDNGSPGGKELLDRGISLHKMIRLITFTSGGRAYLNFMGNEFGHPERVEFPTQSNNFSFSLANRRWDLLESGVHHHLFSFDKELMDLDKSKGILSRGLPSIHHVNDANMVISFSRGPFLFIFNFHPSNSYEKYDVGVEEAGEYTMILNSDEVKYGGQGIVTEDHYLQRSISKRIDGQRNCLEVFLPSRTAQVYKLTRILRI

SEQ ID NO: 3274 - protein, 174 aa, Dendrobium grex
MGRGRVEMKRIENKINRQVTFAKRRTGLLKKAYELSVLCDVEVALIIFSNRGKLYEFCSSRSMLKTLEKYQKCSDGAPEMTMTSRETQSSQVEYLKLKSQVEALQRSQRNLLGEDLNPLGGKDLDQLERQLEASLKQIISTRMQYMLDQLGDLQQRELLLFETNKSLGTRVSAL

SEQ ID NO: 3275 - protein, 247 aa, Dendrobium grex
MGRGRVQLKRIENKINRQVTFSKRRSGLLKKAHEISVLCDAEVALIVFSNKGKLYEYSTDSSMEKILERYERYSYAERALFSNEANPQADWRLEYNKLKARVESLQKSQRHLMGEQLDSLSIKELQRLEQQLESSLKFIRSRKTQLILHSISELQKMEKILLEQNKTLEKEIIAKEKAKALVQHAPWEKQNQSQYSSALPPVISDSVPTPTSRTFQARANEEESPQPQLRVSNTLLPPWMLSHMNGQ

SEQ ID NO: 3276 - protein, 741 aa, Streptomyces coelicolor
MALRDTSIPEPSGPVPPAPGACATAPPLDPTDRGRLLAGAHHDPHSLLGAHPVPGGIAFRVLRPFAREVGVVVDGERHTLASEEDGLFSGVLPLAGIPSYTLVVAYEQGETQETHDPYRFLPALGELDLHLIGEGRHEQLWQALGAEPMTHEGVTGTRFTVWAPNAQGVRVATDFTHWDGTAFPMRSLGSSGVWELFLPGVGEGTRYKFEIHSRYGHRFLKADPMARAAEEPPNTASVVTASRYEWGDAQWMRTRADTPVHEAPFSVYEVHLPSWRPGLTYRELAEELPAYVKDLGFTHVELMPVAEHPYGPSWGYQVTGFYAPTARLGSPDDFRFLVDALHRAGIGVIMDWVPAHFPKDDWALGRFDGDPLYEPGDSRRAEHPDWGTYTFDFARTEVRNFLVANAVYWCEEFHIDGLRVDAVASMLYLDYSRDSGQWEPNQYGGREDLAAMAFLQEMNATVYRRCPGVVTIAEESTAWGGVTRPTDTGGLGFGLKWNMGWMHDSLEYVAHEPVHRRYHHHEMTFSMVYAYSENYVLPISHDEVVHGKQALVSKMPGDWWHRRANVRAYLGFMWAHPGKQLLFMGQEFAQGAEWSEKQGPEWWLLDEGYHSAGDHRGVQDLVRELNTRYTRTPALWQRDTDPAGFRWVSVDAAEDNVFAFLRYGTDGTPLLAVSNFSPVVRHEYGLAVGDEAVAWQEVLNTDAEEYGGGGVGNPDPVKPEDGSIRITLPPLATVWLMPYAL

SEQ ID NO: 3277 - protein, 682 aa, Glycine max
MSGGGCSSIVWFRRDLRIEDNPALTAGVRAGAVVAVFIWAPEEEGQYYPGRVSRWWLKNSLAHLDSSLRNLGTPLITKRSTDTLSSLFEVVKSTGATQLFFNHLYDPLSLVRDHRAKEVLTAQGITVRSFNADLLYEPWDVNDAHGRPFTTFAAFWERCLSMPYDPESPLLPPKRIIPGDASRCPSDTLLFEDELEKASNALLARAWSPGWSNADKALTAFVNGALIEYSKNRRKADSATTSFLSPHLHFGEVSVKKVFHLVRIKQVFWANEGNKAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGSLPDGREIDRIDNPQFEGYKFDPNGEYVRRWLPELARLPTEWIHHPWNAPESVLQAAGIELGSNYPLPIVGIDAAKVRLLEALSQMWQQEAASRAAMENGTEEGLGDSSESAPIAFPQDIQMEERPEPVRNNPPHGTRRYQDQMVPSITSSHVRVEEEETSSDLRNSAADSRAEVPINVTTQQNARETVNQGVLLNTNRNTRVQNNPTTWLRNAAEDSTAESSSSTRRERDGGVVPVWSPPASNFSEQFVDDENGIGTGSSYLQRQHPQSHQLMNWTRLPQTG

SEQ ID NO: 3278 - protein, 414 aa, Arabidopsis thaliana
MENGATTTSTITIKGILSLLMESITTEEDEGGKRVISLGMGDPTLYSCFRTTQVSLQAVSDSLLSNKFHGYSHTVGLPQARRAIAEYLSRDLPYKLSQDDVFITSGCTQAIDVALSMLARPRANILLPRPGFPIYELCAKFRHLEVRYVDLLPENGWEIDLDAVEALADENTVALVVINPGNPCGNVYSYQHLMKIAESAKKLGFLVIADEVYGHLAFGSKPFVPMGVFGSIVPVLTLGSLSKRWIVPGWRLGWFVTTDPSGSFKDPKIIERFKKYFDILGGPATFIQAAVPTILEQTDESFFKKTLNSLKNSSDICCDWIKEIPCIDSSHRPEGSMAMMVKLNLSLLEDVSDDIDFCFKLAREESVILLPGTAVGLKNWLRITFAADATSIEEAFKRIKCFYLRHAKTQYPTI

SEQ ID NO: 3279 - protein, 602 aa, Kluyveromyces lactis
MSHDPNQQQPHGGSGQGHHQRQLTNHAQGQHIGKYQIIKTLGEGSFGKVKLAYHISTGQKVALKIINKKVLAKSDMQGRIEREISYLRLLRHPHIIKLYDVIKSKDEIIMVIEYAGNELFDYIVQRDKMPEQEARRFFQQIISAVDYCHRHKIVHRDLKPENLLLDEHLNVKIADFGLSNIMTDGNFLKTSCGSPNYAAPEVISGKLYAGPEVDVWSSGVILYVMLCRRLPFDDESIPVLFKNISNGVYTIPNFLSQGAASLIKKMLIVNPVNRITVHEIMQDEWFKVDLPDYLVPAESTHQENSESKTEDGGPSVPLELIDDSLVQTLSNTMGYDVDEIYEALESDEDHPSLNEIRDAYQLIKENRNLINDIKVNKQQSNDLDTFLSQSPPTFEQSLHAPPGSKNRHSHRHSKRTQQRTYQYHYGNGSQDGDSTIAILPSSLPQIHRANMVAQGSQAAAKISPLSVKKSKTRWHFGIRSRSYPLDVMGEIYIALKNLGAEWAKPSEEDLWTIRVRWRYNIDMPDDEMKNKQIPDLMKMVIQLFQIETNNYLVDFKFDGWESSNGVVYSSRNDDEMSTFSAYPFLHLATRLIMELAVNSQGS

SEQ ID NO: 3280 - protein, 220 aa, Dendrobium grex
MGRGRVELKRIENKINRQVTFAKRRNGLLKKAYELSVLCDAEVALIVFSNRGRLFEFCSSTSMTKTLERYQKCSYNASESAVPSKDAQNSYHEYLTLKAKVEYLQRSQGNLLGEDLIELSSKELDQLELQLEMSLKQIRSTKTQLMLDQLCDIKRKEQMLHEANRALSMKLKEDGPEIPLELSWPGGETNGSSERQQPQSDKFFQPLPCSNPSLQIGYSP

SEQ ID NO: 3281 - protein, 620 aa, Candida albicans
MSEQAQPQASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYAGPEVDVWSAGVILYVMLCGRLPFDDEFIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHALVKDLKKSKSENIESFLSQSPPPSPFPNRGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVSFKFSGWESAHGNAGTDSPQSHRQQDLDEVGSFSAYPFLHLATRLIMELAVNSQSG

SEQ ID NO: 3282 - protein, 314 aa, Geobacter metallireducens
MPFSEPGKTKFQVDLRRHLRNQGICDNLVHLICEIAEASKYVINAVRTGDLGVAGTSNLYGEEQLALDVLSDRIIKKRLIHSGVVCNIASEEMDEIFQAQADADGLYSVAYDPLDGSSLVDVNLAVGTIVSIYEGCNLLQKGRNQVAALYILYGPRVSMVYSVGRGVHEFTMNHLMEFTLSRENIVMQEEGNIYAPGGLRNKYQEGTEQFVRYLEEKGAKLRYSGGFVPDINQVIMKGKGIFMYPALNGSPNGKLRLLFELNAMAYLVENAGGAATDGKQPILDLEPHSLDQRAPVYIGCKADVVKAMEFVSRN

SEQ ID NO: 3283 - protein, 1051 aa, Vibrio parahaemolyticus
MVGIFSWNNLSVKHKLFGLVLLPIISLFFLAGQHVHNLSTQAQDLQKAQLFSVYIDKVSYLFNLPNNPSIPNKAEKTAQLIQELKETTPRVFGDNSEVLPLLASFEEASLSMFTAIDIEEKLDIAEWRADTFEQILLNLDKVYFSNVSYETDRHLSSLMQLEWLMFWSTEERRLSEYLIYSANKRLHYDDAVRDEIQSLIQNQQLLVERFVALNANHNQVQLLIETFSNKVFQTSQEFRDKLLNQEELQALSPLKTGAGLAALNTRLALLHDINDTMEHELQTKLAQTIKATTQQRLVFIVLMSLVTILVISLTIRLVRKVTNNLHLVLEFLSRENYSEDSPLSELIKGKDELSKFAQEVEKLSHEREQAKQKLTKAKEDAERAKDDAIEASKAKSSFLANMSHEIRTPLNGVIGISEVLADTPLTATQRDYVDTIETSSQLLLSLINDVLDFSKIESGMLLISPHSTCVRESIYDIASIVSPKAKEKGIELTVSISPNTPYHIVIDDHRLRQVIMNFMSNAVKFTERGSVELSITTLESNESEAIIEFSVQDSGIGIDEQQQKRIFAPFAQEDDSTTRQFGGTGLGLAISTQLVELMGGSIQLESEKGRGSRFYFQLTAPISQAHFRARHTVNNQIWLVCDDSDLETKLRNELSFYQIQVHQSVHDLSALPTWINDKERIIILYVETTPDAAVKNTDLMRNLEHQHVQVCLIKHLHSQQLDFGHRVAAIITQPLLGQRLLKALESCAGRFTQSISVVQPATRLETLPKVLVVDDNTVNQKIAGLHVTKAGFSFDVAANGEEAVDLFRTSQYCLILMDCMMPVMDGFEATKQIRQIEQKENRTFRIPIIALTASVVDDDIQKCFDVGMDDYVPKPFKADLLKEKLDKAVGLRLPVTASTKLNQSSLTAFEEPEFKQRVGETLSAAPMRRERILLVEDNRVNQKVASLLLSKAGYQFEVAENGQIAVEMFQRDGGFDIILMDCMMPVMDGFEATKQIRAYEASLGLEKTPIIALTASVVDDDIQRCFDSGMDAYVPKPVRKEKLLHQIENVM

SEQ ID NO: 3284 - protein, 478 aa, Mycoplasma mycoides
MMLIFMELIFYIKRIYMFKFKKDFWWGAASSGCQTESDKDKPNLNIMDYWYKQTPTDFYDNKGPNITCDTYSNYKTDVKLMSEIGLNSFRTSIQWTRLIKNLYTGEVDLKQVEFYRNYFLEIKKNNIKLIVNLFHFDTPIELENIGGWTNKKTVELYFLYAKQCFKYFSDLVDYWTTFNEPVVLVDGCYLNKWYYPKISNLKLAVQAAYNTILAHCKVANYFHSYFKNDQNKKISIILNLTPTIPKNSELKHLKAAKIRDELLNKSFLNAVIKGQFSTFLIKFLNENNLMPEYDQLELNEIKKTRIDFLAVNYYQPARVQAPLNNLTSSTELKLENWFLPYTNKNIRINPYRGWEIHPQTLYDIAIDIKNNYDNIPWIVSENGIGVSDENRFLNKQGYIDDQYRIDFIKEHLIYLYKAIEQGSNCFGYQMWTLIDNWSWANGFKNRYGFISLDTKTLKRTIKKSGYWIKQVIKDQGFE

SEQ ID NO: 3285 - protein, 549 aa, Glycine max
MNSFAKSEPVSSSASSSSSTYQQVPEQDANNDLDRVADNTFRRYTSNVTKGSGKGTAIVWFRNDLRVLDNEALYKAWLSSETVLPVYCVDPRLFATTYHFGFPKTGALRAQFLLECLADLRKNLMKRGLNLLVQHGKPEEILPSLAKSFQAHTVYAQKETCSEELNVERLVMRGLKQVVTSPEESSGITVSNNIPKLQLVWGTTMYHLDDLPFDATSLPDVYTQFRKLVETKCTIRSCIKLPASLGPPPTVQDWGCLPSLEQLGLSSQSVNKGMKFVGGETAALSRVYEYFWKKDLLRVYKETRNGMLGPDYSTKFSPWLASGSLSPRFIYEEVKRYENDRLANSSTYWVLFELIWRDYFRFLSVKYGNSLFHLGGPRKVQRNWSQDKNLFESWRDGCTGYPLIDANMKELSTTGFMSNRGRQIVCSFLVRDMGIDWRMGAEWFETCLLDYDPCSNYGNWTYGSGVGNDPREDRYFSIPKQAQTYDPEGEYVAYWLPQLRKIPKEKRNFPGNLIYIPQIVPLKFGTTSGPNKDKFFGARRTNDRGSKRR

SEQ ID NO: 3286 - protein, 523 aa, Buchnera aphidicola
  misc_feature (15)..(15): Xaa can be any naturally occurring amino acid
  misc_feature (19)..(19): Xaa can be any naturally occurring amino acid
  misc_feature (36)..(36): Xaa can be any naturally occurring amino acid
  misc_feature (45)..(46): Xaa can be any naturally occurring amino acid
  misc_feature (335)..(336): Xaa can be any naturally occurring amino acid
  misc_feature (367)..(368): Xaa can be any naturally occurring amino acid
MAAKDVKFGNEARIXMLRXVNVLADAVKVTLGPKGXNVVLDKSFXXPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQDELEVVKGMQFDRGYLSPYFINKTETGIVELENPYILMADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISKDTTTIIGXXGEKHTIQSRISQIRQEVQEATSDYDKEKLNXXLAKLSGGVAVLKVGAATEVEMKEKKARVEDALHATRAAVEEGVVAGGGVALVRVAGKISHLRGQNEDQNVGIRVALRAMEAPLRQIVSNSGEEPSVVTNNVKDGKGNYGYNAASDQYGDMIDFGILDPTKVTRSALQYAASVAGLMITTECMVTD

SEQ ID NO: 3287 - protein, 523 aa, Buchnera aphidicola
  misc_feature (368)..(368): Xaa can be any naturally occurring amino acid
MAAKDVKFGNEARIKMLRGVNVLADAVKVTLGPKGRNVVLDKSFGAPSITKDGVSVAREIELEDKFENMGAQMVKEVASKANDAAGNGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIIAEDLEGEALATLVVNSMRGIVKVAAVKAPGFGDRRKAMLQDISILTGGSVISEELAMELEKSTLEDLGQAKRVVISKDTTTIIGGVGEKHTIQSRISQIRQEIQEATSDYDKEKLNEXLAKLSGGVAVSKVGAATEVEMKEKKARVEDALHATRAAVEEGVVAGGGVALVRVAGKISHLRGENEDQNVGIRVALRAMEAPLRQIVSNSGEEPSVVTNNVKDGTGNYGYNAASDQYGDMINFGILDPTKVTRSALQYAASVAGLMITTECMVTD

SEQ ID NO: 3288 - protein, 180 aa, Zea mays
MADAPASPGGGGGSHESGSPRGGGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDIKK

SEQ ID NO: 3289 - protein, 523 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISKDTTTIIGGIGEKHTIHSRISQIRQEIQEATSDYDKEKLNERLAKLSGGVAVLKVGAATEVEMKEKKARVEDALHATRAAVEEGVVAGGGVALVRVAGKISHLRGQNEDQNVGIRVALRAMEAPLRQIVSNSGEEPSVVTNNVKDGKGNYGYNAASDQYGDMIDFGILDPTKVTRSALQYAASVAGLMITTECMVTD

SEQ ID NO: 3290 - protein, 461 aa, Saccharophagus degradans
MDSADANGEVLPAYIKDTANPWPIQGAAAWWLHHSLAAFTNSIKNKGGVLSLFEGDPATLVPELISQNKIDAVYLSQGFEPYEVQLQANIHKWCKQHNIECKRFAGHLLLNPDTHLNKQGKPFQVFTPYYKAALATHTIPRAKPIPSNLAKVWAAKKLPKSVALNKLKLLPNLNWADQFNSQWQPGEEGAHKNLREAIEDKIASYTRDRDFPAVDGTSLLSAHLRFGEISPRQIWQQVATQMDGEQCAPFLRQLMWRDFSYALLHHWPHIPQQAFKQQFEKFPWQKASNKNVAKQLHAWQTGTTGYPIVDAGMRQLWQTGWMHNRVRMIVASFLTKHLRIHWHEGAKWFWDTLVDADLANNTAGWQWVAGCGADAAPYFRIFNPVLQGEKFDKQGEYIKTWVPELAALPAKFIHAPWLAPQDILQTAGISLGNNSTYPLPIVDHKYAREAALAAYQQLKGD

SEQ ID NO: 3291 - protein, 362 aa, Shewanella oneidensis
MFKAFKGHALETKNRIVMAPMTRSRSTHPGDVPNEMMANYYRQRASAGLIITEGAPVSAVARGYSMTPGIYTPAQIEGWKKVTEAVHQEGGKIFIQLWHVGRRSHSSVSGAEPLAPSAIKIPDQVFGPLPEGGFGMIETQQPKAMSEQDIQATISDFVQAAQNAMLAGFDGVEVHAAHGYLFDTFLRLESNQRQDRYGGSQENRLRFLVDTLQALTQTIGSGKVAVRISPHIGEGFTGDNPEIIQLTLALLQKLQPMNLAYVHFSENISRYVEVSDAFRQQVRRVYQHPIMVAGKLTKQSAQRLLDQHYADFVAFGTPFVTNPDLVARFTHDWPLTEFDADARLTLYGGGEAGYIDYPAYQA

SEQ ID NO: 3292 - protein, 544 aa, Neisseria flavescens
MAAKDVQFGNEVRQKMVNGVNILANAVRVTLGPKGRNVVLDRAFGGPHITKDGVSVAKEIELKDKFENMGAQMVKEVASKTNDVAGDGTTTATVLAQSIVAEGMKYVTAGMNPTDLKRGIDKAVAALVDELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGVVISEEVGLSLEKATLDDLGQAKRIEIGKENTTIIDGFGDAAQIEARVAEIRQQIETATSDYGKEKLQERVAKLAGGVAVIKVGAATEVEMKEKKDRVEDALHATRAAVEEGVVAGGGVALLRARAALENLHTGNADQEAGVQIVLRAVESPLRQIVAKAGGEPSVVVNKVLEGKGNYGYKAGSGEYGDMIEMGVLDPAKVTRSALQHAASIAGLMLTTDCMIAEIPERKPAMPDMGGMGGMGGMM

SEQ ID NO: 3293 - protein, 523 aa, Buchnera aphidicola
  misc_feature (411)..(412): Xaa can be any naturally occurring amino acid
  misc_feature (461)..(462): Xaa can be any naturally occurring amino acid
  misc_feature (518)..(519): Xaa can be any naturally occurring amino acid
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISKDTTTIIGGVGEKHTIQSRISQIRQEIQEATSDYDKEKLNERLAKLSGGVAVLKVGAATEVEMKEKKARVEDALHATRAAVEEGXXAGGGVALVRVAGKISHLRGQNEDQNVGIRVALRAMEAPLRQIVSNSGEXXSVVTNNVKDGKGNYGYNAASDQYGDMIDFGILDPTKVTRSALQYAASVAGLMITTXXMVTD

SEQ ID NO: 3294 - protein, 365 aa, Shewanella oneidensis
MTQSLFQPITLGALTLKNRIVMPPMTRSRASQPGDVANHMMAIYYAQRASAGLIVSEGTQISPTAKGYAWTPGIYTPEQIAGWRIVTEAVHAKGCAIFAQLWHVGRVTHPDNIDGQQPISSSTLKAENVKVFVDNGSDEPGFVDVAVPRAMTKADIAQVIADYRQAALNAMEAGFDGIELHAANGYLINQFIDSEANNRSDEYGGSLENRLRFLDEVVAALVDAIGAERVGVRLAPLTTLNGTVDADPILTYTAAAALLNKHRIVYLHIAEVDWDDAPDTPVSFKRALREAYQGVLIYAGRYNAEKAEQAINDGLADMIGFGRPFIANPDLPERLRHGYPLAEHVPATLFGGGEKGLTDYPTYQA

SEQ ID NO: 3295 - protein, 178 aa, Oryza sativa
MMMMDLGFLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 3296 - protein, 544 aa, Neisseria gonorrhoeae
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGIKAVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGVLKTVAVKAPGFGDRRKAMLQDIAILTGAVVISEEVGLSLEKATLDDLGQAKRIEIGKENTTVIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIGMGVLDPAKVTRSALQHAASIAGLMLTTDCMIAEIPEEKPAVPDMGGMGGMGGMM

SEQ ID NO: 3297 - protein, 523 aa, Buchnera aphidicola
  misc_feature (314)..(314): Xaa can be any naturally occurring amino acid
  misc_feature (337)..(337): Xaa can be any naturally occurring amino acid
  misc_feature (339)..(341): Xaa can be any naturally occurring amino acid
  misc_feature (350)..(351): Xaa can be any naturally occurring amino acid
  misc_feature (385)..(385): Xaa can be any naturally occurring amino acid
  misc_feature (517)..(520): Xaa can be any naturally occurring amino acid
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMELEKSTXEDLGQAKRVVISKDTTTIIGGVXEXXXIQSRISQIXXEIQEATSDYDKEKLNERLAKLSGGVAVLKVGAAXEVEMKEKKARVEDALHATRAAVEEGVVAGGGVALVRVAGKISHLRGQNEDQNVGIRVALRAMEAPLRQIVSNSGEEPSVVTNNVKDGKGNYGYNAASDQYGDMIDFGILDPTKVTRSALQYAASVAGLMITXXXXVTD

SEQ ID NO: 3298 - protein, 110 aa, Lactobacillus delbrueckii
  misc_feature (101)..(101): Xaa can be any naturally occurring amino acid
LQPDTKIRTFAIGMDQNPIDLKYAREVADYLGTDHTEFIMTREDVLGVLREVIYTLETWDITTIRASIGMYILCKKIHETTDLKVILTGECSDELFGYKYXDFAPSPEEF

SEQ ID NO: 3299 - protein, 203 aa, Lentinula edodes
MGRVLLKVIILGDSGVGKTSLMNQYVNKRFSNQYKATIGADFLTKEVMVDDRLVTMQLWDTAGQERFQSLGVAFYRGADCCVLVYDVNSAKSFETLDSWRDEFLIQASPHDPENFPFVVLGNKIDVEENKRQVTQKRAMTWCQSKGNIPYFETSAKEAINVEQAFQTVAKNALTQEAEEQLYVDYPDPIQLDSESSQSYGCNC

SEQ ID NO: 3300 - protein, 541 aa, Neisseria gonorrhoeae
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGIKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGVLKTVAVKAPGFGDRRKAMLQDIAILTGGVVISEEVGLSLEKATLDDLGQAKRIEIGKENTTVIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQEAGVQIVLRAVESPVRQIVANAGGEPSVVVNKVLEGKGNYGYNAGSGEYGDMIGMGVHDPAKVTRSALQHAASIAGLMLTTDCMIAEIPEEKPAVPDMGGMGGMM

SEQ ID NO: 3301 - protein, 398 aa, Pyrococcus abyssi
MVRASKRALSIEYAIRDVVLPARELEKKGIKVIRLNIGDPVKFDFQPPEHMKEAYCKAIKEGHNYYGDSEGLMELREAIVEREKKKNGVNITPDDVRVTAAVTEALQMIFGALLDPGDEILIPGPSYPPYTGLVKFYGGVPVEYRTIEEEGWQPDIDDLRKKITERTKAIAVINPNNPTGALYDKKTLEEIINIAGEHDIPVLSDEIYDLMTYEGKHISPASLTKDVPVIVMNGLSKVYFATGWRLGYMYFVDPEGKLSEVREAIDKLARIRLCPNTPAQFAAIAGLRGPMDYLEEYMKKLKERRDYIYKRLNEIPGISTTKPQGAFYIFPRIEEGPWKDDKEFVLDVLHNAHVLFVHGSGFGEYGRGHFRAVFLPPVEVLEEAMNRFEKFMREKLSS

SEQ ID NO: 3302 - protein, 154 aa, Triticum aestivum
SLALVVKDPETSPTSGGGEHADENKETVGGGEPRDLGAVVPAPNRRPRGRPPGSKNKPKPPIFVTRDSPNALRSHVMEVAGGADVCDAIAQFSRRRQRGVCVLSGAGTVANVALRQPSAPGGAVVALHGRFEILSLTGTFLPGPAPPGSTGLTV

SEQ ID NO: 3303 - protein, 110 aa, Kluyveromyces lactis
MSSSVPYDPYVPATEETAGDSKTAALKSEIDDTVDIMRDNINKVAERGERLTSIQDKADNLAVSAQGFKRGANRVRKQMWWKDLKMRMCLVLVVIILLIVIIVPIAVHFS

SEQ ID NO: 3304 - protein, 699 aa, Adiantum capillus-veneris
MAKPCTIVWLRRDLRLEDNPALCAAGRIGNVVPVFIWSPEEERQFHPGRVSRWWLKQSLIQLDVSLRSFGVPLVMRKSTDTLGTLQELIKATGATQVFYNHLYDPISLVRDHHVKQGLTQSGIQVQSFNGDLLYEPWEVLNDDGKPFTSFESYWQKCLNMPFEPDSPLLPPRRLTSIAGSIPTYTPEELGLEDETEKSSNALLARAWAPGWSNADRALEAFLAGPLLEYSRNRHKIDGPTTSLLSPHMHFGEVSVRKVYHSVRRLQLLWAKDGSKLGEESIYFFMRSIGFREYSRYLSFNFPFTHERSLLSNLKSFPWRVDEGFFKAWRQGRTGYPLVDAGMRELWATGWLHNRVRVIVSSFCVKFLQLPWRWGMKYFWDTLLDADLESDVLGWQYISGSLPDGHELDRMDNPQTEGYKHDPVGEYVRRWLPELVRLPTEWIHHPWDAPPAVLRAAGVELGSNYPRPIVEVAAARERLRQAVAQMWEQEAALKAAGVATDAEALDENLEVKVVTPPLVSTHSLKTAVAGTLSRSSLRDQRVPTCGKQLSMENGVPHEGDNSPDIAMSPQQDNLLATTAPPEAHSTAEKCDNKSMNCDQTPEPKHNVPPPAVSDGNSTAESSSSPKQVNDELRNGVPLVWVPSIVNQQPVVEPSCVPYAGDAGQLRKHLLALQNSRTENKMEEKSPLSEWRRRTKRKAKA

SEQ ID NO: 3305 - protein, 487 aa, Adiantum capillus-veneris
MTTSTTIVWLRRDLRLDDNPALKEASKIGNAVVPVFVWVPEEEGQFQQGRMSRWWLKQSLKQLAQSLDSLGSPLIIRRSSSSLQALMDLVIHTQASQVFFNHLYDPISLVRDQRVKEGLLQTGIHVRTFNADLLYEPWQVNDPSGKAFTTFNEFWDKCLNMPEEPHAPLLPPTRSLLAFAGHLPGCTVEDLELENNSEKDSNALLARSWTPGWINAEKALEAFVERHLLQYAANQHMVDGSTTSFLSPHLHFGELSVRKVFYNVRIKAVQWTKEGKPDGEQSVNLFLRSIGLRDYSRYICFNFPFTHERLILQNRRPFPWRVDEGLFKAWRQGRTGYPLVDAGMRQIWATGWLHNRIRVIVSSFFVKVLQLPWTWGMKYFWDALLDADLENDILGWQYISGGLPDGHELERMDDLQIEGYKYDPRGEYVRKWLPELSRLPTEWIHHPWDAPPRALRAAGVELGSNYPRPLVEFAAAWSRLQTALREA

SEQ ID NO: 3306 - protein, 423 aa, Trichodesmium erythraeum
MPYYISPRFIDKLAVHITKNFLEIPRIRVPLIIGIHGRKGEGKTFQCQLVFEKMGIEPVTISGGELESKDAGDPARLLRLRYREASEKVKVQGRMCALFINDLDAGAGRFDGGTQYTVNTQLVNATLMNIADNPTNVQLPGSYDETPLHRIPIIVTGNDFSTLYAPLIRDGRMEKFYWEPNREDRVGIVGSIFKTDELSTGDIDNLIDEFSDQAIDFFSALRSRIYDEQIRDFIHQVGIEKISRRVVNSVEKIPDFPQPTFNVSRLLEYGKIMVGEQERIRELGLVEEYNKSRLFGVFKTSQRENITPNSNGLFPEVTTENKLNANRINHSIKSSNLSSEVREKIQKILEDGGKIGMEYADKRRYKTGSWKSCGKIENGEVKEVINAVENCLVKHQNDYVRLIGIDGNVKRRIVEKIIYRPDI

SEQ ID NO: 3307 - protein, 112 aa, Listeria monocytogenes
MTDRKNLTTNQGVPVGDNQNSMTAGRKGPTLIEDYVLIEKLAHFDRERVPERVVHARGAGAHGKFVTKKSMKKYTMAKFLQEEGTETEVFARFSTVIHGQHSPETLRDPRGF

SEQ ID NO: 3308 - protein, 280 aa, Bacillus subtilis
MTTHLQAKATLHNGVEMPWFGLGVFQVEEGSELVNAVKTAIVHGYRSIDTAAIYGNEAGVGEGIREGIEEAGISREDLFITSKVWNADLGYEETLAAFETSLSKLGLDYLDLYLIHWPVEGKYKEAWRALETLYKEGRIKAIGVSNFQIHHLEDLMTAAEIKPMINQVEFHPRLTQKELIRYCQNQGIQMEAWSPLMQGQLLDHPVLADIAQTYNKSVAQIILRWDLQHGIITIPKSTKEHRIKENASVFDFELTQDDMNRIDALNENLRVGPDPDNFDF

SEQ ID NO: 3309 - protein, 323 aa, Aspergillus nidulans
MSLPSHFSLNTGAKIPAVGFGTWQAKPLEVENSVEVALKQGYRHIDCAAIYRNETEVGNGIRKSGVPREEIFLTGKLWNTKHAPEDVEPALDKTLKDLGVEYLDLYLMHWPCAFKASDKWFPLDDNGVFQLADIDYVTTYRAMEKLLNTGKVRAIGVSNFNVRRLEDLLSKVSVVPAANQIEAHPYLQQPDLLRYCQSKGIIIEAYSPLGNNQTGEPRTVDDPVVHTVAGQLSMDPGPLLASWAVQRGTVVLSKSVTPSRIAANLQVKRLPDDAFATLAALERHKRFNFPAFWGYDIFDEAGEEAVKKAAMDAAPINKTKFTV

SEQ ID NO: 3310 - protein, 541 aa, Enterococcus faecalis
MAKEIKFAEDARAAMLRGVDVLADTVKVTLGPKGRNVVLEKSFGSPLITNDGVTIAKEIELEDHFENMGAKLVSEVASKTNDIAGDGTTTATVLTQAIVREGLKNVTAGANPLGIRRGIELATKTAVEELHNISSVVDSKEAIAQVAAVSSGSEKVGQLIADAMEKVGNDGVITIEESKGIETELDVVEGMQFDRGYLSQYMVTDNDKMEAVLENPYILITDKKISNIQDILPLLEQILQQSRPLLIIADDVDGEALPTLVLNKIRGTFNVVAVKAPGFGDRRKAMLEDIAILTGGTVITDDLGLELKDTTIENLGNASKVVVDKDNTTIVEGAGSKEAIDARVHLIKNQIGETTSDFDREKLQERLAKLAGGVAVVKVGAATETELKELKLRIEDALNATRAAVEEGMVSGGGTALVNVIGKVAALEAEGDVATGIKIVVRALEEPIRQIAENAGYEGSVIVDKLKNVDLGIGFNAANGEWVNMVEAGIVDPTKVTRSALQNAASVSALLLTTEAVVADKPEPAAPAPMMDPSMGMGGMM

SEQ ID NO: 3311 - protein, 167 aa, Oryza sativa
GRWSATRPGGGGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 3312 - protein, 190 aa, Ophioglossum vulgatum
DDHGEIFAEIRRSNLEPYLGLHYPATDIPQASRFLFMKNRVRMICDCSASPVKVIQDEKLGQPLSLTSSTLRAPHGCHSLYMGNMGSIASLVMAVVINDNEDDISNNGHAYQGRRLWGLVVCHHTAPRFVPFPVRSACEFLMQVFGLQLNMEVGLAAQVREKHILKTQTVLCDMLLRDAPIGIVSKSPNM

SEQ ID NO: 3313 - protein, 252 aa, Prunus caroliniana
AHYKSEADVGNAIAEAIRSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETYPYFQRESLVKFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTL

SEQ ID NO: 3314 - protein, 219 aa, Hordeum vulgare
MGATEDSSSGSETTTSSSVEALASPPSPTATTASSKKKRARNDGRHPTYRGVRMRSWGKWVSEIREPRKKSRIWLGTFATAEMAARAHDVAALAIKGRAAHLNFPDLAHELPRPATAAPKDVQAAAALAASADFPASATATANAGAKNPDGPEPNAASASTPPDTAEDALFDLPDLLFDLRHGPPSCQVSCASTWDDDVAFAGPGAGVFRLEEPLQWEY

SEQ ID NO: 3315 - protein, 334 aa, Triticum aestivum
  misc_feature (50)..(50): Xaa can be any naturally occurring amino acid
AYLGDTTEQVCTKKQAGTGPEFPADRRPTRPLGTVHHELHFTVQEGIDAXEEVIYHIETYDVTTIRASTPMFLMSRKIKSLGVKMVLSGEGSDEIFGGYLYFHKAPNKKELHEETCRKIKALHLYDCLRANKATSAWGLEARVPFLDKNFINVAMDLDPECKMIRRDLGRIEKWVLRNAFDDDEKPYLPKHILYRQKEQFSDGVGYSWIDGLKDHANAHVSDSMITNASFVYPENTPTTKEAYYYRTVFEKFYPKNAARLTVPGGPSVACSTAKAVEWDAAWSKLLDPSGRAALGVHDAAYEEEKAPALADHVFRPPAHGESILVETGVPAAAV

SEQ ID NO: 3316 - protein, 119 aa, Zea mays
IGFREYSRYLCFNYPFTHERSFLGNLKHYPWLLDEGRFKSWRQGMTGYPLVDAGMRELWATGWTHNRIRVIVSSFAVKFLQIPWIWGMKYFWDVLLDADLESDILGWQYISGSLPDGHE

SEQ ID NO: 3317 - protein, 931 aa, Ashbya gossypii
MTSIPHRHTYYGGGATPPAATGPLSGSRGHAAGRSKKKQVTFGPYIIGPTLGEGEFGKVKLGWSKARLDGDSRNVAIKLIRRDTVPKNSEKEIKIYRELNALKLLSHPNIVRLEEVLQNSKYIGIVLQYASGGEFYKYIQKKRRLKEPPACRLFAQLISGVHYIHYKGLAHRDLKLENLLLDEHENLIITDFGFVNEFHKNDLMRTSCGSPCYAAPELVVSSKPYSAQKADVWSCGVILYAMLAGYLPWDDDPENPEGEDIAKLYQYITHTSLKFPEYIKPIPRDLLKRILVSNPEVRLTVADIEQHAWLQPHAQFLMWSPSDWDAKAKAETNNLFRQPSAVHAGVLRPQSSCSISSANSKGDNRGSLIMDSTLNPQPVPPQEFQSHIIMKPTSPSNGLRKMSPVRRHARSNSAASIALQAVVDAERDYFNSPSIHSLHHDSLSQNTTPPSSAGRVPTYAITRSATHHNGISSSLMNRNSVIIEVSPQKGSVPPVMIPGNRESLNGQESGGIAMADMSQRPTIVKDKTSSHMVPQAGRKQRPTSYQPCSTTAFAQSPDLVSGAGALVPIMGKQQRVSTASNPTFVDVGRSGSTRRLPGPNNQLLETPFEADRQIDDNPVVDDATIKSDDMLPSTLEIVAYDNECGTSPGSNGQHRRYSAIVMSEIYEQEEGERISCELSSPNKMGSARPDCSTARISINTPNMGLQNRECIVSSSSPESDASSKQKSGKTDKKDKRFSLLSFYSFYNNSKSSIDSSTDAVQPTGLVLDVVKHPNISRTSSQKKNPAPAGNGTQAIPRRHNTLPREAQRTPVALSYVYASLDVTPNAGTPELADVPSPINLVKMAEQPHGTKQHDPSTPTRSATVHGKSQRLSNNTPKGPIYEDPKPKRKTNKVSLMVSSINPSQAPQPPRQKEPSTARKVLDFFKRRSLRI

SEQ ID NO: 3318 - protein, 418 aa, Emericella nidulans
MSDLQVQGRKVFKVFNQDFIVDDRYTVTKELGQGAYGIVCAATNVQTGEGVAIKKVTNVFSKKILAKRALREIKLLQHFRGHRNITCLYDMDIPRPDNFNETYLYEELMECDLAAIIRSGQPLTDAHYQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKVPFQRLFPNANPDALDLLDRMLAFDPSSRISVEEALEHPYLAIWHDASDEPSCPTTFDFHFEVVDDVQEMRRMIYEEVVRFRQSVRMPPQAQSLAQQQQIGNIPIPEHQQGVWRQEEPRPQEAGAVGGNHNDLESSLQRGMDA

SEQ ID NO: 3319 - protein, 181 aa, Unknown
  Malus x domestica
LENFIDPDIPATWRAMETLYDSGKARAIGVCNFSTKKLSDLLDIARVPPAVDQVECHPSWQQNKLRSFCKSKGVHLSGYSPLGSPGTTWIKSEVLTNPILATVAEKLGKTPAQVALRWGLQKGHSVLPKSTNEARIKENIDVFGWSIPDDLFAKFSEIEQARLIRWLSPVHHTSGPYRSLE

SEQ ID NO: 3320 - protein, 478 aa, Streptococcus pneumoniae
MTTFKDGFLWGGAVAAHQLEGGWQEGGKGISVADVMTAGRHGVAREITLGVLEGKYYPNHEAIDFYHRYKEDIALFAEMGFKCFRTSIAWTRIFPKGDELEPNEEGLQFYDNLFDECLKNGIEPVITLSHFEMPYHLVTEYGGWKNRKLIDFFARFAEVVFKRYKDKVKYWMTFNEINNQANYQEDFAPFTNSGIVYEEGDNREAIMYQAAHYELVASARAVKIGHEINPDFQIGCMIAMCPIYPVTCNPKDILMAMKAMQKRYYFADVHVLGKYPEHIFKYWERKGISVDFTDQDKEDLLGGTVDYIGFSYYMSFAIDSHRENNPYFDYLETEDLVKNNYVKASEWEWQIDPEGLRYALNWFTDHYHLPLFIVENGFGAIDQVAADGMVHDDYRIEYLGAHIREMKKAVVEDGVDLMGYTPWGCIDLVSAGTGEMRKRYGFIYVDKDDNGKGSYNRSPKKSFGWYKEVISSNGESVE

SEQ ID NO: 3321 - protein, 463 aa, Mycobacterium avium
MPQHPSLPAHAIAPAYTGRLFTAPVPALRMPDESMDPDAAYRFIHDELMLDGSSRLNLATFVTTWMDPEAGRLMAETFDKNMIDKDEYPATAAIEQRCVCMVADLFHAEGLNDADPYSACGVSTIGSSEAVMLGGLAMKWRWRAKTKDWKKRTPNLVMGSNVQVVWEKFCRYFDVEPRYLPMEEGRYVITPEQVVDAVDEDTIGVVAILGTTYTGELEPVADICGALDKLALKPASAGGVDVPVHVDAASGGFVVPFLHPELKWDFRLPRVVSINVSGHKYGLTYPGVGFVVWRSKEYLPDELVFRVNYLGGDMPTFTLNFSRPGNQVVGQYYNFLRLGREGYTKVMQTLSGTARWLGEQLRVSEHCELISDGSAIPVVAFRLAKNRGYTEFDVSHELRTYGWQVPAYTMPDNATDVSVLRIVVREGLSADLARALHDDAVSALTSLDKVKPGGHYDAQHFAH

SEQ ID NO: 3322 - protein, 177 aa, Arabidopsis thaliana
MTGTGQKLNIRRRVGENRCVNMIANLFHAPVGQDEAVISCGIVASSESAGLAFKMKWQHRRKAQGLPIDKPNIVTGVNVQVCWEKFARYFEVELKEVKLSEDYYVMDPAKAVEMVDENSICVAAILGSTFTGEFEYVKLLNDLLAEKNAKTAWETPIHVDAASGGFIASMGEEYQCQ

SEQ ID NO: 3323 - protein, 475 aa, Borrelia burgdorferi
MKNKFLICVYFLLTLGISSLVIVESIFAFDESNNKLSRSNYEQMMIQAFEFVKENYVDPVSDEVIFEGALKGIFQSLGDPYSQYLTKKDLEEISKTTVGDYVGIGISIIKKMHSQDKQDKAKDFDPNSACVSIVTPFEGGPAYKAGIKSGDCITAVDGKSVYSMEVDQVVDLLKGKEGTKVKVSILRGKNLTLDFELTREKIEIQTIKYDVINSDIGYIRIVSFNPHTSVDFRKALDNLKNKNIKSLILDLRLNTGGYFQAAIKMADDILSKGIIVSTKSRNSSKPIDYKASSKQVLPSNIKIVALIDRSSASASEVFVGALKDNKRAYIIGEKSYGKGLIQHVVPFYTGGFKITSSKYYTPSGKSIHKVGIEPDLEIKSPDFSEEEALIYKEIFDKKLIEGFLKGKKFITEQEIDFFVENLVKENPKYKIDKEFLGKYVFFNYYQDNNKELPIYNLHYDKVLKTACEYLSKLGN

SEQ ID NO: 3324 - protein, 373 aa, Corynebacterium glutamicum
MANVVLVDRMEPLVSKLFTPIQIRDITIPNRVWMSPMCTYSAATGSGLPTDFHQAHYAARAAGGVGLVMVEATGVNPVAPISPVDLGLWSHDQIEPFSRVTAAIRAGGAVPAVQLAHAGRKASTDAPWNGGGYVGPETNGWETVGPSPLAFPGLPAPRELTVSEIQEVVQQFAGAAVRADQAGFDVVEIHAAHGYLLHNFLSPISNKRTDSYGGSLENRARIVLEVIDAIRAVWPEEKPVFMRISTTDWVEENPQDDRESWTLSQSRQLALWASEHGVDLIDASSGGLDIVPIPHDRDYQTAKAADLHASTGVTVAAVGRIDDAQTAHNLVDSGDVNAVFLGRPLLKDPSWANQAALALGAEPRYVHQYDYVL

SEQ ID NO: 3325 - protein, 494 aa, Trichodesmium erythraeum
MASQKEETALVQAVKNSNFAQVSILVAQNINANAQALDGTTALMVAAEKGYTQIASLLLDKGANVNYTKKKFGATALMLAAAHGRSEIVEVLLSRGADVNAKNYDGASPLMVASMNGYLLVVNQLIAAGADVNVVDKDHDTALGLATAQGYQNVVQVLLDAGARIDESTLSVVAHSNHAKMREILLNYGVDVNTKNLQGKTWLIQAAEAGDLSTVKTLLKAGADVNFRDKDGETALILSADQGDLEIVKALLESGADVNIKSRSGGTALMAAAAEGNLVIVSTLLDANSDVNAQDLEGETALSFAIGENHTETVKILLEHQAEIITKNQAGDTPLFSAIFHGYTDVVSILLATIEKQNLTSLLNSKYLGETALTLAIWQKNREIINILLDVGVDINIPAQGGYTPMIKAVYQGDIETLKILLGREADINLRDDNQATALMWAAYQGHTEAVKLLIDSGANLTYKNTSGYTALMLAEFNGYQDIVRLLSNAKGEH

SEQ ID NO: 3326 - protein, 334 aa, Haemophilus influenzae
MKTLSEFIVERQAEYPNAKGELSGILSSIRLLAKIIHRDINKAGLTNILGQSGVENVQGESQMKLDLFAHNTMKAALMAREEVAGFASEEEESFIAFDTERGRNAKYIILTDPLDGSSNIDVNVSVGTIFSIYRRVSPIGTPVTLEDFLQPGNKQVAAGYIVYGSSTMLVYTTGNGVNGFTYDPSIGTFCLSHENMQMPKTGRIYSINEGQYLKFPQGVKKYIKYCQEEDKATNRPYASRYIGSLVADFHRNLLKGGIYIYPSATNYPNGKLRLLYEGNPIAFLAEQACGVATDGYRRILDIQPTELHQRVPLFVGSEDMVKKAQEMMEEFKEE

SEQ ID NO: 3327 - protein, 494 aa, Sinorhizobium meliloti
MTDRPTITTTAGAPVPDNQNSLTAGPRGGIMLQDYQLIEKLAHQNRERIPERVVHAKGWGAFGSLKITGDISQYTRAKCLQPGAETPMLARFSTVAGEQGAADHERDVRGFALKFYTDEGNWDLVGNNTPVFFIRDPYKFPDFIHTQKRHPKTNLRSATAMWDYWSLSPESLHQVTILMSDRGLPQTPMHMNGYGSHTYSFWNDAGERYWVKFHFKTQQGHKFFTNEEGEAVIGKTREGYQESLFYAIENGEFPRWTVQVQIMPELDVEKTPYNPFDLTKVWPHADYPPVEIGVLELNRNPENYFAEIENAAFSPSNIVPGIGFSPDKVLQARIFSYADAHRYRLGTHYEHIPVNQPRCPVHHYHRDGQMNTYGGIRTGNPDAYYEPNSFNGPAEQPLAKEPPLRIDGDMSRYDHRVGNDDYVQVRALFGLFDEGQKSRLFSNIAAAMGGVPGEIIERQLIHFARVHPEYEAGVRQALKTAHGYEADTISTAAE

SEQ ID NO: 3328 - protein, 461 aa, Unknown
  Magnetococcus sp. MC-1
MSSEKKSARGWLWLVVVFILFIVGVQAANNGMALGRITYEKLKVFTEVLDLVRTQYVEEADEEKLLYGAIGGMLETLDPHSSFLNPDSFKEMKVDTKGEFGGLGIEITRGEQAIKVVAPIADTPADRAGMKAGDLIIKIEDESTQDMNLMDAVKRMRGKPDTDIKLTVVREGEPKPLVFTLTRAIIKISSVKWRAEQNNLAYVRITSFNEQARPLLDKALDEIEAELKGNVRGLVLDLRNNPGGLLDQAVQVSDAFLNKGRIVYTKGRIPGKDLSFDARNGDLMEGAPIVVLVNGGSASASEIVAGALQDHKRAVIMGTQSFGKGSVQTILPLSDGSGVRLTTALYYTPSGRTIQAKGIVPDIVVEDLTLIKRKDRLERTKEKDLKGHFNNDGKRSMDDKEETTSTTEDSAKKGDTKSTEDEDDQAERDSVTGRSKDDYQLKRALDLLRGLQVFQTTAAQN

SEQ ID NO: 3329 - protein, 856 aa, Gloeobacter violaceus
MAVGFSLRVLVVAANGPLVHALEKTLLSGGYDLALRWAAGTASLHQALMSERPEMILAADGPGEIDALLLLRSLTVHNCCELPLVWIGDAPSTPEGGYLNGADLHLLVLTVERALHQAQQRRETGVARAALRRSEQRLDLFFSQSLDGFFFMMLDRPVRWDATVDKERTLDYVFAHQRLTRVNDALLAQYRASGEQLLGRTPADLFAHDLELGRRLWREFFDRGKLHVETDERRFDGSPMWVEGDYSCLYDEQGRITGHFGIQRDVTVRKLAQEALRTSEAALQEQLQRTLLLQRICEQIRSSLESRQIFQATVDQVGQALGVNCVRILVYSPTPKPELHFAAEYLEAGYPPVHHGSVPVAGDPHAQRVLECDRAVCSPDVYADPQLAPVHELCRSVGLKSLLAVRTSYQGKPNGVITVQQRDRFRRWTPEEIALLEAVAAQVGIALNQAKLLEQEKAQSLLLAEQNAALARARQAAEAASRTKNEFLATMSHEIRTPMNGVIGLADVLLADGGLTHRQRDSIETIRASGETLLTIINDILDFSKAESGCIELETKRFDLHALLAGCVDLLRPEATQKHLQLCCTLHGQVPQAVVGDAARLRQILVNLIGNAVKFTTSGAVSVNVTAARPAAEPPQKWELHFAVRDTGIGIPAERMDRLFKPFSQVDASTTRRYGGTGLGLAICKRLAELMDGRIWVESEPGRGSTFSFTIVAAAATDAPAPAPPVEASWSKPLPLRILLAEDNPLNQKVALQLLRRLGYRANVATDGEEVLRALRRQRYDLVLMDVQMPMIDGLEATRRIASEFAAAERPRIIALTAGATLQDEQACLRAGMDGFISKPIRIGELRRALERWGTG

SEQ ID NO: 3330 - protein, 1005 aa, Desulfovibrio vulgaris
MARRKDKQHRARMVQAESTIRTLRRERVLHDSQVEQLRRTGALYRSVFERIPVMVFVWRVARDVGASRLIDMNPLAKAYLENVPRNGDDGSPDLPESPDLLGSLLPWLVESPFGEALRRVHAEGGTLEIPALRHGAAGGGRFWRCIFCRLPLGDVIAISEDITAAQETGAALVTSERGYRTLVENIPDIVVRFDARGRLLFANPALRRFVRSKRLPSGHVTGQPLGQQPAMLRELRERVQLAMSSGEVQRAELEERTRQGRRFFEWRIVPEPAPDGGDATVLCIGRDVSAMRRATEDYRALFNGMLSAFALHEIICDGAGVPVDYRFLAVNPAFERMTGLLASEMVGRTARDVLPGLESEWLQRYGQVALTGVPVTFEAFNRDLGKYFKVSAYRPAERQFACMFHDVTDRVRGREERRSNARRMAALQRIFRMKEPEEVVARYALTQSMQLTGARVGRVVLHDPETRVIRHIVDHGDPLFGTEGWQWASVAHGGAGGDDTDGGAAGGRGPDEPEGIAGPRRVPPQPDAGHVAEPDRARLDDLMTRAAAGMGPLASELTHGRHGPHARHLAVPVRLDGRLGAVAVLLDKPTPFTRADIKQLDLLMRGMLEHLERRRSLHRLSLAKEHAESANRAKSEFLANMSHELRTPLNGMLGMLQLLEAGDLDRDQNELVHIALDSGRTLLRVLSDILDLSRIEAGRMELRHDRFSPEEAVRQVYDMFAQDARIRGLRLRWRCDELPCEVWGDGTRLRQILFNLLGNAMKFTHEGTVGVEVCAVRRTEESVRLLFSVSDTGIGIPHDRLMSIFEPFTQLDGSTTRRYSGTGLGLGIVRRLVHLMGGGLNVESALGEGTAVHVCLPFRLPSGGGVTCDVMDSTPALRRPLKVLVAEDEAVNRMTLSRCLHHLGHEAVCVTNGLEAVEALREGRFDCVLMDIQMPELDGLEALARIRAEAGEQARALPPVVALTAHAMEGDRERFLAAGMSAYIPKPIELGELERVLLRLAAAMP

SEQ ID NO: 3331 - protein, 338 aa, Methanocaldococcus jannaschii
MDFIVIDGSYLEGGGQIIRTAVSLSALTQKPVKIINIRKKRKNKGLAPQHVSAVKAVKKLCNAEVFGLNVGSEELTFIPSKLSPKDFTIDIGTAGSISLVIQTLLPLSLGINKKFTVKIKGGTDVKRAPPIDYVKNVTLKILRNFGVLTELKVLKRGFYPEGGGEVIFEVKPSKIKKFDLIEHSKSNLVEGISYVQNLDESIARRMRKKAVDLLNKEKLLPNIKIECSKGISTGAGIVLWNDTLGGSCLGEKGLRAEIVAERAVNELLKERESGMALDKYMGDQIIPFLAFGKGIVGVSEITNHTKTNMWVVKHFLDVDFEIKEYKENNCNGFTIEVV

SEQ ID NO: 3332 - protein, 423 aa, Gloeobacter violaceus
MEANLDKPNDARPVRLRRHAVWAAALASAALAGCSAEVLSSTAGPAPKEVLTETWTYINNEYVDPKFNGQDWWSVRQTYLEKPAETSEQVYEQIASMLKTLDDPYTRFLNPKQFKSLQTTTSGELSGVGLQITLDTESELPVVIAAVEGSPAFRGGVKARDLIVEIDGRPTKGQALDDVADRLRGKIGSQVNVGLRRGERTFDVTLTRETIQVNPVTSQLKRLDGRPIGYIRLSQFNGNAAQQVRQAIEKLEAQDAAGYILDLRSNPGGLLEAGVEIARYWLTPGQTVVYTVNRQGERDQARAQRAPLTARPLVVLIDGGSASASEILAGALQDNRRAQLVGTKSFGKGLIQAIHPLKDGSGLAVSIARYQTPSRRDIHKQGIEPDVKVELPKSFSLEQLATDADSQYQAGAKALSRALASSQ

SEQ ID NO: 3333 - protein, 756 aa, Prochlorococcus marinus
MTTSVALDWVVQDGQRLAECRHDDPFSLLGPQSHEGQWIVRIWMPEASQVELLCDGRTTAMTTPNHSWIFEAALNQNPGRTYQVRVKRAGIVHEQHDPWAFHDEWMGEMDRHLFAEGNHHHIWQRMGAHLMEREGVEGVMFCLWAPHACSVAVLGELNGWDGRHHPMQRRQGGLWELFIPGFKEGTLYKYEIRTQEGHCYQKADPYGFQHEVRPATSSVVARLDRYQWQDEQWMRQRDSRNALDQPISVYEMHLGSWIHAATDEPYIELDGTPRAPVPAADMKPGARLLTYPELADQLIPYVKDRGFTHIELMPISEHPFDGSWGYQVTGWYAPTSRFGSPDEFRAFVDRCHAEGLGVIIDWVPGHFPKDGHGLAFFDGTHLYEHSDPRIGEHKEWGTLIFNYSRNEVRNFLVANLVYWFEQFHIDGIRVDAVASMLYRDYLRPDGEWIANEDGGRENTEAVRFLQQANHVLFQHFPGALSIAEESTTWPMVTQPTDIGGLGFNLKWNMGWMHDMLDYFELDPWFRQFHQNNITFSIWYAYTENFMLALSHDEVVHGKSNLLHKMPGDDWQKFANVRALLAYMWTHPGKKTIFMGMEFGQRSEWNVWGDLQWELLKHDPHKGLQRLVDDLNTFYKGEPALWKDDFDQYGFQWIDCNDNRHSVISFMRRESSGGTWLVVVANFTPQSHSNYRIGVPMSGYYQEVFNTDSSCYGGRNLGNMGGKNTDEFNIHGYEQSLELCLPALSVLVFRHDPKRSL

SEQ ID NO: 3334 - protein, 367 aa, Vibrio fischeri
MKNALFQPMQLGNLTLKNRIVMPPMTRSRASQPGNVANDMMAKYYAQRASAGLIIAEGTQISEMGQGYAWTPGIYSQEQILGWKKVTDAVHAKGGTIFAQLWHVGRVTHPENIGGQQPISSSALKAENVKVFIDNGTDAPGFVDVVEPREMTQQDINDVIAEYRQAALNAIEAGFDGIELHAANGYLINQFIDSEANNRTDEYGGSIENRLRFLGEVVEAVNEAIGYDRVGVRLAPFTSLNGTVDKTPVETYTAAAALLNKHNVVYMHIAEVDWDNAPETPEEFKTAIREAYQGTIIYAGRYNTGKAAQALTDNLADLVGFGRPFIANPDLPNRIKNDYPLAEHDPNTLFGGTQQGLVDYPEYQEAH

SEQ ID NO: 3335 - protein, 468 aa, Idiomarina loihiensis
MREAIWFRSDLRILDNPAVFSACHGDEPPLAIFFVCHETWKSHDWAPIKVDFIWRNLECLQQDLAEKGIELQVQLVPKFSQVPGALRSFCRENKIARVHINAEYALDEKRRDAATNAVLSNDDIELVSHHGNLLVSPGEVRTQQGDYYKKFTPFNRRWRQVLSEKTYSEPLQIKSYSRVTAKGLPECPLGRKDSSDWSAGEQQVLGKLGQFVGHSVDDYQQARDLPAENGTSQLSAYLAQGVIGPQTAVRALHKFSPEFPFGLASGADTWLTELAWREFYQHLMYFVPRLSKGESFQSETDSIQWLEDDDAFQRWCDGRTGYPIVDAGMRQLTSTGWMHNRLRMITANFLVKDLLVDWRKGEAFFMQHLIDGSFPANNGGWQWSASVGTDAVPYFRVFNPVKQSEKFDPDGQYIRKWVEELKEVPTKYIHWPHSWLQQQSSNNYCDPMVEHKFARERFLTTFKQVKNG

SEQ ID NO: 3336 - protein, 471 aa, Rhodobacter sphaeroides
MMADAPLILWFRRDLRLADNPMLAEAAATGRPLIPLFILDPETEALGAAPKWRLGLGVEAFARALEGLGSRLVLRRGPALAVLEALVAETGAAGVHWSRLWEPDWRARDEGVKAGLRQAGIEAASHAGHTIFEPREVETGQGGFYRVYTPFWKAVKDRPVAASSPPPARLLSPAEWPVSERLACWDLGRAMHRGAAVVAPHLAVGEAAAAERLTRFLSGPLDRYAAERDRPDAPVTSRLSENLTYGEISARSLWHAGMRARAEGRAGAEKFLQELAWREFGWHLLYHTPEIARRNWRGDWDAFPWRGDNPDAERWRRGMTGEPFVDAAMRELFVTGTMHNRARLIAGSYLTKHLLTDWRVGQAWFEDCLIDWDPASNALGWQWVAGSGPDASPYFRIFNPATQAEKFDPESAYRQRFLAEIARRPGPEALAFFEAVPRSWGLRPDRCYPRPVVGLAEGRERALAAYGRRNN

SEQ ID NO: 3337 - protein, 310 aa, Triticum aestivum
MARHFLLNTGAKIPSVGLGTWQADPGVVGAAVYAAVKAGYRHIDCARVYGNEKEIGLALKKLFEEGVVKREDLFITSKLWNDHHAPEDVPEALNESLNDLQLDYLDLYLIHWPFRVKKGTNNNPENIVTPDIPATWAAMEKLHDAGKALAIGVSNFSSKKLGDLLDVARVPPAVNQVECHPCWQQTKLHNFCQSTGVHLSAYSPLGSPGTSWMNGNVLEEPIIISIAEKLRKTPGQVALLWNIQMGHGVLPKSTNPERIKQNLDVYDWTFPADMLAKFSEIKQARLLRGNMMINPQSVYKTYEELWDGEI

SEQ ID NO: 3338 - protein, 552 aa, Nostoc punctiforme
MAKPIEFNLFAPYNKGAALIGSFSDWQEIPMEKGNDGYFRTSVELKDGVYKYKFRVQSNSWFFEPEQWVDVTDPYATDIDELSGKDDSVIHVKDCERITDTYVWQNDDKPLPADHELVIYELHVGDFSGGEDDPYARGKYKHVIEKLDYLSELGINAIELMPLKEYPGDYSWGYNPRHFFATESSYGSTAELKKLIDECHGRGIRVIIDGIYNHSEASAPLTQIDHDYWYHHEPRDPDNNWGPEFNYEHYDEKLEIHPARKFIGETIRFWIQEYHLDGIRYDAARQIANYDFMHWIVQEAKNTAGAKPFYNVAEHIPETTSITNVDGPMDGCWHDSFYHCILEHICGDTFDLERLKDVIDCKRQGFLGATNVVNYLTNHDHNHIMVELGNREIFDEEAFRRAKLGVAILMTAVGVPLIWMGEEFGEYKPKQPESSKIDWTLLGNDLNRSLFESYKGLTNLRKSNHALYTENIDFIHENPEAKVLAYTRWNDEGSRVVVIANFSENFLAGYHVPNFPSAGTWHEWTGNYDVESGDDGIITDLGPYEAKVFVWQ

SEQ ID NO: 3339 - protein, 323 aa, Debaryomyces hansenii
MPSFNKSFVMNHTCLRIKDPKVSIPFYTENLGMKLIATLPFPDSKFTLYMLAYDNGDNNNDVSWSAREGVLELCHNHGVENDESYTLNNGNGEKFRGFGHICVSVDNIEAAEAQFLSKGVKFQKKLSDGRQKNIAFALDPNGYWIELIEHGQGKASDKTDSTHYKLNHTMIRVKDPKKSLDFYRNVLGMKLFSTSVHEGAKFTLYFLGYEHDASFKEDTLSRDEQSKKQGLIELTHNWGTESDNDFEGYHNGNSTENGAIQGYGHTCVSCSDPGKFCKEINEEFGEANIDWAVQWGKGGIKQLAFIRDPDGYSIEIINSVFKQ

SEQ ID NO: 3340 - protein, 700 aa, Zea mays
MSVSPSSLCGGDPAMRIVVWFRRDLRVEDNPALAAAARAGGEVVPAYVWSPEEEGPYYPGRVSRWWISQSLNHLDASLRRLGAGKLVTRRSADAAVALLQLVRDTGATHVYFNHLYDPISLVRDRRLKEMLAAEGIVVQSFNSDLLYEPWEVVDDEGQPFTMFDPFWNRCLSMPYDPPAPLLPPKRINSGDLSMCPSEDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVDESYFKIWRQGRTGYPLVDAGMRELWATGWLHDRIRVVVASFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPIVELDAAKGRLQAALSEMWQLEAASRATMNNGTEEGLGDSSEVLFPQELQMEVDRQPAPAEAAANVHVPVPMPARRRGDQMVPTMTTSSLNRAGTEVSADLVVANSEEEDTRAQVPFHAHLHPRAEAPPAARRTNNGARQHDVFQQPRNHRREALLAPSASEASSSWTGREGAVVPVWSPPAASGHSDAFAADEADVSSRSYLGRHPQSHRLMNWSQLSQSS

SEQ ID NO: 3341 - protein, 1046 aa, Methanosarcina barkeri
MNVSRKILAIIYIIFALLISVVIFASQSILGSTFSDLQEKEVTDNVEKVESMIELQILQLEKINSVLSSRDDVRNLMLNQDFQNLSSGTSLDDIFSISGCDFIFLVNNSGYIVYSDISDPEPSTNASALNASILNVSILNVSTLNASPLPKVRQRINDGSFLCKGAETSLKGLFMLKNDPAIISSQPVSAAPESKEISGTIILGKYLDSSFIESVQESTGSTFTLYSFNNASSDLLQAFFENPGPNFTYTVTGEHTTCYSVLEDLSGSPAIVIRADAGSNIYAEGQEALRYIVFFLLFAGLMIGASCKFLLDREVVSRIVAIDNFVEKVGMNENFSERYFMEGDDELSRLSKGINQTLDRLRTTSNEFKAQEHEKKLILDSLSELVVFMDSELKIIWLNKAALDHMGMKINDVIGRHYQDMYILYKENPGKSPVLKVLESGNEEFGEVVTQDGKIWTVTAIPIKNEDGRITGILKTGLDITAHRRSEEKLIQAKLEAEEANNSKSEFLANVSHELRTPLNSIIGFSDILIEKVFGELNEKQFRYVNNISTSGKHLLVLINDILDLSKVEAGKMELHYSEFSIDPVFEEVKAVLFPLIQAKPLEVTFNVEPDFTTLEADRGRLIQILYNLISNAIKFTPNGGKVSVYCKESGNRALISVIDTGIGISAEDQVKLFQPFTQLDASTSRQYCGTGLGLALVKKIVNLHQGDIWVESDPGKGSNFTFALPLRKPLERRKVSEIGIEDVTIEFEMNKAEALSVKENAENLQEEVKLPEICHSEKGDVKQELILVVDDDKSSSELHSTILKDAGYSVAILYSGKRVLEVAKNLKPDIITLDVFLPGTNGWLVLRQLKNDPYTTSIPVLIISMTNNNELGITLGATYSFAKPVNRIELVNSLREITGKFRFEYPKVLIVDDDENTVELLSSMIEPEGFETIKAYSGRECLQKLFFSEQQPDILILDLMMPEISGFDIISSMRADVHTKDIPLIVCTSGELTEKNLEELNSELERHLISILKKGTFGRKELINRIKQLAMLKRRNDEKNPDCRR

SEQ ID NO: 3342 - protein, 861 aa, Saccharophagus degradans
MTNSSTTHLAKNQRIRLINSTWAAGGGVLLSFVAYYSTTMGLFLGDKNVLIWVLVGFWLGNFAFIGTIASGLNKRFRDPALTLPQMYWAVSTTNIALMFTTQLDVLYYLLIMLTMVFGIFRLSVRQFNVFCYFAIAQLLLSLFVRYSLYASDAIGTLIINWVAFGFCAITLTALCNSIVRLRHRLKQKNEELSEALKAKSEFLANMSHEIRTPMNGVIGMLDVALLSETSPEKHRYLSVARNSAQSLLGIINDILDFSKVEAGKLELEAIDTDIDDLVHEVLVNFSGLAEQNDVELIADISPTISHLVKCDPGRIKQILNNLVGNALKFTPHGEVLVKARAEKLVSGRIQLHFLVRDTGIGIAAQNQKHLFDSFTQADTSTTRKYGGTGLGLSIAKRLCETMNGAISLESYEGKGSTFAFFIEVEASEERPPKAILPEYIRDFRVLVVDDNATSRAVITKYLEYLEVHVVAVENGKQALTRLANNTTFDAVIIDRQMPGMTGDTLAQQIRMQQNDERVPIIMLSNMKAEGASNLITELRLAAYITKPLRANQLYTALGFTFNSACYISENAPNSDTADTPTDTAPLPTITKPTNKERKKILLVEDNKTNQEVALLTLEILGYNADVANHGGEAIEILKQQSDSEQHYGAILMDCQMPVLDGYKTTETIRSDAALSAFKYIPIIALTANALRDDKEKCLAAGMNDFLSKPIDSAKLGATLAHWLHEEAQPEISPPPKKKSAVTEAEESLVWNRAELERLVGNNAQRAYKLISGFVASLVAMRTELEAHIDGKRYSDAANTLHGLKGAASNMRVNKLAEAAGNFEHALKYESTATIASSQEHFVEQLEIAVSHLSEYLETHEQ

SEQ ID NO: 3343 - protein, 1653 aa, Saccharophagus degradans
MNKSSFNYLTRNSKWLIPTFAAIVLLTLAIAVDRVIYSRFALEERTAVHNEASKLRASIESTINSNLQAVQGLVLVLNAFPEPSQEEFASFAAPLFNQNTQLRNIAAAPGMVIKYMHPLEGNEAAIGLDFRATPAQKEAAERAERTGQLVLAGPVNLKQGGQGFIGRIPVFTYNKQNNTKSSWGLLSTVIDLDRFYSATGITQFNETLQLALRGKDAKGAQGQVFYGDEALFHADAVLLEVSVPSGSWQLAILPKQGWANSAEDSALLRIILLLIILAILIPIIISVNLLANRHDSDLKFRGLFELSPVGIALNRFTDGKYVETNTALENMLGYSADELHGKTYLEITSPVYEDHQKAVINSLKNYGRYGPYEKEFIRRDGTLLPVIMNGMLVTDSNGEKLIWSIVEDITSRKQAELALAQNRKQLEQIIDSTSVAIWDWNIVTGEIVINERWAEIIGYSLMDLEPVSIDTWTNFTHPEDLDKSSELLNAHWNGESNHYQCEARMHHKDGHWVWVLDSGKVIEWTSEGKPLRMVGTHLDITEQKESQRLIEQSQIELKNFFDLSPNFMCIIDREGFFERINDTFLSQLDFTRDDFFSCKYIDFVHPDDREITQDHFEKMKSGALTQVFTNRYMHSNGDYLYLQWYTFADPASGMVYTTALDITNQKLDEKRMARQQEMLLSMSEQGRIGAWEVNLEEQQMYWSTMTKDIHEVDANYTPHYESAIDFYKEGESRDTISRLLNLAINKGIPASIELPIITAKHNERWVSVTVQPEFRNKQCIRLFGSIQDIDARKRIEQGVQLANTKLEKQMTLVNAIAAAQASFIQQTDIAIAFRNLLDGVLELAESEYGFVSEILYTEKNEPYIRTHAIANRSTHDRYNAFFAAQGENPIEFFNLDSLLGAAVTSCKPVIANSPTTDSRRAGVPDGHPQLESYLGIPIILNGSIIGLIGLANNPNGYNQALVDWLAPLINTVGQMIENTRAIRERDNAQQALVKAKNAAELAARTKSEFLAMMSHEIRTPLNGVLGMLNLVKRTQLEDKQRYQIDIAKSSAESLLNLINDILDFSKVDAGKLDLEVVDFNIITLLEDIAHAMAGRALERGNELIIDTTKLEFTYLSGDPSRLRQILVNLIGNAIKFTQNGEVTVTASLTKNTSGFNLNISVADTGIGIAEEKIPLLFSAFTQVDASTTRKYGGTGLGLAICKKLCALMGGDINITSQEGNGSEFSFQILVKNSVKNIDLPPLIEQKVDLNDKTIFIAESNPKNTAILENMISSKRCIAVSSLPDSNLNLPNEPIDVAFIDRKLLTSMESITPLKNKPNFANTQWLMLTAINQTKDIENYTAKGFDTYLTKPITQSGLTLSLKSLKLDSNQAESEQQQTSEKLTLPQSPQGEASQFAARILLVDDNTVNQDVAKMMLEDFGLIIDVANNGLEAIAALDACSIREPYSLILMDCQMPELDGYETTKRIRKGATDFDNTKIPIIAMTANAMKGDKEKCIAAGMDDYLSKPIEADALEHMLKLWLPLHNFSQDSNTQATSQHPQVVEGFWQHDELLATLKGREDRLKILVASFTKRIPALLEEFEEATASNDLEALSFIAHSVKGSAGQLKCNLLFVCASELELTAKNGDLTTALELSQNFKQYTLDFYNLLNKYLA

SEQ ID NO: 3344 - protein, 497 aa, Zea mays
AVVAAHNHTSDTITASHLPVPSIAKGHIGRPRARGKKDQVTDEQEGGIMAYAAGRKKRVGRYEVGRTIGQGTFAKVKFAVDADTGAPVAMKVLDKETIFAHRMLHQIKREISIMKIVRHPNIVRLNEVLAGKTKIYIILELVNGGELFDKIARYGKLRENEARKYFQQLIDAIDYCHSKGVYHRDLKPENMLLDSRGNLKVSDFGLSTLSQNGAGLLHTTCGTPNYVAPEVLGSNGYDGSAADIWSCGVILYVLMAGYLPFEENDLPSLYEKITAAKYSCPYWFSPGAKSLIQRILDPNPRTRITIEEIREDPWFEKNYVAIRCGEDENVSLDDVQAIFDNIEDKYVSDEVTHKDGGPLMMNAFEMIALSQGLDLSALFDRQQEFVKRQTRFVSRKPAKTVVATIEVVAESMGLKVHSRNYKVRLEGPASNRASQFAVVLEVFEVAPSLFMVDVRKVAGDTPEYHRFYENLCSKLCSIIWRPTEVSAKSTPLRTTTC

SEQ ID NO: 3345 - protein, 356 aa, Bdellovibrio bacteriovorus
MNNHALFQPFQFKGLTLKNRIVMAPMTRQKSPDGVPTEDVAKYYQRRAEGEVGLILSEGTVINRPASSNEKDVPHFHGEKSLHQWQAVIQAVHSAGGKMAPQIWHMGKMKPSSSGWLPKAAFEGPAEMTLEDIQNTINAYAQAALDAKNLGFDTVELHGAHGYLIDQFFWPGMNTRTDRFGGNTIAARNTFAVEVVKAVRAKVGADFPVILRLSQWKQQDYNAKVATTPKEMEEWLLPLSEAGVDIFHCSQRRFWEPEFADSDLNFAGWAKKITGKPTITVGSIGLSGGDFLNSFRGQGAEVGGLEELTRRLDRGDFDLVAVGRALLTDPQWVKKVKEARTNELKGFNPADLAVLT

SEQ ID NO: 3346 - protein, 554 aa, Desulfitobacterium hafniense
MTKFSMFCSKLIKANTKAGRILTASALALILTVSAPAAALGSPVDDVRSLLESQYVDPVDPWVLSASSVEEMLKRLDDPHTVFFTQKEYQNFLNSMDLSFSGIGVYIELEPRGLEIVGIIPGSPAEEAKLKTGDIIAQVGGQSLAGLSQDAATTLIKGPEGTTIDIVVLRGEERLSLKVARRAVEVPTVSGEMLNEDIGYVAIESFGETTEELFEQVIKELDKQGADAWVMDLRNNPGGYLDSALSLAGYFIGEQTALQTKDRSQKFEPYQAEKQEFIIAEPVIFLTNENSASASEILTAVVKDYQKAVVVGTNTYGKGSVQSLWQLTDGDVLKITVAKFYSPYGKEINGVGISPDVEILENDPLEMAVLMLAGSIQGNDDGQEVADLVQFTAGGKDWNISLEEARNPEYWSAYRELIQNNSFPGGFSWRHNSDWAAISQSEQDALWPLFYPGYHGMKELKDLAVDKTFTVRFTAPIDFKSVTENSFELIESESGKRMPVTFEQVDERSVKVIPQGLLEPEKTYWLLTHQGIAAKDGSILKEGALTVGTTGAGH

SEQ ID NO: 3347 - protein, 371 aa, Helianthus annuus
MAGVVKEFDSSHDMFKVREEPKVVFNNKDLSEEMMKIKEEPMLVFDEHEDFVGGEEAPKPIEGLRDGGPPPFLKKTFEMVDDPTTDSIISWSSSKNSFILWDPHKFSTDLLPQRFKHNNFSSFVRQLNTYRFKKIDPDRWEFANEFFQKGKKHLLRDIKRRTNQPQNTQKQEEIRKQEQQQCCGHQTNSTMETELKNLRKERITLKQEILKMKQQQENTEKHLEMVEERMLRMEFKQQQLLVFMSKAFRNPIFVKLLQHLVQKQKTGSVEMCKKRKLEQMLNTDDLDRFQEMWNMIEPDAYTVLSSDGSVSPPEDQNTSDKSGSNGSDYNSESFILWEKLMEDELIFGGEQSGKDQTETYLQEWEELIPKA

SEQ ID NO: 3348 - protein, 404 aa, Shewanella oneidensis
MRPIIKSNKLDTVCYDIRGPVHKEARRLEDEGHRILKLNIGNPAPFGFEAPEEIVRDVILNLPSAQGYCESKGLFSARKAIVQHYQAQGIYDVDIEDVYIGNGVSELIMMAMQGLLNTADEILIPSPDYPLWTAAANLAGGKAVHYRCDEEADWFPDLDDIKSKISSRTRGIVLINPNNPTGAVYSKELLLQVVELCREHNLILFADEIYDKILYDEAKHIPAASLSDDILTVTFNGLSKAYRAAGFRIGWMMLSGNLKAAKSYIEGLDMLASMRLCANVPNQHAIQTALGGYQSINELILPSGRLTVQRDTCYELLNQIPGVSVKKPKGALYAFPKLDMKKFNLRDDERLVLDLLRDKKILLVHGTAFNWPEPDHLRVVFLPYKEDLTKALTEFGNFLETYKQ

SEQ ID NO: 3349 - protein, 236 aa, Shigella flexneri
MGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGKIAKLDQGKRLGPDPDQFGG

SEQ ID NO: 3350 - protein, 621 aa, Listeria monocytogenes
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDDKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPGVFKSMLNNLARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLDLLDDHCAGKFDYSRKIWTVVIFMIWYDVYVADKYDFGK

SEQ ID NO: 3351 - protein, 216 aa, Triticum aestivum
MVAAAMQALFDQTDLSLSLSLVPAAAPALNKDDYLAICLAALAKSGQQVQGMEGQARVWRPAPAPAQELRFSCAVCGKAFASYQALGGHKSSHRKPPPTGERCVVVAQASAGTGSEASAAASSGGSSGGPHQCTVCGRGFATGQALGGHKRCHYWDGTSVSMSVSVSVSASSSVLRNFDLNLLPMPENVNAGLKRCAEEEEVQSPLPPRSSGFCCR

SEQ ID NO: 3352 - protein, 388 aa, Saccharomyces cerevisiae
MNCTLTDNTRAINVASNLGAPQQRTIFAKERISIPGYYEIIQFLGKGAYGTVCSVKFKGRSPAARIAVKKISNIFNKEILLKRAIRELKFMNFFKGHKNIVNLIDLEIVTSSPYDGLYCYQELIDYDLAKVIHSSVQLSEFHIKYFLYQILCGLKYIHSADVIHRDLKPGNILCTLNGCLKICDFGLARGIHAGFFKCHSTVQPHITNYVATRWYRAPELLLSNQPYSKSVDIWAVGCILAEFYARKPVFMGRDSMHQIFEIIKVLGTPDKDILIKFGTIKAWNLGKNSNNPVYKKIPWSNIFPFASHEAINLIESLLHWDSTHRLNVEQAISHPFLNEVRKPDDEPVCLQGPFDFTYESELNSMSKLRDYLVEEVKNFKTDLSSSSL

SEQ ID NO: 3353 - protein, 545 aa, Campylobacter jejuni
MAKEIIFSDEARNKLYEGVKKLNDAVKVTMGPRGRNVLIQKSFGAPSITKDGVSVAKEVELKDSLENMGASLVREVASKTADQAGDGTTTATVLAHAIFKEGLRNITAGANPIEVKRGMDKACEAIVAELKKLSREVKDKKEIAQVATISANSDEKIGNLIADAMEKVGKDGVITVEEPKSINDELNVVEGMQFDRGYLSPYFITNAEKMTVELSSPYILLFDKKITNLKDLLPVLEQIQKTGKPLLIIAEDIEGEALATLVVNKLRGVLNISAVKAPGFGDRRKAMLEDIAILTGGEVISEELGRTLESATIQDLGQASSVIIDKDNTTIVNGAGEKANIDARVNQIKAQIAETTSDYDREKLQERLAKLSGGVAVIKVGATTETEMKEKKDRVDDALSATKAAVEEGIVIGGGAALIKAKAKIKLDLQGDEAIGAAIVERALRAPLRQIAENAGFDAGVVVNSVENAKDENTGFDAAKGEYVNMLESGIIDPVKVERVALLNAVSVASMLLTTEATISEIKEDKPTMPDMSGMGGMGGMGGMM

SEQ ID NO: 3354 - protein, 159 aa, Glycine max
MDFRVMGLEPPLFHTLQHMMDMSEDAAGENKTYSAPTRSYVRDAKAMAATPADVKEYPNSYVFEIDMPGLKSGDIKVQVEDDNVLLISGERKRDEEKEGVKYLRMERRVGKFMRKFVLPENANTDAISAVCQDGVLSVTVQKLPPPEPKKPRTIEVKVF

SEQ ID NO: 3355 - protein, 1122 aa, Arabidopsis thaliana
MSGSRPTQSSEGSRRSRHSARIIAQTTVDAKLHADFEESGSSFDYSTSVRVTGPVVENQPPRSDKVTTTYLHHIQKGKLIQPFGCLLALDEKTFKVIAYSENASELLTMASHAVPSVGEHPVLGIGTDIRSLFTAPSASALQKALGFGDVSLLNPILVHCRTSAKPFYAIIHRVTGSIIIDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDATTQPQKRKRLWGLVVCHNTTPRFVPFPLRYACEFLAQVFAIHVNKEVELDNQMVEKNILRTQTLLCDMLMRDAPLGIVSQSPNIMDLVKCDGAALLYKDKIWKLGTTPSEFHLQEIASWLCEYHMDSTGLSTDSLHDAGFPRALSLGDSVCGMAAVRISSKDMIFWFRSHTAGEVRWGGAKHDPDDRDDARRMHPRSSFKAFLEVVKTRSLPWKDYEMDAIHSLQLILRNAFKDSETTDVNTKVIYSKLNDLKIDGIQELEAVTSEMVRLIETATVPILAVDSDGLVNGWNTKIAELTGLSVDEAIGKHFLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNNAVTSQDPDKVSFAFFTRGGKYVECLLCVSKKLDRKGVVTGVFCFLQLASHELQQALHVQRLAERTAVKRLKALAYIKRQIRNPLSGIMFTRKMIEGTELGPEQRRILQTSALCQKQLSKILDDSDLESIIEGCLDLEMKEFTLNEVLTASTSQVMMKSNGKSVRITNETGEEVMSDTLYGDSIRLQQVLADFMLMAVNFTPSGGQLTVSASLRKDQLGRSVHLANLEIRLTHTGAGIPEFLLNQMFGTEEDVSEEGLSLMVSRKLVKLMNGDVQYLRQAGKSSFIITAELAAANK

SEQ ID NO: 3356 - protein, 545 aa, Haemophilus influenzae
MAAKDVKFGNDARVKMLKGVNVLADAVKVTLGPKGRNVILDKSFGAPTITKDGVSVAREIELEDKFENMGAQMVKEVASKANDAAGDGTTTATVLAQAIVNEGLKAVAAGMNPMDLKRGIDKAVSAVVSELKNLSKPCETAKEIEQVGTISANSDSIVGQLISQAMEKVGKEGVITVEDGTGLEDELDVVEGMQFDRGYLSPYFINKPETATVELDNPYLLLVDKKISNIRELLPVLEGVAKAGKPLLIIAEDVEGEALATLVVNTMRGIVKVAAVKAPGFGDRRKAMLQDIAILTAGTVISEEIGMELEKATLEDLGQAKRVVINKDNTTIIDGIGDEAQIKGRVAQIRQQIEESTSDYDKEKLQERVAKLAGGVAVIKVGAATEVEMKEKKDRVDDALHATRAAVEEGIVAGGGVALVRAAAKVAASLKGDNEEQNVGIKLALRAMEAPLRQIVTNSGEEASVVASAVKNGEGNFGYNAGTEQYGDMIEMGILDPTKVTRSALQFAASVAGLMITTECMVTDLPKDDKADLGAAGMGGMGGMM

SEQ ID NO: 3357 - protein, 244 aa, Gossypium hirsutum
MVYPNESLEDSPQKKMGRGKIEIKRIENTTNRQVTFCKRRNGLLKKAYELSVLCDAEVALVAFSSRGRLYEYANNSVKATIERYKKASDSSNTGSVAEVNAQFYQQEADKLRNQIRNLQNANRHMLGESIGGLPMKELKSLESRLEKGISRIRSKKNELLFAEIEYMQKREIDLHNNNQLLRAKIAENERKQQSMNLMPGGSSANFEALHSQPYDSRNYFQVDALQPATNYYNPQLQQDQIALH

SEQ ID NO: 3358 - protein, 140 aa, Pediococcus pentosaceus
MANEMMNRRNDMWDPFFDRLSRGFFNNGWDGTSKTLKTDVSESDTDYKVKIDVPGIDKKDIKLDYQDGVLNVEVKKDSFADHEDEKHNVTMTERSYGIMRRSYELPRVKAEDIKAKVDNGVLSITLPKASGEKTSGIEIE

SEQ ID NO: 3359 - protein, 379 aa, Aspergillus nidulans
MDSSKLFTPLKVGNIQLAHRITLPPMTRFRVDEGHIPQDQVAEYYAQRAAVPGTLLITEATLISTRPGVYTHVPGLWSKEQIAQWRKVTDAVHAKGSFIYNQLWALGRVADPEATKKEHGGSEGRVIAPSAVPLDPSGEPPKEMSEEDIAGVIQDFATAAKNAIEAGFDGVEIHGANGYLVDQFIQKAANKRSDRWGGSVENRARFPLEVIRAVVDAIGAERTAIRYSPWSTFQGMGVDPDEEQIAQFAYLAKKTAEFKLAFVHLVEGRIAGNTETDENGGRNLHFFFDAYGRAGPIMVAGGYVGETAREAADVQYKDYDVMIAIGRPWTANPDLPFKVKKGIPLRPYEREHFYTVRSPKGYIDYDFSEEFKAATGTRL

SEQ ID NO: 3360 - protein, 270 aa, Helicobacter hepaticus
MQTLTLNNGVKMPILGLGTYSLTGKAGQKAMSEAIEVGYRLFDSAQMYNNEAELGAAINAAVKGGIKREEFFIQTKLLESSSEDLAKKSIEKSLKTLGLDYIDSLLIHMPYSQSKAMYRAMESFYKQGILRVIGISNFGAKAYSEFVKSCEVIPAINQCETHLLLQQKPLREAMKSKKTLLQSWSPFIAGKGSILENPTLKSIAQKYNKTPAQVVLRFLIEQGISVIPKTSKRARMQENLNVFDFSLSAQDTQILKELDTNKSAFSWTNY

SEQ ID NO: 3361 - protein, 441 aa, Triticum aestivum
  misc_feature (422)..(422): Xaa can be any naturally occurring amino acid
TPAGAPRSGERLVSAARDGDAVEARMLLELSPALARYSTFGGLNSPLHFAAAKGHLHAAALLLEKGADVNARNYCGQTALMHACRHGHWEVVQMLLLFRCNVTRADYLSGRTALHFAAHDGLVRCVRLLLADFIPSGPLEDTASSVADGGDSQTNSGSSPTSSLGLKFNEPARVRYINKPADGGVTALHMAALNGHFDCMQLLIELGANVSAVTFPYGTTSNLIGAGSTPLHYAAGGGSLECCQVLLSKGASRLTLNCNGWLPMDVARIFGRRCLEPLLSPNSHTIIPAIQPSSYLALPLMSILNIAREFGLQHTVSSVDESDLCAVCLERSCSVAAEGCGHEFCIKCALYLCSTSNVRVEFTGPAGSIPCPLCRNGIMSFTKLPSTPTEGLKSSSALTFCNPCILNTRSVDSPATVCKAEXIRPNRVAAPSSRVGRPLTC

SEQ ID NO: 3362 - protein, 118 aa, Brassica napus
  misc_feature (115)..(115): Xaa can be any naturally occurring amino acid
MKFCKKYEEYMQGQKEKKNLPGVGFKKLKKILKRCRRRDHQIASINHQHGNNCPRECTVCDGTFFPELLKEMEDVVGWFNENAQKLLELHLASRFKRCHTWLKGNNNRKRSHLGXIQE

SEQ ID NO: 3363 - protein, 279 aa, Ralstonia metallidurans
MHGSPLARSPSHLHRLSSASAFTPSAVAEGVFLELRPSGHLCHTDDPRRGEGHNPHRHHPDPVHHPVPARPPGGHRGVSGLLNVIATACKVIATAASRGALAGVLGSAEHENVQGEVQKKLDVISNAILVHATERGGHLVALASEEMDTIYPIPAAFPRGKYLLVFDPLDGSSNIDANISVGAIFSVLRSPDPEVPPTLEHFLQAGAGQVCAGYALYGPATMLVLTTGQGTHGFTLDRDVGEFILTHPMLRIPAATQEFAINTSRGLLVFSAISDGTQS

SEQ ID NO: 3364 - protein, 496 aa, Listeria innocua
MEQSPQNKEEKVEKPEEEKTKPGNGYIKMKLFPFIMLLFAFVFVTALVTTIVMSLGDDKQVKVSIPERKEFTKLYDVYDEISEKYYKDTKSTNMIDGAITGMVNSLDDPYSTFMSKKESAEFNDTISSSFEGIGAEIQEKDGAIVVVSPIKNSPAEKAGLRPQDIITQVDGKSVKGDTATEATKKIRGEKGTDVTLTIQRSNEDKPFDVTITRDEIPIETVYKEMGNDKIAHVTISTFSENTYDELEKALKALEKDGMKGLVIDLRGNPGGLLDQAVSISSLFVPDGKIVVQEQGKDGDKSAIKADSSSHGDYKVKVPTTMLIDGGSASASEILAAAAKESGGIKLVGNKSFGKGTVQTATTLSDDSTLKLTVAKWLTPNSEWIHEKGITPDVVVNMPSYATMTIPSSTKVYKNGDFGDDVKTIETLLKALDYNVGKVDGLYDIDTEYAVQRFQAANNLDVTGIMTGVTTDKLVELTQKHLKETDPQLQKAKALVK

SEQ ID NO: 3365 - protein, 505 aa, Schizosaccharomyces pombe
MFTDYPNDINCESPRMSDLDGFCQNAFSDLNSLNQQVFKANYAVRGALAILADEIQDDLLENPSSYPFSEIVYANIGNPQQMGQSPITFVRQVLSLCQYPTLLDHAEEKWFQNLFPTDVVQRSKMLLKESGSLGAYSASQGIPLVRRHVADFIRARDGFDCEPSDIYLTSGASHAARLIMTLIIARPTDGVMVPAPQYPLYGAQIDLMSGSMVSYSLSEENNWDIDFDQFKKSFDEASKKGINVRLCVVINPGNPTGACISENSMEKVLRFAKAKGIVLLADEVYQNNIYQNKFHSFRRKLGELREKEPDNHWDQVSLISVNSVSKGQFGECGQRGGYLDVVNIPEPAKDQILKLATIDICPPVAGQLLVDMLVNPPKPGDPSYDLFIKEVDEIHEALRLQCRQLYEGTKRMKRVSCLEPHGAMYLHPSVSLPEKLITTAKAQKIQPDEFYAIELLKRSGICVVPGSGFGQPEGDYHIRITFLAKGTEYIERFVKAHNEIMDLYE

SEQ ID NO: 3366 - protein, 365 aa, Ralstonia metallidurans
MPLSHRQTLTRYLIEERRRFPEASGELNALILDVALACKALARVVSFGELGDALSDGSAAPTGGGINVQGEVQKPLDVQSNEMFIRMNEWNGQLAGMASEEMEEPYLIPSSYPRGKYLLVFDPLDGSSNIDVNVSIGSIFSILRAPADVVASGRDVTEADFLQPGAAQVAAGYTIYGPTTQLVLTVGNGVAAFTLDPNLGEFLLTRSDIRVPEQTQEFAINSSNSRFWEPPVKRYVDECLAGKTGPRGKDFNMRWVASMVAEAHRILMRGGVFMYPRDTKDPAKPGRLRLLYEANPVAMLMEQAGGRASTGREPILGVSPTALHQRIGLIFGSKDEVERIERYHQEPASNEAAAPLFAERSLFRD

SEQ ID NO: 3367 - protein, 1283 aa, Haematonectria haematococca
MIDDAALAAAAEIVASIAPDSRLPNSIPVGVASQVQLPGRDTPAKRKLEIELQNLALRVGKLESQASATSTFPETPNEAIDTLFGGEDTSNTNVPVTTRPKPKVIHAQGSLHSPHLPSYQLTKEALEGLRDHVDDQSKLLDSQREELAGVNAQLLEQKQLQERALEVLEQERIATLERELWKHQKANEAFQKALREIGEIVTAVARGDLTMKVRMNTVEMDPEITTFKRTINAMMDQLQTFASEVSRVAREVGTEGLLGGQARIGGVDGTWKELTDNVREIASVTTAVAHGDLTKKIERPARGEILQLQQTINTMVDQLRTFASEVTRVARDVGTEGMLGGQADVGGVQGMWNDLTVNVNAMANNLTTQVRDIIKVTTAVAKGDLTQKVQADCRGEIFDLKSTINSMVDQLQQFAREVTKIAREVGTEGRLGGQATVHDVEGTWRDLTENVNGMAMNLTTQVREIAKVTTAVAKGDLTKKIGVEVKGEILELKNTINQMVDRLGTFAVEVSKVAREVGTDGTLGGQAQVANVEGKWKDLTENVNTMASNLTVQVRSISTVTQAIANGDMSQKIKVGANGEIQVLKETINNMVDRLSSFCYEVQRVAKDVGVDGKMGAQADVAGLDGRWKEITTDVNTMASNLTTQVRAFSDITNLATDGDFTKLVDVEASGEMDELKRKINQMISNLRDSIQRNTQAREAAELANKTKSEFLANMSHEIRTPMNGIIGMTQLTLDTDLTQYQREMLNIVNNLANSLLTIIDDILDLSKIEARRMVIEEIPYTLRGTVFDALKTLAVKANEKFLDLTYKVDSSVPDYVIGDSFRLRQIILNLVGNAIKFTEHGEVSLTIKERVEQRNVRPGEYAVEFIVEDTGIGIAKDKLDLIFDTFQQADGSMTRKFGGTGLGLSISKRVVNLMGGDLWVISEQGKGSEFHFTCLVKLAHDDAAMIEQQIRPYRGHQVLFVDKAQSKGGASIKGMLEQIGLHPVVVESEKSPALTRLQASGSLPYDAILVDSIDTARRLRAVDDFKYLPIVLLAPVVHVSLKSCLDLGITSYMTTPCKLIDLGNGMIPALENRATPSLADNTKSFEILLAEDNTVNQRLAVKILEKYHHVVTVVGNGWEAVEAVKRKKFDVILMDVQMPIMGGFEATGKIREYERGIGTHRTPIIALTAHAMMGDREKCIQAQMDEYLSKPLQQNHLIQTILKCATLGGPLLEKNRERELALHAEAKSSKHKEGGQGLLRPALESRSFTSREPLSGNGKESPALLSPDEDPMARVYMRSLSS

SEQ ID NO: 3368 - protein, 430 aa, Glycine max
MSEKEKGNNSEGQSTLLHGKYELGRVLGHGTFAKVYHARNLNTGQHVAMKVVGKEKVIKVGMMEQVKREISVMKMVKHQNIVELHEVMASKSKIYIAMELVRGGELFNKVSKGRLKEDVARLYFQQLISAVDFCHSRGVYHRDLKPENLLLDEHGNLKVSDFGLTAFSEHLKEDGLLHTTCGTPAYVSPEVIAKKGYDGAKADIWSCGVILYVLLAGFLPFQDDNLVAMYKKIYRGDFKCPPWFSLDARKLVTKLLDPNPNTRISISKVMESSWFKKPVPRKLAAEKVDLEEEKIESQLETINAFHIISLSEGFNLSPLFEDKRREEMRFATAGTPSTVISRLEEVAKAGKFDVRSSETKVRLQGQERGRKGKLAIAADIYAVTPSFMVVEVKKDNGDTLEYNQFCSKQLRPALKDIFWNSSQNSAPASA

SEQ ID NO: 3369 - protein, 236 aa, Oryza sativa
MGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGQQPAFN

SEQ ID NO: 3370 - protein, 366 aa, Cryptococcus neoformans
MTIDQSQINFNVPSTYKLEEIVGEGAYGLVVAGTHLPSGTQVAIKRITPFDHTMFCQRTLREIKLLRHFHHENIISILDLIQPESYEVFNEVYLVQELMETDLHRVIRSQELSDDHCQYFVYQTLRGLKALHSADVLHRDLKPSNLLLNANCDLKICDFGLARSSAKPPPGTSDGGQGFMTEYVATRWYRAPEVMLSFQEYTKAIDLWSVGCILAEMINGKPLFPGRDYHHQLSLILQVLGTPTMDDFNEITSQRSKDYLRALEFTRRQDFSAICPKAKPAAVDLLKQTLTFSPSKRITVEEALMHSYVEAYHDPHDEPNAEPLKPGFFDFEFHQEKLSRDQWKRMIYDEVQDPVPTILSQWTESH

SEQ ID NO: 3371 - protein, 399 aa, Magnaporthe grisea
MASTASAPGYVRFTGHRHLTQRLVLSTLTGKPVHISGIRSSSPTAPGLAPHEISFLRLLETVTNGSSIQISYTGTTMTYHPGLITGSVPGAGAAVNGDSIEFSLPETNRRGITYYLIPIAMLAPFSKAHVNICFSGPGVITAATELGDMSVDSFRLAILPLYGLFGIPPARIDILVRQRSCAGYGDRRGGGVVELRFASQVRLPKTLHMNRTPGRIRRIGGVAYSTGVSASNNKRMIHAARGVLNALTGEIKIGEAPPGKDDAKNKIGIGFGLSLVAESSVPGVVYSADVVSPARGGALPEDLGAQCAHQLLEAIAKGGCVSWAAARSVLTLMAMGSEDVGRLRIGKDVVDEDTIGLARDLRKFGASSWGLRAVDDDDTDDMLISVKGTGVGNVGRKIA

SEQ ID NO: 3372 - protein, 312 aa, Arabidopsis thaliana
MAQQGQGSMDPAALDDIIRRLLDYRNPKPGTKQAMLNESEIRQLCIVSREIFLQQPNLLELEAPIKICGDIHGQYSDLLRLFEYGGFPPTANYLFLGDYVDRGKQSLETICLLLAYKIKYPENFFLLRGNHECASINRIYGFYDECKRRFSVRLWKVFTDSFNCLPVAAVIDDKILCMHGAISPDLTNVEQIKNIKRPTDVPDSGLLCDLLWSDPSKDVKGWGMNDRGVSYTFGPDKVAEFLIKNDMDLICRAHQVVEDGYEFFADRQLVTIFSAPNYCGEFDNAGAMMSVDESLMCSFQILKPADRKPRFL

SEQ ID NO: 3373 - protein, 58 aa, Pisum sativum
MASMISSSAVTTVSRASTVQSAAVAPFGGLKSMTGFPVKKVNTDITSITSNGGRVKCM

SEQ ID NO: 3374 - protein, 1430 aa, Cryptococcus neoformans
MVPPARAHTHNTTNTKQAQLSSAYHELANELGTDNISVVGNYTLGRVIGQGTYGSVHLATHRLTGTRAAVKKVPKSFTPHLTRELHHHRRLHHPHIVHLHEIIATESHIWLVTELCSGGELFDYLVERGRILEGEARRLFGELTLAVGWLHMHGVVHRDLKLENVLLDGELRIKLGDLGFAREWQKGRLMDTYCGTTGYASPEMLACQKYLGVETDIWSLGIILYTLLCGGLPFDDDDERVMKELIQKGEYEEPDWLSQEARDLIRGMLQHDPSKRLSIREILTHPWFKMTIVDKVYPNGDVPSIPPSPNPTSPTAAGDDFFAESALRQQQQQQSRLTPHVAGRSPLSTHLPTTPRQNSGSSEAENGDSRTERKASNMQRLNSAEFSTTEKELEQLHLCTSRPAATATGSGAISPRSISSPSMRGKTLRTLPEGQVDVDETPAGLPPPLSLIDEHPHLPVALHSRTPSRTKRRSVSSTLSLERRLSHHSSHNSYITFPPEDYLSKLDPSLLPNPDSSSSSTTTPPARSFTTPSETRLLRQLDDLGLDVGQLKHSVETDACDASAGLWWLLRQKQEERGETDEVVRRREKEVVRREEKVAEYAKEERRKAREAERERERIPTSPMGILGTRPGKRDSIEKSSEGLRFKEEQPPSIPTTPSYTSVIDLGPPVLPVDVDVDVERTAVGRDAPREAAGEEMKSWKRVESPQSVAISSQSSLDPAPTLPPPAAAGGGGAAGAKTQKEDGRDQAGLDPVAVATPMSNANSSTGASTVAKPEPNVNASANANTSANPRLKAKSPSMNMLQRATSVLGGVGKKGDDKDKDKNGMNEKREESTNDSLHPKRGGSSSPNKLKKPMPAGMKGLTSTLSRSESESEGLLAGGGGGGGGGDSPAVSASGSKTVTPGSSPRRKGLTPQGTPRGGLRDAGAKDSSGERASGNGNGNAGGGNEKGKGGKKDSLWTTFRHLFYEDRRRRKRESVTPSASSPLLLPPSDIKLPAGAVVLSRGANSRTSQFKRSNVGYAPSTGSRRTSLDGNRPVYSRRSSSVHTTSRRSSVGSLHFQDHQAMISDLSRRASQRSHGSQTPTSDREYLDYPSAAAPISRPGSSHSIRGGVGGGSRRSSFSVRSPSLHPETFSASAGGPTSTRFKSSVPPPASPLLGYRRRPAGGNDSSRVRHIKVIPESQIMRSSSVASSIRSNASSRASSMDRDRDRDRESEYESGRDDVSLRSGKRQKRRSGSQRSLAQQIHRTRSPLALSLENTYGSNSVANVGLGIGGASRIPKKPLRDVFQKKGKRKDGGDDDWVSEDEDGFACGLGQGRGIAKSFSNANANGTVWMNVNAKTNPARSAAAFPTSKMVAQPTAQGGTSRRRERGRRSSLEEERGRPQEGKGKAKGETAAQGLMGIESLSGRSRRNLPDRSTAPGIIEEEEEDEE

SEQ ID NO: 3375 - protein, 134 aa, Brassica napus
  misc_feature (122)..(122): Xaa can be any naturally occurring amino acid
  misc_feature (130)..(130): Xaa can be any naturally occurring amino acid
MVLSHAASDSDVSVHSTFASRYVRTSLPRFKMPENSIPKEAAYQIINDELMLDGNPRLNLASFVTTWMEPECDKLIMSSINKNYVDMDEYPVTTELQNRCVNMIAHLFNAPLGETETAVGVXGTVGSSEXIMLA

SEQ ID NO: 3376 - protein, 357 aa, Helicobacter hepaticus
MQEHKELLERREFLKTSAKFGAAVSLASLSGFALSACDSKEDLKTDSTQNLQSTEKAGKSQIQNHLQGDTMEFITLNNGVKMPILGYGVYQIDPKETQRCVEDAISVGYRSIDTAQAYFNEAEVGAAIKTALQGGLKREELFITTKLWIDNYPEEKALKACEESLRKLGLEYVDLMLLHQPYNDTYGAWRALSRFYKEGRFKAIGVSNFYPDRIMDFYLNNEIKPMINQIELHPFYQKQAEQKVNTELDIVTQSWASFAEGKNGLFTNEILRNIGEKYNKSAAQVVLRWLIQRQIVVIPKTTRKERMIENFNVFDFSLSGEDMQKIATIDTGKTLFLDHHDPQSAKFLFDYTKIHKA

SEQ ID NO: 3377 - protein, 544 aa, Methylobacillus flagellatus
MAAKQVIFGDDARAKIVNGVNILANAVKVTLGPKGRNVVLERSFGSPTVTKDGVSVAKEIELSDKLENMGAQLVKEVASKTNDNAGDGTTTATVLAQAIVREGFKYVAAGFNPTDLKRGIDKAVAEIVNEIKAIAKPTTTSKEIAQVGSISANSDADIGQIIADAMDKVGKEGVITVEDGSGLQNELDVVEGMQFDRGYLSPYFINNPERQIALLENPFVLLYDKKISNIRDLLPTLEQVAKAGRPLLIIAEDVEGEALATLVVNNIRGILKAVAVKAPGFGDRRKAMLEDIAILTGGTVIAEEVGLSLEKVTLENLGQAKRVEIGKENTTIIDGAGSENNIKVRIDQIKKQIEDATSDYDREKLQERVAKLAGGVAVIKVGAATETEMKEKKARVEDALHATRAAVEEGIVPGGGVALLRARSSIKELKGDNPDQDAGIKIVLRAIEEPLRQIVANAGDEPSVVVNKVLEGTGNYGYNASNGTYGDLVELGVLDPAKVTRSALQNAASVASLILTTDALVAELPKEEAAPAMPDAGGMGGMGF

SEQ ID NO: 3378 - protein, 581 aa, Streptomyces coelicolor
MQFEVWAPQAGRVTLRCDGATRALERDPERPGWWCGEAPARDGSRYGFAVDDGPVLPDPRSRRQPDGPDGLSAVVDHGRYAWRTPWAGRPLPGGVLYELHVGTYTPEGTLDAAADRLEHLVRLGVTHVELMPLCPFPGRHGWGYEGVSLWAVHEPYGGPEALKRFVDRAHDLGLGVVLDVVHNHLGPSGNHLPAFGPYFTDTHHTPWGVAVNLDAPGSDEVRAYLVDSALAWLRDYRLDGLRLDAVHALADTRACHFLEQLSTAVDGLAADLERPLFLIAESDLNDPRIITPRAEGGLGVHAQWNDDFHHALHAALTGESQGYYADFARDPLAALAKTLIRGYFHDGTYSSFRGRSHGRALDRGRVAAHRLTGYSQTHDQVGNRAQGDRLASLVSPGLAACAATLTLTAPFTPMLFMGEEWAAGTPWQFFTDHTDPQLAQAVRQGRRREFAAHGWREEDVPDPQDPATRERSCLDWSEPEREPHARVLDWYRRLIALRAEQPDLTDPDLADTRVAYDGTGRWLAFRRGDIRVAVNLGTEPAAIPLGNRPARVLAAWEPVEGPGANGILRVPGESSVVLVQE

SEQ ID NO: 3379 - protein, 368 aa, Methylobacillus flagellatus
MADLFSPYKLKDVELRNRIAVPPMCQYMATNGLANDWHRAHYASLARGGSGLVIVEATAVAPEGRITPHCLGLWNDAQAEQLRSIAAAIKAAGAVPGIQIAHAGRKASANVPWEGDDHIPEGDARGWQPIAPSAKAFGGLLPRVPTEMTIADIQRVQQNFVDAARRALEAGFEWLELHFAHGYLAQSFTSTHSNLRTDAYGGTLENRGRFTRETLAAVRQTWPEHLPLTARFGVLEFDGQDEQTLSESIQLVNEWKQLGLDMLSVSIGFSTPEAKIPWGPAFLAPIAQRVRNEAGIPVSSAWGFGAPDLADQAIRNEQLDIAMIGRAHLENPHWTYQAAKELNKKDPAWVLPPPYAHWLARYHDPRQR

SEQ ID NO: 3380 - protein, 323 aa, Zea mays
MSYMRKKKKKKKKKLEAAGTHLLSPACARLSSFLPRPLAFAWLHRAGRAGEEKLASSYQLSAGGGSLPAAGVSCKGWELAMGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELEQLEKQLDSSLRHIRSTRTQHMLDQLTDLQRREQMLCEANKCLRRKLEETSNQVHGQVWEHGANLLGYERHSPQQQAPSHVGNGLFFHPLEAAAEPTLQIGFAPEHMNNFMPTWLP

SEQ ID NO: 3381 - protein, 237 aa, Oryza sativa
MVMNPDAVRNVVGIIGNLISFGLFLSPLPTFVTIVKKKDVEEFVPDPYLATFLNCALWVFYGLPFIHPNSILVVTINGTGLLIEIAYLAIYFAYAPKPKRCRMLGVLTVELVFLAAVAAGVLLGAHTYDKRSLIVGTLCVFFGTLMYAAPLTIMKQVIATKSVEYMPFTLSLVSFINGICWTIYAFIRFDILITIPNGMGTLLGAAQLILYFCYYDGSTAKNKGALELPKDGDSSAV

SEQ ID NO: 3382 - protein, 371 aa, Ralstonia metallidurans
MPHLFDPYRIGNLELANRIAIAPMCQYSAQEGNATDWHMIHLGQMALSGAGLLIIEATAVSPEGRITPTDLGLYNDANEAALGRVLGAVRNHSPIAVTIQLAHAGRKASSEAPWDGGGQIRPDQPRGWQTFAPSAVPHAAGEVPPAALDKAGMKKIRDDFVAAAKRAARLGIEGIEVHGAHGYLLHQFLSPIANHRTDEYGGSLENRMRFPLEVFDAVREAFPAERPVWMRVSATDWVPNGWDIEGTIALSHELKARGSAAVHVSTGGVSPQQAIKIGPGYQVPYAQRVKAEVGLPTMAVGLITEAEQAEAIIANNEADIISIARAMLYDPRWPWHAAAKLGASVNAPKQYWRSQPRGLEKLFKDAHFGQR

SEQ ID NO: 3383 - protein, 375 aa, Trichodesmium erythraeum
MNQLKILEPFTLGDLQLPNRIVMAPLTRRRADINNAPTPLNALYYSQRSSAGLIISEASQISPQGTSLPKTPGIYSQKQIEGWQLVTKAVHNSGGRIFIQLWHGGRCSHPSLQPNGELPVAPSARAPIEEKALTAQEKEVPFVNPRSLLTTEIPEIIAQYRQGAINALEAGADGVEIHGANGYLLDQFLQDNSNQRTDKYGGSIENRSRLLLEVTQAVTEVWGSQRVGIRLSPSSTYQDMYDSNPEALFNYIVSKIDQFNLAYLHIVEPRIKGSHDDLTEKKLQLGVKHFRPLYSGNLMTAGGYTRDLGEEIISQGYTDLVAYGRLFIANPDLPKRFALNAPLNPYYRPTFTGGNEIGYTDYPFLSIDTLAKNII

SEQ ID NO: 3384 - protein, 251 aa, Triticum aestivum
AYLGDTIEQVCTKKQAGTGPEFPGYRRPTRPRIRKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEFEISEFLRRFGWIVPAYTMPPDAQHVTVLRVVIREDFSRTFAERLVIDIEKVLHELDALPSRSSGPALQHPNGDTVSEKDLARQREVVSVWKRAVAARKKTQGVC

SEQ ID NO: 3385 - protein, 311 aa, Brassica napus
GPDSRVDPRVRVGIPQDYRHMEGFGVHTYTLVSKSGKVLFAKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPIPTKSYTGIRTKCIIKKENNFKQPGDRYRSWAPDRQDRFVKRWVEILSEPRLTHEIRSIWISYWSQADRSLGQKLASRLNVRPSI

SEQ ID NO: 3386 - protein, 412 aa, Streptococcus pyogenes
MEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 3387 - protein, 589 aa, Unknown
  Bradyrhizobium sp. BTAi1
MSGRQFGPRLSEHGTSFRLWAPAARRVDLVLDDGRREMQRRDGGWYALDAPGIGAGTRYKFRIDDELDVPDPGSDFQPEDVSGPSEVIDHCAYVWRAKDWRGRPWQDAVFLESHVGTFTEEGTYRAMIDKLDHLVETGITALELMPLADFAGRRNWGYDGVLLYAPDSVYGRPDDLRALIDEAHLRGLMVFLDVVYNHFGPEGNYIARYAPTFFTDTHTPWGSAIDYRRPEVRAFAIENALHWLTDYRFDGLRFDAVNHILSNEGEIPMLHELSAAVGRLVAQTGRHIHLVLENGDNRASMLDAAEEPPRGKFRAQWNDDYHHVWHVMLTGETTGYYGDYQDNPRGGLARALASGFVYQGEQAAFWGGIRRGEPSGHLAPGAFVNFLQNHDQIGNRVFGDRLEALAPPEGIAAALAVTLLAPTVPMLYMGEEWGSKQPFPFFCDFQGDLAHAVRKGRRKEYEWAYAKYGDEVPDPLDVETFRSAIIDWDARNEPPGRERLALVRDLLAVRHSKVAPLLPGATFGAADVTDEGRLTAHWTMGDGSQLRLLANVSDKEIAGPSNDVNGTPIWGGTPGDRLPPWSVYWSIGG

SEQ ID NO: 3388 - protein, 712 aa, Unknown
  Bradyrhizobium sp. BTAi1
MTHLSPEAFAIIEGRHADPFRYLGQHDVDGRTVIRAFLPEASRVEAVGDNGEVAPLARIHDAGLFTGTMSGPQRYRLRATFGDHVTDLEDPYRFLPILTDFDLHLLGEGNHERLYDKLGAHPMVLDGVDGVGFVVLAPNARRVSVVGDFNFWNARRHPMRVRGNGYWELFIPRAKAGDHYKFDIIGPQGEHLPLKSDPMAFAAEMRPKTASIVVDETRLPRPRPAPSDINKLDRPVSIYEVHLGSWRRKDNNQWLTYRELAEQLPAYARDMGFTHIEFLPVSEHPFDGSWGYQPTGLFAPTSRFGSPEDFCALVDACHREGLAVWLDWVPGHFPDDPHGLGHFDGTALYEHANPMQGRHLDWGTLIYNYGRTEVANFLRSNALFWLERYGIDGLRVDAVASMLYLDYSRPSGGWIPNKYGGRENLEAIEFLRRTNIEVFGHFPQATTAAEESTAWPQVSRPVDIGGLGFGYKWNMGWMHDTLRYVGKDPIHRKYHHGEILFGLHYAFSENFILPLSHDEVVHGKRSILGRMPGDDWQRFANLRAYYSFMFGHPGKKLLFMGCEIAQEREWNHDSSLDWHLLGDAKYAGIQALIRDLNHLYRNQPALHERDCEPEGFDWLITEDADRNVFAWVRKGFDERARCVVVVNFSPNVYYNYRVRVPLGGTWREVFNSDSSHYGGSNVGNVGQVHASEDQQLNLILPPMAAVFLVPEA

SEQ ID NO: 3389 - protein, 220 aa, Glycine max
GAVHGVPSIEKITFHLLRLEDGEILDKKVFSNDFVNLTHNMGVFLYDDLLAIVSLRYQTIHILQIRDSGNLVDVRAIGEFCREDDELFLNSNAQLQLPGNHIENHMHQGQPNLGNSFLSGIKQRLLSFIFQGLWNEERDDTLRIQRLRKKFYFHFQDYVDLIIWKVQFLDRHHLLIKFGSVDGGVSRNADHHPAFVAVYNMDTTEIVSFYQNSADELYLL

SEQ ID NO: 3390 - protein, 479 aa, Prochlorococcus marinus
MALHRSNPRSNDLEEHAIGETVDALVSPLPRTTFPQEYRPALTTFNLLKEELLLDGNSKQNLATFCQTYESQQVAELMALAVDKNLIDKDEYPQTAEIERRCVSMMADLWHAPGEAVGCSTIGSSEAAMLGGLAAKWRWREHRKAAGQSIDRPNMVCGSVQICWTKFARYWDVELREVEMTSGELCMSPERMLEQVDENTIVVVPTLGVTYHGLYEDVQAVSQALDELQQRKGLDIPIHVDAASGGFLAPFCAPDLAPWDFRLPRVKSINSSGHKFGLAPLGVGWVLWRESRDLPEGLVFHVSYLGGDMPTFQINFSRPAGQVISQYYDFVRLGRDGYQAIHGASYANAQYVAQELKKLGPFELINDGNPAGGIPTVVWTLRADQELGFNLYDLSDRLRLRGWQVPAYPFTGELAHQAFQRILVKRDFSREMADLLLTDIRNAITHFESHPVKISLNANEAASTNHLGRSMVECRDAHG

SEQ ID NO: 3391 - protein, 887 aa, Methanosarcina acetivorans
MKKSNELIFILVLGFIFTLVASNYNLFESVVLFVEEYNLDGLGLLLILSIYTSFGMGIFSLGRWMELENTLTLYRKAEEDLREKDQMYRALFEMSNDAVIISDGKKVLDINNKGCEIFGFREERPLNVSLISFIPPEYLSELQQALKETFKQASSCFEMRYQKAEGEIVDIEVSLSLIDRNNNIIHIVAQDITGVKNAERLEQENRERFKTVLDNTLCSILLIEASSRKIVDANPVALKTTGYSEKELIGMVCSRLICQAGEERCNVPSLDPAGELSESILFKAGGDKISILRNVVPVSIGGNGYFVESFIDLSERKKVEEELLQAKLAAEGANRAMSEFLATMSHELRTPLTAIIGFSELMLGEATGEFDELNRKFLGHISNSGKHLLSLINSVIDLSRIEAGKMDLEPDFFSLYDIFADTKSISSPLALKKNISMDFNVESDFLIYADRTRFKQIMYNLVSNAIKFTPAGGSVEVVGRRSENRIRVTVSDTGIGISQDEIKHLFKPFKQINFALSREYESTGLGLVLSKNFVEMHGGRIWVESEPGKGSTFTFEVPVEILNSGEKMKIPEICGINGANNFEIPAETGEAGNSEIGSQTEKSEEKDFVEIFEPEGSDGSEPLVMIVEDDKLSRELLIFTLKEAGYRVVRALSGKQALSLAQKLNPFVITLDLMLPEMNGWDVLKNLKKDSETAGIPILLLSIDERDECNMVWGAFDHLVKPVEKSILLSTLERLNKKTKKGSPKILIADDQEDMVELMVSLVKEEGYIISRAYGGKEAIDKALTELPDAIILDLMMPEVSGFEVIRTLKKDPETVDIPVIVCTARDLSAEETELLNSNVSVVMQKEDLNKQILMQLIRSLESREEGCRTCILSAPREDRSFCKAEE

SEQ ID NO: 3392 - protein, 540 aa, Streptococcus agalactiae
MAKDIKFSADARSAMVRGVDILADTVKVTLGPKGRNVVLEKAFGSPLITNDGVTIAKEIELEDHFENMGAKLVSEVASKTNDIAGDGTTTATVLTQAIVREGLKNVTAGANPIGIRRGIETAVSAAVEELKEIAQPVSGKEAIAQVAAVSSRSEKVGEYISEAMGRVGNDGVITIEESRGMETELEVVEGMQFDRGYLSQYMVTDNEKMVSELENPYILITDKKISNIQEILPLLEEVLKTNRPLLIIADDVDGEALPTLVLNKIRGTFNVVAVKAPGFGDRRKAMLEDIAILTGGTVVTEDLGLDLKDATMQVLGQSAKVTVDKDSTVIVEGAGDSSAIANRVAIIKSQMEATTSDFDREKLQERLAKLAGGVAVIKVGAATETELKEMKLRIEDALNATRAAVEEGIVSGGGTALVNVIEKVAALKLNGDEETGRNIVLRALEEPVRQIAYNAGYEGSVIIERLKQSEIGTGFNAANGEWVDMVTTGIIDPVKVTRSALQNAASVASLILTTEAVVANKPEPEAPTAPAMDPSMMGGF

SEQ ID NO: 3393 - protein, 433 aa, Cytophaga hutchinsonii
MNEVVVFWFRRDLRLTDNAGLFQALTSGYAVLPVFIFDINILNALEHKNDARVEFIHDTIQSLKNELQKIHSDMEVYHATPAEAFEQLVKKYTVKAIYTNTDYEPAAIKRDNEISDWAAQQQIAFKSFKDQVIFEKNEILTDTGAPYRVYTPYKNKWLKKLTENPVTHSPSEKHTDAFLRMEAKPIVTLKQLGFTPSSIQIPPLETLRKTIQEYDKTRDYPYLEHGTSLLGIHFRFGTISIREKVVKALPLNATWLSELIWREFFMQLLFHFPHVVTESFQSKFNRLEWRYSQADFEKWCTGKTGYPLVDAGMRELNTTGHMHNRVRMVVASFLTKHLFIDWRWGEAYFAQKLLDYDLSANNGNWQWAAGTGADAQPYFRIFNPISQQEKFDPDFIYIKKWVPEFGTSSYIEPIIEHKKATERAKLLFSVLKN

SEQ ID NO: 3394 - protein, 339 aa, Glycine max
MDHSADAQRTDLMTITRFVLNQQSNHPESRGDFSILLSHIVLGCKFLCSAVNKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 3395 - protein, 372 aa, Unknown
  Burkholderia sp. 383
MSSLLSNFDLNGLILPNRVVMGPMTRSRAPYRGQPTELMAEYYAQRASAGLIVSEATNVSPVSASFELTPGLITDEQVAGWKKVTEAVHAKGGRIFAQLWHGGRVSSLTLLGGQAPLSPSGVNDDLEQLQVWAQLQNGYYTKIHATPSRAMTTDEVVKTIDEFRQSAAHARSAGFDGVEIHAANGYLPHQFLSSTLNRRDDRYGGTLANRVRFLEEIIAAVGGEIPLSRVGVRISPYAKYNNVRDTDPDATYAYVGRMLDEAGVAYVHAADTNGWSGEPDLPRIIEIVRKSFGGALIVNGGISPDVATKLIMSGDADLVAFARAYIANPDLVERIANKAPLAAPQAVGWYGGDRTGYVDYGRHDATGHTTGE

SEQ ID NO: 3396 - protein, 225 aa, Arabidopsis thaliana
MLSKLPTQRHLHLSPSSPSMETVGRPRGRPRGSKNKPKAPIFVTIDPPMSPYILEVPSGNDVVEALNRFCRGKAIGFCVLSGSGSVADVTLRQPSPAAPGSTITFHGKFDLLSVSATFLPPLPPTSLSPPVSNFFTVSLAGPQGKVIGGFVAGPLVAAGTVYFVATSFKNPSYHRLPATEEEQRNSAEGEEEGQSPPVSGGGGESMYVGGSDVIWDPNAKAPSPY

SEQ ID NO: 3397 - protein, 156 aa, Ananas comosus
MSLVRRSNIFDPFSLDLWEPFEGFPFGGALSFPRPSASFPAETASFAGARIDWKETPEAHVFKADLPGVKKEEVKVEVEEGNVLQISGERTREKEEKNDTWHRVERSSGKFLRRFRLPDNAKVDQVKAAMENGVLTVTVPKEDVKKPQVKSVQISG

SEQ ID NO: 3398 - protein, 716 aa, Pseudomonas syringae
MASKKAPPATDTSKSQMAGTDTPDRGNTNAKLESLEQFRSDATGQALRTNHGVKISDNQNTLKVGSRGPSLLEDFIMREKITHFDHERIPERIVHARGTAAHGYFQTYENHGALSKAGFLRDPAEKTPVFVRFSTVQGPRGSGDTVRDVRGFAVKFYTGEGNFDLVGNNMPIFFIQDAIKFPDFVHAVKPEPHNEIPTGGSAHDTFWDFVSLVPESAHMVLWTMSDRAIPKSLRTMQGFGIHTFRLINTEGKSSFVKFHWKPKFGVCSLVWDEAQKLAGKDTDFHRRDLWESIEMGDYPEWELGVQIVAEEDEHKFDFDLLDPTKIIPEELVPVTPLGKMVLNRNPDNYFAETEQVAFCPGHIVPGIDFSNDPLLQGRLFSYTDTQISRLGGPNFHEIPINRPIAPNNNGQRDAQHRTTIDKGRASYEPNSIDGGWPKETPAAAVDGGFETYPERVEAHKVRERSESFGDHFSQATLFFQSMSHHEKEHIIAAYSFELGKVEREYIRARQVNEILANIDLELASRVAANLGLPAPTAGTVPVRNTSVKESPALSQVNLLSGDIVSRKVAILVANGVDGKAVEAMKKELTAKGAHAKVLGPTSAPVKTADGASLPVDASAEGLPSVAFDAVFVPGGKDSVKALSTDGVALHFILEAYKHLKAISVAGEAKELLTLLRLEEDAGLLVVSDSKSFETFFNAIAQHRVWDREVKAKAVPA

SEQ ID NO: 3399 - protein, 651 aa, Psychrobacter arcticus
MCGVNGFFNAHTTIPVQNVIAQMNAAIDHRGPDAGDAWLDENIGLVLGHQRLAIQDLSPAGAQPMHSACGRYVLAFNGEIYNHLQLREQLMIEGHAPAWRGHSDTETMLACFVAWGIEKTLQAMVGMFAIVLWDRQQKVLTLARDRMGEKPLYWGWQGQSLYFSSELKGLKAHPSFKTDINRDAITLLLRHNCIPAPYSIYQGIEKLRPGHWVQLPLSDIQQAKTAQSKAYWRFNDIVEAGLADPFTGSPEQAVDALESALMQSIGGQMQSDVPLGAFLSGGIDSSTVVALMQAQSSRPVKTFTIGFDDAGYNEATHAKAIAKHIGTEHTEMYMRPEDALAVIPKLSSIYCEPFSDSSQIPTFLVNQLAHQHVTVALSGDGGDELFGGYNRYLMAQQVWSKSRKLPRPMRQLAAVSLTALSPKSWDTLVNTLSPVIPKRLNLRTPGDKAHKLAGVLNIDSEQAFYQNLTSHWQDPAQLVIGAQEPATLISDSSCWPTTDSFQHAMMAMDAQTYMTDDILVKVDRAAMANSLETRVPMLDHRIAELAWRMPLDYKIRNGEGKWLLKQVLYRHVPRELIERPKMGFGIPLHDWLRGSLRDWAEALLDRNLLQQQGYFNPAPIRKIWNEHLSGVFNHQHQLWDILMFQAWLETQ

SEQ ID NO: 3400 - protein, 246 aa, Oryza sativa
MGRGKVQLKRIENTINRQVTFSKRRSGLLKKANEISVLCDAEVALIIFSTKGKLYKYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 3401 - protein, 1384 aa, Trichodesmium erythraeum
MKLRKKTRIIINTVIASIVAILYVVQSIILLHHFQYLEANYVRLNVDRGLNILDEQLSNLSAIAKQDRVLLLSKNFANQNQLESNVNLTKEEFINFNSVKNFFINQKLNLILRVNSQGEILFSQVFDLNKQTEIPISESFKKHLSRIQNLKQENYLSKIGIIILPEAPMLIVATNVPNEKDSLSNDTLIVGRYLDNTMISRLAESTKLSLTISRNLQTNQQLKLKNSEIVVKPLSSNKIAGYKIIKDIYSQPVLILQVKIDRIISNSLQSFWGYLIFLWVIVGLVFCVVIIAVIEKLLVSRVLQLSKLVKKIASSGDFSSRISMLGNDELSSLAGTINNILEGLKNYHSDYQESEESYRLMIENSTCIISRHSLNGIFLDISPNCRNLLGYSPLELLGNHPQKLFAHEDTKAIAKAYYAVLKNSVTSTITYRLLCKDSKYIWLETSFRTIRDSKTGKVQEIIALSYDISELKQKKEELQESEAAILRLYQITSATCKDKNLDMDPSSFFNYRLQKLLEMGCEKFDLETGVLFKIEDGISTTIASITPDNCISKGQEFEVEKNFIFTAITEKPICFESITSSGFSITTDIDFQIEAYMGAPVMVGGLVYGTLNFWSPKPLRQPFKAIDKELLKLMAQWVGGELERQKTATDATDLAKARDEALAATRAKSEFLATMSHEIRTPINAVIGMTGLLLDTSLKSDQTEFVETIRSSGDALLTLINDILDFSKIESEKFDLEEHPFDLETCLEESIDLLVAKVSEQGLELVYFIDPETPTIVIGDVTRVRQILVNLLSNAVKFTSDGEVLVSVSGRKLEIEENVQNLAVENISESDTCDIWPAYEIQFSVKDTGIGIPANRMNRLFKRFSQVDSSTNREYGGTGLGLVISKRLAEMMGGQMWVESMGVVGGNPPATYRLPDLYEHSAAVNEKSGSTFYFTIVSKCSIQTVQNKFIQTNYVNGSQHKLVDKRILIVDDNSTNRTILLRQTESWGMIVRTAENANRALELIATENKFDVAIIDMKMPEIDGLSLGKKITEYPIYQNLPIILLSSLGQQEINFSDKLLGSVINKPIKQSQLYEALLNIFSGQDVKVKFKNNNKRNYQTIPVLAKELPLRILLADDHLVNQKVALRILQRMGYRADLASNGLEVLAAVFRLPYDVVLMDVQMPLMDGLEASRHIQREYENATKYSQKSPQKRPRIIAMTANVMQGYREECIAAGMDDYISKPIQIEELIKALSKCKSVVSEVKEKLNFPQLNTFLETEDNNNNIFPDKPILESKVIENLREVEYLDESIDIYLETSPELLENINIAINQTDPLRLKNAAHSLKSISGTLGAMNLYNICQELEVLARLAYESGNFTPKEVIDIFSEVKIEYEKVIAALKLEQHK

SEQ ID NO: 3402 - protein, 80 aa, Brassica napus
MQCANHSILLLTPYKMGRFNLSHRVVLAPLTRQRSYGNVSHPHAVLYYSQRTCPSGFLTTEASGVLDTAQGFQDTSGDLV

SEQ ID NO: 3403 - protein, 406 aa, Pyrococcus furiosus
AHHHHHHGSIRASKRALSVEYAIRDVVLPARELEKKGIKVIRLNIGDPVKFDFQPPEHMKEAYCKAIKEGHNYYGDSEGLPELRKAIVEREKRKNGVDITPDDVRVTAAVTEALQLIFGALLDPGDEILVPGPSYPPYTGLVKFYGGKPVEYRTIEEEDWQPDIDDIRKKITDRTKAIAVINPNNPTGALYDKKTLEEILNIAGEYEIPVISDEIYDLMTYEGEHISPGSLTKDVPVIVMNGLSKVYFATGWRLGYMYFVDPENKLSEVREAIDRLARIRLCPNTPAQFAAIAGLTGPMDYLKEYMKKLKERRDYIYKRLNEIPGISTTKPQGAFYIFPKIEVGPWKNDKEFVLDVLHNAHVLFVHGSGFGEYGAGHFRAVFLPPIEILEEAMDRFEKFMKERLKE

SEQ ID NO: 3404 - protein, 545 aa, Sinorhizobium meliloti
MAAKEVKFGRSAREKMLRGVDILADAVKVTLGPKGRNVVIDKSFGAPRITKDGVTVAKEIELEDKFENMGAQMVREVASKTNDIAGDGTTTATVLAQAIVREGAKAVAAGMNPMDLKRGIDLAVAEVVKDLLAKAKKINTSDEVAQVGTISANGEKQIGLDIAEAMQKVGNEGVITVEEAKTAETELEVVEGMQFDRGYLSPYFVTNPEKMVADLEDAFILLHEKKLSNLQAMLPVLEAVVQTGKPLLIIAEDVEGEALATLVVNKLRGGLKIAAVKAPGFGDRRKAMLEDIAILTGGTVISEDLGIKLESVTLDMLGRAKKVSITKENTTIVDGAGQKSDIEGRVAQIKAQIEETTSDYDREKLQERLAKLAGGVAVIRVGGATEVEVKEKKDRIDDALNATRAAVQEGIVPGGGVALLRSSVKITVKGENDDQDAGVNIVRRALQSPARQIVENAGDEASIVVGKILEKNTDDFGYNAQTGEYGDMIAMGIIDPVKVVRTALQDAASVASLLITTEAMIAELPKKDAPAMPGGMGGMGGMDMM

SEQ ID NO: 3405 - protein, 1131 aa, Glycine max
MSTSRPSQSSSNSRRSRHSARMAQATVDAKIHATFEESGSSFDYSSSVRVSGTADGVNQPRSDKVTTAYLRGKMIQPFGCLLAIDEKNHMQTCKVIAYSENEPEMLTMVSHAVPSVGDHPALGIGTDIKTLFTAPSVSGLQKALGCADVSLLNPILVHCKTSGKPFYAIVHRVTGSLIVDFEPVKPYEVPMTAAGALQSYKLAAKAITRLQSLPSGNMERLCDTMVQEVFELTGYDRVMAYKFHEDDHGEVIREITKPCLEPYLGLHYPATDIPQASRFLFRKNKVRMIVDCHAKHVRVLQDEKLQFDLILCGSTLRAPHSCHAQYMANMDSIASLVLAVVVNDNEEDGDTDAVQPQKTERLWGLVVCHNTTPRFVPFPLRYAREFLPQVFADHVHKEIELEYQIIEKNILHHPGHLLCMLMRDAPLGIASESPNIMDLVKCDGAALIYRNKVWRLGVTPSEPQIREIALWLSEYHMDSTSFSTDSLFDAGFPSALSLGDVVCGMASVRVTAKDMVFWFRSHTAAEIRWGGAKHEAGEKDDSRRMHPRSSFKAFLEVVKARSLPWKEYEMDAIHSLQIILRNAFKEDTESLDLNAKAINTRLRDLKIEGINDLKIERMQELEAVTSEIVRLDYTATVPILAVDVDGLVNGWNIKIAELTGLPIGEATGKHLLTLVEDSSTDRVKKMLNLALLGEEEKNVQFEIKTLGSKMDSGPISLVVNRCASRDLRDNVVGVCFVAHDITAQKNVMDKFIRIEGDYKAIVQNRNPLIPPIFGTDEFGWCCEWNPAMMKLTGWKREEVMDKMLLGEIFGTQMAACRLKNQEAFVNLGVVLNKAMTGSETEKVPFGFFARNGKYVECLLSVSKKLDVEGLVTGVFCFLQLASPELQQALHIQRLSEQTASKRLNALSYMKRQIRNPLCGIVFSRKMLEGTDLGTEQKQLLRTSAQCQQQLSKILDDSDLDTIIDGYLDLEMAEFTLHEVLVTSLSQVMEKSNGKSIRIVNDVAGHIMMETLYGDSLRLQQVLADFLLISINFTPNGGQVVVAGSLTKEQLGKSVHLVKLELSITHGGSGVPEVLLNQMFGNNGLESEEGISLLIRAKLLKLMNGDVRYLREAGKSAFILSAELAAAHNLKA

SEQ ID NO: 3406 - protein, 540 aa, Streptomyces albus
MAKILKFDEDARRALERGVNQLADTVKVTIGPKGRNVVIDKKFGAPTITNDGVTIAREVECDDPYENLGAQLVKEVATKTNDIAGDGTTTATVLAQALVREGLRNVAAGASPAALKKGIDAAVAAVSAELLDTARPIDDKSDIAAVAALSAQDKQVGELIAEAMDKVGKDGVITVEESNTFGVDLDFTEGMAFDKGYLSPYMVTDQERMEAVLDDPYILIHQGKIGSIQDLLPLLEKVIQAGGSKPLLIIAEDVEGEALSTLVVNKIRGTFNAVAVKAPGFGDRRKAMLGDMATLTGATVIAEEVGLKLDQAGLDVLGTARRVTVTKDDTTIVDGGGNAEDVQGRVAQIKAEIESTDSDWDREKLQERLAKLAGGVCVIRVGAATEVELKERKHRLEDAISATRAAVEEGIVSGGGSALVHAVKVLDDNLGRTGDEATGVAVVRRAAVEPLRWIAENAGLEGYVITTKVAELDKGQGFNAATGEYGDLVKAGVIDPVKVTRSALENAASIASLLLTTETLVVEKPAEEEPEAGHGHGHSH

SEQ ID NO: 3407 - protein, 540 aa, Streptomyces albus
MAKIIAFDEEARRGLERGMNQLADAVKVTLGPKGRNVVLEKKWGAPTITNDGVSIAKEIELEDPYEKIGAELVKEVAKKTDDVAGDGTTTATVLAQALVREGLRNVAAGANPMALKRGIEKAVEAVSSALLEQAKDVETKEQIASTASISAADTQIGELIAEAMDKVGKEGVITVEESQTFGLELELTEGMRFDKGYISAYFATDMERMEASLDDPYILIVNSKIGNVKDLLPLLEKVMQSGKPLLIIAEDVEGEALSTLVVNKIRGTFKSVAVKAPGFGDRRKAMLGDIAILTGGTVISEEVGLKLENAGLDLLGRARKVVITKDETTIVDGAGDTDQVNGRVAQIRAEIENSDSDYDREKLQERLANVAGGVAVIKAGAATEVELKERKHRIEDAVRNAKAAVEEGIVAGGGVALLQASSVFEKLELEGDEATGAAAVKLALEAPLKQIAVNGGLEGGVVVEKVRNLSVGHGLNAATGQYVDMIAEGILDPAKVTRSALQNAASIAALFLTTEAVIADKPEKAAAAAPGGMPGGDMDF

SEQ ID NO: 3408 - protein, 274 aa, Zea mays
  misc_feature (44)..(44): Xaa can be any naturally occurring amino acid
RGGDAVAERQGGRGGGGGGPGRHDERLQRPRGRGGGGGAAAAGXDGQGRAKRKRSRRRRDRDGQQPKEPTTQEEYLALCLVMLATGRRDADADAAAPPQDHACSVCGKAFPSYQALGGHKASHRAKPSPSPSPAAALAPEPGAGDGDRHDEKKPAQPSSSSAGSRPAAAAHECNVCGKAFPTGQALGGHKRRHYDGTIGSAAAPARASSSSVPASAATSSLGAATSVPASAPPPPQAVAFDLNLPALPERCAGVDEDEVLSPLAFKKPRFMIPA

SEQ ID NO: 3409 - protein, 212 aa, Glycine max
  misc_feature (47)..(47): Xaa can be any naturally occurring amino acid
  misc_feature (168)..(168): Xaa can be any naturally occurring amino acid
MGQQSLIYSFVARGTVILAEYTEFTGNFTGVAAQCLQKLPSSNNKFXYLVDNGFTYCVGAVESAGRQIPIAFLGRIKEDVTKKYAGGKAATAAAQSLNREFGPKLKEQMQYCVDHPEEISKLAKVKAQVSEVKGVMMENIEKVLDRGEKIELLVDKTENLRSQAQDFXQQGTKIRRKMWFQNMKIKLIVLGIIIALILIIVLSVCGGFNCGK

SEQ ID NO: 3410 - protein, 367 aa, Pseudomonas fluorescens
MPVQALFKPFQLGALELPTRVVMAPMTRSFSPGGVPNSKVIEYYRRRAAAGVGLIITEGTTVGHQAANGYPNVPQFHGEAALAGWKKVVDAVHAEGGKIVPQLWHVGNVRRLGTEPDASVPGYGPTEKLKDGKVLVHGMTHQDIQEVIAAFAQAAKDAQSIGMDGVEIHGAHGYLVDQFFWEGTNQRTDEYGGDLAQRSRFAIELIQAVRAAVGPDFPIILRFSQWKQQDYSARLVQTPEALEAFLKPLADAGVDIFHCSTRRFWEPEFEGSDLNLAGWTRKLTGKPTITVGSVGLDGEFLQFMVNTDKVAQPASLENLLQRLNNDEFDLVAVGRALLVDPDWAQKVREGREQDILPFSRDALTTLV

SEQ ID NO: 3411 - protein, 476 aa, Methylobacillus flagellatus
MRKLKKIGLIVAGPLLGVMLSLSYSAIADKETKPQLPLDDLRTFAEVFGKIKSDYVEPVEDKKLLTEAINGMLAGLDPHSAYLDADAFKDLQAGTQGEFGGLGIEVGMEDGFVKVVAPIEDTPAYKAGLKSGDLIMKLDDTPVKGMTLTDAVKRMRGKPDTKITLTVLRKGEAKPLTFVLTRAIIKTQSVKYKLSEPGYAYIRITQFQEHTGEDLAKALKTMREQNKEAFKGLILDLRNNPGGLLNAGVGVSAAFLPKGELVVYTEGRGEEAKMRLTANPENYVRGGARADYLRDLPAEMKTLPIVVLVNGGSASASEIVAGALQDHKRAIIMGTQTFGKGSVQTILPMNNGAAIKLTTARYFTPKGRSIQAKGIVPDIVVEEATVSSQEHAAMLREADLSRHLSNPKEGEEAPTVQPAPAEPENTKPEAPATEPDSKDQKDKPAANGPIEPGSKADYQFNQALNLLKGLQILQRK

SEQ ID NO: 3412 - protein, 371 aa, Agrobacterium tumefaciens
MTSLFEPAQAGDIALANRIVMAPLTRNRSPGAIPNNLNATYYEQRATAGLIVTEGTPISQQGQGYADVPGLYKREAIEGWKKITDGVHSAGGKIVAQIWHVGRISHTSLQPHGGQPVAPSAITAKSKTYIINDDGTGAFAETSEPRALTIDDIGLILEDYRSGARAALEAGFDGVEIHAANGYLIEQFLKSSTNQRTDDYGGSIENRARFLLEVVDAVAEEIGAGRTGIRLSPVTPANDIFEADPQPLYNYVVEQLGKRNLAFIHVVEGATGGPRDFKQGDKPFDYASFKAAYRNAGGKGLWIANNGYDRQSAIEAVESGKVDAVAFGKAFIANPDLVRRLKNDAPLNAPNQPTFYGGGAEGYTDYPALAQ

SEQ ID NO: 3413 - protein, 351 aa, Ralstonia eutropha
MPTLFDPIRIGDLDLPNRVIMAPLTRSRAVGGKRVPNALMAEYYVQRASAGLIISEATAVTPQGVGYADTPGIWTDEQVAGWKHVTDAVHAAGGRIFMQLWHVGRISDPIFLDGELPVAPSAIAAQGHVSLVRPKRAYVTPRALETEEIAGVIAAYRHGAENAKKAGFDGVEIHGANGYLLDQFLQDSTNQRTDAYGGPIENRARLLLEITDACIDVWGADRVGVHLSPRGDVHSMGDSDLAATFGYVARELGKRRIAFICAREALGDNRLGPALKAAFGGVYIANEKMTKQTAEHVLAAGEADAVAFGQLFIANPDLPRRLALDASLNEPRPETFYHPGAEGYTDYPALV

SEQ ID NO: 3414 - protein, 453 aa, Glycine max
  misc_feature (153)..(153): Xaa can be any naturally occurring amino acid
MEECHTVFGKYEMGRLLGKGTFAKVYYGKQISTGESVAIKVINKEQVRKEGMMEQIKREISVMRLVRHPNVVEIKEVMATKTKIFFVMEYVRGGELFAKISKGKLKEDLARKYFQQLISAVDYCHSRGVSHRDLKPENLLLDEDENLKISDFXGLSALPEQLRYDGLLHTQCGTPAYVAPGVLRKKGYDGSKADIWSCGVVLYVLLAGFLPFQHENLMTMYNKVLRAEFEFPPWFSPDSKRLISKILVADPSKRTAISAIARVSWFRKGFSSLSAPDLCQLEKQEDAVTVTVTEEENNSKVPKFFNAFEFISSMSSGFDLSGLFESKRKTATVFTSKCSAAAIVAKIAAAARGLSFRVAEVKDFKIRLQGAAEGRKGRLAVTAEVFEVAPEVAVVEFSKSAGDTLEYAKFCEEDVRPALKDIVWTWQGDATCAANFPACHGEECQKQVVVSTI

SEQ ID NO: 3415 - protein, 430 aa, Arabidopsis thaliana
MSLTLEFLLLLIVLFLSHHAHSGSIVKFLPGFEGPLSFELETGYIGIGEEEEVQLFYYFIKSEKNPEEDPLLLWLSGGPGCSSLTGLLFENGPVALKFEVYNGSVPSLVSTAYSWTKMANIIFLDQPVGAGFSYSRTPLVDKTSDTGEVKRIYEFLQKWLSKHQQFFSNPFYVGGDSYSGMIVPPLVQEIAKGNYQINLQGYILGNPITDTESEQNYQIPYAHGMALISDELYKSMERICKGNYVNVDSLNTKCYKLIKDYQKCLHKLNKYHILLPDCDITSPDCFLYRYTLMTFWANNKSVREALQVNKGSIGEWVQCNYKNISYNYDIKSSVAYHMKNSIDGYRSLIYNGDHDMMVPFLATQAWIRSLNYSITDDWRPWMINDQIAGYTRSYSNKMTFATIKASGHTAEYLPNESSIMFQRWISGQPL

SEQ ID NO: 3416 - protein, 876 aa, Nicotiana tabacum
MAAPSSTTNVMLSISEKKTVSVDLYRPLRNYIIYNYSEREAQNIEDDLQTLKEYRSDIERAGSTDSSSSLPARRDLLQNYYKALCAVESRFPISPDQDHINSVTFTWFDAFKNKNKAAQQNIHLEKAAVLFNLGAVHSQMGLGFDRSSVEGRRQASHSFIAAAGAFAFLRDNVAMKASMGSSTTVDVSVECAGMLERLMLAQAQECVFENSIAKGNTPGVCAKISRQVGLFYEEALAALSVAPLNQHFDKAWLAHVQLKAALFYAEACYRYSLELHEKEEIAEEIARLKSGVNALSEARKTSPRGAAQQLLDAMNKLEASLNLNLEKAMKENDRVYLMRVPPASSLSPLPAFSLVKPMQMNDVLDASKEKMFASLVPDNSAKALSRYTEMVDDVIRTQAEKLQQGSELARVRLREMDLPDSILALDGNLSLPLALKEDVEAVQICGGPAGLDAELQQLRDLKRVNQELLVQTEEHLQKEATEDAQFRTQFGTRWTRPQSTTLTKNLLDRLNRFAANLKQAAESDARIERSVRDHAALMSILDRHPIESALPTLERPIMSLDATEDAIVGALKQSLRHLETLGAQRAGLEDMLKEMKRKDDILPKLMTSTGSHEDLFRKEIAKYDHICEEIARNLEAQEQLLLQIQAHNEEFASIFSLEDYKANRERIYNQIEAAISKYREIKDNINEGLKFYVTLQEAITNVKQQCSDFVMTRSIQCREMIEEVQRQISGLSFQDSKSSSGYAYPSVGQPQQAPRANPQLPADTGNIPNHPRPQNPTYQPPQQPTMPGYSQTSPYGSPQPPAPPYNFPGQGQPYPHPQHQQQPPQSHEYGQPAYPGWRGPYYNAPPQQPGAMPRPPYTAPSPYPHPPPHQSGYYRQ

SEQ ID NO: 3417 - protein, 242 aa, Neurospora crassa
MASSSSSATPLLYSCIAHNTTILAECTTSASSQTSSLASLILPKIDHSTPQKLTYTHGSYHIHYMSESPSDWTSQPSASSAGGLTFLVVADSSLGRRIPFGFLVEVRKRFLAQYPPGPTNDFSDMPNYGTASFNSELKTLMVDYGTTGQGQNDAITNAKREIEDVKGIMTRNIEGLLERGERIDLLVDKTDRLGGSAREFRVRSRGLKRKMWWKNVKLMALLALVVVLIVLSIVIAVKNSLP

SEQ ID NO: 3418 - protein, 230 aa, Arabidopsis thaliana
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 3419 - protein, 737 aa, Chlamydia muridarum
MDPFFLNTQHVELLVSGKQSSPQDLLGIVSESLNQDRIVLFRPGAKTVFVELQGKIQQAESHHSGIFSLPVTKGISPQDYRVYHQNGLLAHDPYAFPLLWGEIDSFLFHEGTHQHIYDRMGAIPCEIGGVPGVRFVIWAPHAQRVSVVGDFNCWHGLVNPLHKVSDQGVWELFVPGLTAGSCYKWEIVTASGQVLIKSDPYGKFFGSPPQSVSVVVDDRYEWGDKEWLDERSKKAEGPMNIYEVHVGSWRWQEEQPLNYRELADQLSLYCKQMHYTHVELLPVTEHPLNESWGYQTTGYYAPTSRYGSFEDLQYFIDTMHQHGIGVILDWVPGHFPVDSFAMSNFDGTPLYEYTRNPSPLHPHWHTYTFDYAKPEVCNFLLGSALFWIDKMHIDGIRVDAVSSMLYLDYGRNPGEWIPNRYGGRENLDAVRFLQQFNTIIHEKYPGVLTFAEESTTFPKITVSVEEGGLGFDYKWNMGWMHDTLHYFEKDFPYRPYHQSDLTFPQWYAFSERFLLPFSHDEVVHGKRSLIGKMPGDAWRQFAQLRLLLGYQICQPGKKLLFMGGEFGQGREWSPNRELDWDLLDIHYHQGVHLCSQKLNSLYVNSPQLWKGDHLPQSFRWIDFSDTRNGVVAYLRFASDEDKEALLCVHHFGVNHFLHYILPMLPMKSCSLLMNTDDLAFGGSGKGFRNPKMLTPEMVRKEKTSSELAPLDDDGSVAWGLDIEMPPSATLIFSVTLQ

SEQ ID NO: 3420 - protein, 312 aa, Oryza sativa
MAAAEVYSPTAAAAAQQQQRGKVAAQAWQAVVGWIGFLLQVLLQILRGTPSCAQLLSFVGFRYPLLSGPADSEQSPSVAFMPLRSEIPADTAPAPTPPPESLQRLTVVLDLDETLVSAYESSSLPAIVRTQAVEAGLHCFDMECISTEKDVEGRNKVNHVTVFERPGLHEFLQKTSEFADLILFTAGLEGYARPLVDRIDVHNRFKLRLYRPSTVTTEYREHVKDLSCVSKDFCRVVIVDNNPFSFILQPLNGIPCVPFSAGQHNDNQLMEVIFPLLKHLSIQRDVRPALYERFHMPEWFQKHGIPQTDQAV

SEQ ID NO: 3421 - protein, 542 aa, Lactobacillus acidophilus
MAKDIKFAENARRSLLKGVDKLADTVKTTIGPKGRNVVLEQSYGNPDITNDGVTIAKSIELKDHYENMGAKLVAEAAQKTNDIAGDGTTTATVLTQAIAREGMKNVTAGANPVGIRRGIEKATKAAVDELHKISHKVESKEQIANVAAVSSASKEVGELIADAMEKVGHDGVITIEDSRGINTELSVVEGMQFDRGYLSQYMVTDNDKMEADLDNPYILITDKKISNIQDILPLLQEIVQQGKSLLIIADDVTGEALPTLVLNKIRGTFNVVAVKAPGFGDRRKAQLEDIAALTGGTVITDDLGFELKDTKIDQLGQARRVTVTKDSTTIVDGAGSKDAIKEREDSIRKQIEESTSDFDKKKLQERLAKLTGGVAVIHVGAATETELKERRYRIEDALNSTRAAVDEGYVAGGGTALVDVEKAIKDLKGETSDEQTGINIVLRALSAPVRQIAENAGKDGAVVLNKLESQENEIGYNAATDKWENMVEAGIIDPTKVTRTALQNAASIAALLLTTEAVVADIPEDKPEAPQAGAAGAPGMGM

SEQ ID NO: 3422 - protein, 232 aa, Oryza sativa
MTWSSDSDRDDEPATAAAASADDASLATSFFLQQPGTPPAAAPAPARRRRHKNRRPRAHRRAAAKNEEEEEVAGTEDVWRGAQWEAAWPRRAAARPVVVADDAAGAAAAREDAPGVGGEGGGLGVGRARSLTDDDLEELKGCVDLGFGFSYDEIPELCGTLPALELCYSMSQRFLDEHYHSPVAEPAPVAPSSPAQPIANWKISSPGDSPDEVKARLKYWAQAVACTVRLCS

SEQ ID NO: 3423 - protein, 325 aa, Cryptococcus neoformans
MSLGRTLKLNNGVVAPQIGFGTWQAAPGEVEKAVEEAIKVGYRHIDCALIYRVFDATGVYGTVAQGIKASGVPRKDLFLVSKLWNNSHRPEKVEADLDTSLKQLGTDYLDVYLIHWPVPFAPGDNLFPKTEDGKVAIDWDGPSVVDTWKELIRISKETKKVKAIGVSNFNVELLEKLIKETGVVPTMNQIECHPSLIQPELFKYCKEKNIVITAYSPLGNNTTGKPRIIDQPQIIDIAKKLNKEPAQVLINWAAHQGFAVIPKSVTPSRIKSNFEDFKLNDDVFEEINKVGKANAARANIPAEYNPSWPINVFGEKSEEQYKKVW

SEQ ID NO: 3424 - protein, 142 aa, Brassica napus
  misc_feature (120)..(120): Xaa can be any naturally occurring amino acid
SHGHSETTELRGKKHRKIYRFFCNLHSIQFTASKMVAKEAIPLLTPHKMGQFELSHRVVLAPLTRCRSYANVPQPHAAAYYSQRATKGGLLIAEATGVSATPQGYPETPGVWTQQQVDAXKPIVDAVHRKGALFFCQIWHVG

SEQ ID NO: 3425 - protein, 213 aa, Methanosarcina barkeri
MEVRYICPTAYDSSVYLVNGKVLIDTGMNSDLIIKQLEKYIKLTDIELIVLTHCHYDHTAAAAVIAERSGAKVGIHKADLEGINDDYLSVAVIFGERAPEVRPTITYEEGDKIDIGNGEYLEVIHTPGHSKGSICLYEPVSKSLFSGDTVFPGGGSGRTDFEGSVPEKMASSIEKLTKLDVKNLYPGHGSPTDRDGNNQIMASYRMLKMMMGE

SEQ ID NO: 3426 - protein, 533 aa, Ustilago maydis
MSIANASSSTASHDLDAADADPCPSACTSVSALCNMSTLPSPRPFGYRPTYVPAMVASGVSAVTVTTNSHRPPSKSHSISSVDSLASVSSNAPSTPTHDADDVRFEMAVIPKLVRASADAYLDRVGKPLPPSPAPQIVATSATTKTNAQAARSVAAAAAAAAAAAAVPPSHSALRNENHKNAISFRVGSKYKVCEIIGEGAYGVVCSAIHRATGQKVAIKKIQPFEHQMFALRTLRELKLLRFFQECDVSENIISILDIIKPSTYEAFTEVYLVQELMETDLHRVIRTQELSDDHCQYFTYQTLRALKPMHCADVIHRDLKPSNVLLNANCDLKVCDFGLARSVLTADQDTGFMTEYVATRWYRAPEIMLTFKQYTKAIDVWAVGCILAEMLTGRPLFPGRDYHQQLSLILDVLGTPTLEEFQNINSRRSRDYIRSMPFRKRREFRTLFPKASPEAIDFLQKTLTFDPRNRLTVEECLQHPYLSAYHDPDDEPGAPRLDPDFFYFDMQKESITKEDLRKELWYQVQEFQPLLR

SEQ ID NO: 3427 - protein, 129 aa, Brassica napus
MESKPFVSVTFLTVTLFLGGAIRSGICRSEERRMEHVRLGGVHDLPGNQNSGEIESLARFAIQEHNNKENKVLEFKKIVKARQQVVAGMMYYLTLEANEGGQAKNFEAKVWVKPWMNFKQLREFKESSS

SEQ ID NO: 3428 - protein, 744 aa, Aspergillus nidulans
MATSITAGLQKAQQAVQDTATKNKKIVDISHDTVNVHTDQEQRTDFGVAITDPDHWLRVTNETHSGPSLLEDHIARERIHRFDHERIPERVVHARGTGAYGNFTLKESIEDLTYAGVLTDTSRNTPVFVRFSTVQGSRGSADTVRDVRGFAVKFYTDEGNWDIVGNNIPVFFIQDAIKFPDFVHAVKPEPHNEVPQAQTAHNNFWDFVYLHPEATHMFMWAMSDRAIPRSYRMMQGFGVNTFSLVNKEGKRHFVKFHWIPHLGVHSLVWDEALKLAGQDPDFHRKDLMEAIDNKAYPKWDFAIQAIPEEDQDKFEFDIFDATKVWPEEQVPLRVVGELELNRNIDEFFPETEQVAFCTSHIVPGIDFSDDPLLQGRNFSYQDTQISRLGVNWEEIPINRPVCPFLNHNRDGAKRHRITKGTVNYWPNRFEANPPASDKGFKSHPAPITGRKRRDLTPKFKEYHNQAQLFYNSLSEVEKVHVKKAFSFELDHCDDPIVYERLAGQRLAEIDLPLAQAVAEMVGAPIPTKALRDNHGKTSVRLSQFDFTPKAPGIISRRIAIIIGDGYDKIAFNGMKAAILAAQALPFVIGTKRSAIYAQGEDKNSSKGVIPDHMYDGMRSTMFDATFIPGGSHIETLQKNGQIRYWIAETFGHLKALGAMGEAAQLVKEVLGNVMGVQIAGADSAEPVEWYGVVTARGPESAESLSEGFKVLKDAGDFTSKFFYQISQHRNWQRELDGLASTVAF

SEQ ID NO: 3429 - protein, 1525 aa, Arabidopsis thaliana
MPGNEYGERIHNFFGQEGLSQDSHQPQAGDGSWSGFRNGLVSNQRQIDPSLIANLKTYSTQQSVDPERGQSSNSQHGLNFAQQPMRSDYSRSVLREHQQSTTGYMHGNLMLQASPNEGSFVGVDVESSRDRLSGSGFTLDRHKTPMRFDMGESPVNYDFFGGQQQLNNQLPGMIQPFPRQQMTFNDMQLLKQHAMAKQMHEYQIQQQLQKQQLEARQLNSLHSNAVNGSLSSDNQSHPSISGVPLQDASNNWLQPDLMTGNTNWMHRGISPIVQSSSSGLVITPEHGHANLMAQQFETSLYGMPVGGTDAPQNAFSSFQMKMLAAQHGSANMSSSLTNQPTSFLNQSDSHMLPRSTYQENLYSHISVPGSNDRPNFESFQQDNSGQQNISGQEEFGQMDGSGLSEKSFMKVPENINTLQKSTTLDPTEEKILFGSDDNLWEAFGNSTDMSLTGNLMSSSSDLFDACPSLQSGSWSALMQSAVAETASDDAGVHEWGSKQQSVWANNINAPHPDSRIGNRAQVSGGHTDSTRSTVQHLQDKGNIVSDHGLLEKPMTPQSQMAGNMFQSLSSGIDVQNNSCSIGKNEDIDDRLGNWRGASNPNSAALMERKNHFTQNLQMQRASYGAGDDSRASRDIQQNIQHHLDNNSVEKAIHQLNSGDSSQILESYASNNVSKVMTESNEMGNSGKENSSDSFRSKFSPESLTQVNARDLSVLPGGKETQSPSRSDGLIRDGLNHKDSANCMLQFGPTISQSFFNKNHAVSAGSDHQQISPQIAPSRFSQYEAFKNGLVQPVNDTGRFTLLKIGERYSNLGNSDDGLHSVQSSKQLNTADPGYIVHMQQISGSTPGVETLSSASLPCGATDQLLKVYKPKKRKNVTSELLSWSKEVMQRPQRLKTLGFLFEAEVDWARATNRFAEKGLFVEFATLLEDGPPIRSKRRLIYTTQLMQQLFRPLPGRVKSLVTSYEFVAYSAARAALGDACSSTSTDRIEGFLLQNNLNPLSERTETEKMSDQYISKAAEDFISRTKKLETDFAGLEKGTTITDLRVEVQDLERFAVINRFASFHQSSSSMDRSVSSLRLNPQRYVTVAPVPRHIPDRCCKKQGPKIREIKREKVGFHIFCIWTEKSLNSTNEQELKVLVCYSRIRESKTQRQTTSNLWCGNKSHTRATIRRGEMKIYPEHNAGDAEDNGDESGVVNGKILRRYRPWNVRLCRRRLPWIVHRRSVPVTFPPPASPSPASSSRSLASSSPSPGSFSSSMRLWRPAAQRNLRNQWSNLSNCRQQWIVACSAGRSHATLLVNSYLSQKYMPMMELGVLSDMFDIDKKALKKLFTQQSSYRIKLLSSYKEMVAVVVEMVNASRSLRCYTKLSTGSLIQFSGTKEDSNDAGDCGGIPVFNFWNVSAFEKMAEELVEMFKREVMLKRLLIMELISLSTEVPQPINNSWSDELYHGEFDHLTKCSLYSMEVAKPVLPRVKDYNIGSSSISHTNQPTAEILQIYLTTWLAEVNIDTHRVDEILALVGEEIRVTF

SEQ ID NO: 3430 - protein, 462 aa, Leptospira interrogans
MKNKERMIWIGIVSFLSFALIFPIETVKGISKTGESYLQIFHEVLSTIHSDYVESVDEEKLYQGAIRGLISSLGDPHSRFMDKDDFSQLQEETRGSFGGLGMEVSFADGAIVVISPIEDTPAMKAGILPQDRIIEIDGKNTHDLSLSDSIKLMRGKVGTSVSIKLERKNQKEPMVLTLVREMIKIRYVRSSFLEKEKLGYIKLNQFMGKENTLSEFKKELNSLKEKGAEGLILDLRMNPGGLLDLAIALSDLFLKPDLDIVSVRGRGGELVRVFRSTAANDKFINLPLVVLINEGSASASEIFAGAMQDHGRGKILGTVSFGKGSVQNIYSLSHNTGIALTIQKYYTPSGKSIHGKGIQPDVIVKPIEPTEDDRFYIRKMAEKKMLETFLLKNPNYSEANFVLLEKYLSEKGIKLSADVARFLYKSKTRQEGQNSILDLELDPQLRKAIEILSPNKDGEKKS

SEQ ID NO: 3431 - protein, 544 aa, Chlamydophila pneumoniae
MAAKNIKYNEEARKKIHKGVKTLAEAVKVTLGPKGRHVVIDKSFGSPQVTKDGVTVAKEIELEDKHENMGAQMVKEVASKTADKAGDGTTTATVLAEAIYSEGLRNVTAGANPMDLKRGIDKAVKVVVDELKKISKPVQHHKEIAQVATISANNDSEIGNLIAEAMEKVGKNGSITVEEAKGFETVLDVVEGMNFNRGYLSSYFSTNPETQECVLEDALILIYDKKISGIKDFLPVLQQVAESGRPLLIIAEEIEGEALATLVVNRLRAGFRVCAVKAPGFGDRRKAMLEDIAILTGGQLVSEELGMKLENTTLAMLGKAKKVIVTKEDTTIVEGLGNKPDIQARCDNIKKQIEDSTSDYDKEKLQERLAKLSGGVAVIRVGAATEIEMKEKKDRVDDAQHATIAAVEEGILPGGGTALVRCIPTLEAFLPMLANEDEAIGTRIILKALTAPLKQIASNAGKEGAIICQQVLARSANEGYDALRDAYTDMIDAGILDPTKVTRSALESARSIAGLLLTTEALIADIPEEKSSSAPAMPSAGMDY

SEQ ID NO: 3432 - protein, 480 aa, Lactobacillus plantarum
MSEFPEGFLWGGATAANQLEGGYQEGGRGLSIADRLPGGKDRFKIVSQPDFDWTIDTDKYTYPNHEGIDFYHHYKEDIALFAEMGFKCYRFSIAWSRIFPNGDETQPNEAGLKFYDDVIDECLANNIEPVITISHYELPLNLAKRYGGWKNRYLIEFYETFARTILTRYASKVKYWMTFNEINSAVHFPVMGQGLVLSTGANDKKNVFQAWHNQFVASAKAVKIAHELRDDIQVGCMILYATSYAYDSNPVNQLANLQHNQDFNFFCADVQVRGAYPTYTKRLLAEYNLTFDDLETTDGDLALLQQYPVDYIGFSYYMSSAVETTGSVTDTVAGNLMGGVKNPFLKASDWGWQIDPTGLRIALNELHDRYQKPLFVVENGLGAIDKPDKNFYVEDDYRIDYLKQHIEAMAGAIDDGVDLMGYTPWGCIDLVSASTGEMSKRYGFIYVDLDDQGHGTLARYPKKSFYWYQDVIKHNGLTKK

SEQ ID NO: 3433 - protein, 472 aa, Bartonella alsatica
MLREVASKTNDIAGDGTTTATVLGQAIVQEGIKAVAAGMNPMDLKRGIDAAVDEVVANLFKKAKKIQTSAEIAQVGTISANGAAEIGKMIANAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKAEINARVNQIKAQIEETTSDYDREKLQERLAKLAGGVAVIRVGGATEVEVKEKKDRVDDALNATRAAVEEGIVAGGGTALLRAASALTVKGSNPDQEAGINIVRRALQAPARQIASNAGEEAAIIVGKVLENKADTFGYNTATGEFGDLIALGIVDPVKVVRSALQNAASVASLLITTEAMVAETPKKETPMPPMPGGGMGGMGG

SEQ ID NO: 3434 - protein, 544 aa, Chlamydia trachomatis
MVAKNIKYNEEARKKIQKGVKTLAEAVKVTLGPKGRHVVIDKSFGSPQVTKDGVTVAKEVELADKHENMGAQMVKEVASKTADKAGDGTTTATVLAEAIYTEGLRNVTAGANPMDLKRGIDKAAKVVVDQVKKISKPVQHHKEIAQVATISANNDAEIGNLIAEAMEKVGKNGSITVEEAKGFETVLDVVDGMNFNRGYLSSYFATNPETQECVLEEALVLIYDKKISGIKDFLPVLQQVAESGRPLLIIAEDIVGEALATLVVNRIRGGFRVCAVKAPGFGDRRKAMFEDIAILTGGQLISEELGMKLENANLAMLGKAKKVIVSKEDTTIVEGMGEKEALEARCESIKKQIEDSSSDYDKEKLQERLAKLSGGVAVIRVGAATEIEMKEKKDRVDDAQHATIAAVEEGILPGGGTALIRCIPTLEAFLPMLTNEDEQIGARIVLKALSAPLKQIAANAGKEGAIIFQQVMSRSANEGYDALRDAYTDMLEAGILDPAKVTRSALESAASVAGLLLTTEALIAEIPEEKPAAAPAMPGAGMDY

SEQ ID NO: 3435 - protein, 247 aa, Prunus dulcis
  misc_feature (220)..(220): Xaa can be any naturally occurring amino acid
  misc_feature (228)..(228): Xaa can be any naturally occurring amino acid
  misc_feature (235)..(235): Xaa can be any naturally occurring amino acid
  misc_feature (243)..(243): Xaa can be any naturally occurring amino acid
RIENKINRQVTFAKRRNGLLKKAYELSVLCEAEVALIIFSNRGKLYEFCSSSSMLKTLERYQKCNYGAPETNVSAREALELSSQQEYLKLKARYEALQRNQRNLLGEDLGPLSSKELESLERQLDMSLKQIRSTRTQCMLDQLTDLQRKEHMLNEANKTLKQRLFEGYHVNSLQMNPNADEYGRQQTQAHGDGFFHPLDCEPTLQIGYQNDPISVVTAGXSVSNYMAXMVAMIIXKCVLESTXSHEW

SEQ ID NO: 3436 - protein, 540 aa, Clostridium scindens
MSYEALFSPFKVRGLELKNRIVLPGMNTKMAKNKHDIGEDMIAYHVARAKAGCALNIFECVALCPAPHAYMYMGLYTDHHVEQLKKLTDAVHEAGGKMGIQLWHGGFSPQMFFDETNTLETPDTLTVERIHEIVEEFGRGARMAVQAGFDAVEFHAAHSYLPHEFLSPGMNKRTDEYGGSFENRCRFCYEVVQAIRSNIPDDMPFFMRADCIDELMEQTMTEEEIVTFINKCAELGVDVADLSRGNATSFATVYEVPPFNLAHGFNIENIYNIKKQINIPVMGVGRINTGEMANKVIEEGKFDLVGIGRAQLADPNWITKVREGKEDLIRHCIGCDQGCYDAVINPKMKHITCTHNPGLCLEYQGMPKTDAPKKVMIVGGGMAGMIAAEVLKTRGHNPVIFEASDKLAGQFRLAGVAPMKQDWADVAEWEAKEVERLGIEVRLNTEVTAETIKEFNPDNVIIAVGSTYALPEIPGIDSPSVYSQYQVLKGEVNPTGRVAVIGCGLVGTEVAELLASRGAQVIAIERKGVGTGLRCFAECS

SEQ ID NO: 3437 - protein, 398 aa, Nitrosomonas europaea
MDDIASILMNGLIDLPWWGYIVVALVFTHITIASITIFLHRYQAHRSLELHPIPSHFFRFWLWLTTGMVTKEWAAVHRKHHAKCETVDDPHSPQVFGIKKVLGEGAELYKVETKNQETLDRYGHGTPDDWIERNVYTKHSVAGIASMLIINVILFGPLGLTIWAVQMMWTPVMAAGVINGIGHYWGYRNFRSEDASRNIVPWGILIGGEELHNNHHAYPTSARLSNKWYEFDIGWMYIRILEMMGLARVKKIAPKLQLNKAKTECDLETLQAVISHRYEILAKYTKSLKIALKNELVHLQQAAIENGVDGLTLRNWVLADAKTLKEEERTKLETVLSHAQKLDKLYRMREELSLIWERSAATKDELLKQLEDWCRRAEESGIELLEKFSRRLRCYAMA

SEQ ID NO: 3438 - protein, 380 aa, Mannheimia succiniciproducens
MNPIFSPLFQPYTLNNGVEIKNRLVVAPMTHFGSNTDGTLGKQEHRFISNRAGDMGMFILAATLVQDGGKAFHGQPEAIHTSQLPSLKATADIIKAQGAKAILQIHHGGKQAITELLNGKDKISASADEESGTRAATIEEIHTLIDAFGNAADLAIQAGFDGVEIHGANNYLIQQFYSGHSNRRTDEWGGSRENRMRFPLAVIDAVVAAKIKHQRDDFIIGYRFSPEEPEELGLTMEDTLALVDVLKEKPLQYLHISLWDFYKKARRGADSNTARLQLVHERIGGKLPLIGVGNLFTAQQILEAYQTGWAEFIALGKTVMVNPKIATMILNGQENQLITEVDENQADHYGFPDFLWNATMSATQAWLPPVKGKPWSPLDI

SEQ ID NO: 3439 - protein, 321 aa, Schizosaccharomyces pombe
MSAEQKYFENAQNVHFTLADGSKIPGLGLGTWRSEPNQTKNAVKTALQYGYRHIDAAAIYGNEDEVGDGIKESGVPRKDIWVTSKLWCNAHAPEAVPKALEKTLKDLKLDYLDEYLIHWPVSFKTGEDKFPKDKDGNLIYEKNPIEETWKAMEKLLETGKVRHIGLSNFNDTNLERILKVAKVKPAVHQMELHPFLPQTEFVEKHKKLGIHVTAYSPFGNQNTIYESKIPKLIEHETIQKIAKSKGEGVTGATIAVSWAITRGTSVIPKSVNEQRIKSNFKYIPLTKEDMDEINSIGIRARFNQATFSNEPVFAGLEDGRT

SEQ ID NO: 3440 - protein, 331 aa, Arabidopsis thaliana
MQAISKVSSAASFFRCSRKLVSQPCVRPCVRQLHVRKGLVSGVMKLFSSPLRTLRDAGKSVRISRFCSVSNVSSSLQIELVPCLTDNYAYILHDEDTGTVGVVDPSEAVPVMDALQKNSRNLTYILNTHHHYDHTGGNLELKDRYGAKVIGSAADRDRIPGIDVALKDADKWMFAGHEVHIMETPGHTRGHISFYFPGARAIFTGDTLFSLSCGKLFEGTPEQMLASLQRIIALPDDTSVYCGHEYTLSNSKFALSIEPTNEVLQSYAAYVAELRDKKLPTIPTTMKMEKACNPFLRTENTDIRRALGIPETADEAEALGIIRRAKDNFKA

SEQ ID NO: 3441 - protein, 569 aa, Debaryomyces hansenii
MMTDNKSDSDSIEIHLAKEMTNIPRTSSTPTPVVGIPGGTKPQTIFIHKLYDMLEDGNISHLIWWTENSESFGLLPGEEFSKVLAQYFKHTNIASFIRQLNMYGFHKVNDAGQSENGGDNNVARWEFRHLANHFRKGDIESLKLIKRRSSKNINHTREAAKTAGGTEDDIHEAVNEDDTKGIHTGDQHDVRAHEQQQHYHQTLQLQQQDQIPQPPSAIQHHHLTQIDGAPSPSVLPPLSKLPQIYKLSSDKSLETRLNEATSNLGTLRHEHHQLQTQFDLVFNEQKKSQFDLIQLVEIMQRHAVKSEDDKKLDYELTNFKQVLLNKFNNLHVLLSQAQGHQTPTIHPQHLSHAHPSMKPQYNSSHLHYSYSQSSADSNTDSSNIETQKLSKNGSKQPVSDGPMAKDVQPPYTYAEKFLEKNNIPTSLHSPHTSEVRRGYQQYPFPNMNSDPRASAPSTPDQFGQSVPPRVSLPSTNTYEQRPQSIPTPNSSLSLSRLALSNSSVSSGSSYSSNISVETPPKLVPLPSVSELDKLIKNGGGGLPLYRMLNSYGPMKRKNSTEEETRKRQA

SEQ ID NO: 3442 - protein, 910 aa, Legionella pneumophila
MLKSIGIKYQLRITTLIPAFLVALLFAFFYNGLFGKDLKQHMSRLGEAYIRQLLPAAQYAMLRNDYRTLQGLINASTINPEVKALAFYNADGRLIAYRGGKHSIHKPFNPPDYTGDYIESKQINPFTINFIAPITIPKFNLYSSTEFKELSTPKIFQADDILGWLSIDIDTQSLLIKRYQMLIVTIFITLFGLLMGLTIHYFLSKRIYMPIARLRRSMKQILSNEFETEIRVSSPGELGIIEKGCAHLQRQYLNTVRDLNHHIEIATADLQQSLELLEEKNIELSLEKKKTEEKSRQKSEFIANMSHEIRTPMNGVIGFTNVLLESKLDPLQLDYVKTIKSSAQDLLSIINDILDFSKIDAGKLNLDCIPLDIRGCIDEVLSLASPNAHKKGIDLIPITDINVPKMVLGDPLRIKQIISNLVTNAVKFTDHGYVLIRTKIEQETDKDYTLLFAITDTGIGISPEDQTKLFTAFNQADTSITRRYGGSGLGLVICKKLCEEMHGRISLTSEINKGSTFSARIKVEKLVAYEIEKNQTHRFAHLKIICFDDNPLHLEAIGNGLGFWGIEAIRVDSFNKLSRILTKHKDCKIAFINVNQGCERQAAELIAKHKQIPFVLISKWPINDFAALGARGFLYKPISIQKLQDLIESIANENQTEKNTNQELDTLREQLRFLHPEILIAEDNPVNKMLLTSLLNNNANITTVDDGEMAVTACEDKKFDMILLDLHMPKLNGLEAAKMIRQKSLMNKHSPIVLITASSSDLSSIDMKKSGVDFCFQKPIDEKQLLIQILRIVDKTKHAAIDWQLCVQKVSGNQALAEEFLAKFIEELYKNREEFIELMHQKNVKGLADLAHKLHGACCFCGVPILQKRVAQLEKLARRTANADNLTGAFTDLIQSIDAVISEYENQYSQ

SEQ ID NO: 3443 - protein, 178 aa, Oryza sativa
MMMMDLGFLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREVIGDSKLSSKAGDGSVKKDTIGPHSGASSSSAQGMVGAYTQGMGYMQPQYHNGDT

SEQ ID NO: 3444 - protein, 364 aa, Vibrio vulnificus
MSKLFEPTQLKHLDLQNRVVMAPMTRARTSQPGNIPNAMMATYYKQRASAGLIISEATQISDDSQGYSFTPGVYTDEQVAGWKSVTQAVKSQDAAMFCQLWHVGRVSHPVFQKGEQPIAPSALAPVETKVWIADEQGNGNMVDCVEPRAMTQDDIDRVVSDFSYAAKRAIEAGFDGVEIHGGNGYLIDQFLRTNSNHRTDQYGGSRENRIRFLLQVVDAVSQAIGADKVGVRLAPFITFKDMNCPDIVPTILEASKQLQARDIAYLHLSEADWEDAPEIPESFRIELREYFTNTIIVAGSYTQARADEVLKKGYADLVAFGRPFVSNPDLVARLKHQQPLAELDGATLFGGDERGYTDYTALHV

SEQ ID NO: 3445 - protein, 473 aa, Arabidopsis thaliana
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSQGLRQYNLDNMMDGFYIAPAFMDKLVVHITKNFLTLPNIKVPLILGSRGGKGQGKSFQCELVMAKMGINPIMMSAGELESGNAGEVRKLIRQRYREAADLIKKGKMCCLFINDLDAGAGRMGGTTQYTVNNQMVNATLMNIADNPTNVQLPGMYNKEENARVPIICTGNDFSTLYGPLILDGRMEKFLTGPTREDRIGVWGIFRTDKIKDEDIVTLVDQFPGQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKGAHEVNLPVPEGCTDPVAENFDPTARSDDGTCVYNF

SEQ ID NO: 3446 - protein, 164 aa, Legionella pneumophila
MGSLRKHQPGKTTDLLMSPFLRLQQEVNHAMSDFYNLFDPQRSANLEQFEHISLTPSLDIVEDKDNFKIEVEMPGMGEEDIKVSFCENRLTIEGEKTTSKKDENKNYISREISYGRYERTISLPLSADVDKATASFKKGMLWITIPKKTEARENVKTIKIEKAK

SEQ ID NO: 3447 - protein, 330 aa, Triticum aestivum
YNKFVQKSRLVPVRNSRDIVDPRVRLTEGYYVMDPKKAVEMVDENTICVAAILGSTLTGEYEDVKLLNDLLVAKNKETGWDVPIHVDAASGGFIAPFLQPELEWDFRLPLVKSINVSGHKYGLVYPGVGWVIWRSKADLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLTDINKIVGELDAHAVHAIKLSTAAAAEGASKSTVDAVTEAFKGLAGNKKAGVC

SEQ ID NO: 3448 - protein, 160 aa, Oryza sativa
MSLIRRSNVFDPFSLDLWDPFDGFPFGSGSRSSGTIFPSFPRGTSSETAAFAGARIDWKETPEHVFKADVPGLKKEEVKVEVEDGNVLQISGERSKEQEEKTDKWHRVERSSGKFLRRFRLPENTKPEQIKASMENGVLTVTVPKEEPKKPDVKSIQVTG

SEQ ID NO: 3449 - protein, 495 aa, Escherichia coli
DRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 3450 - protein, 680 aa, Desulfitobacterium hafniense
MSEFTHLFKPIKVGSLTLRNRMITTSMSPGHGYTTDDNKPTQVFLNYLEERSKGGYALICQSVAFYPRQSRHPLPNAYAPEHLPHLRAMAEAVHKHGGLLVGQALALHDWRRNTNEPEGHFGPSDIQILKGVGPFQTMTKEDIKTYATQVANCGKILQAAGWDGIELLAGVGGVLSRFLSKATNNRTDEYGGSVENRCRFAMEVVQAVKEACGQEFPVLIRWSPVDYVKNGNEIEDAKQIVPYLEKAGVAWHNLAVGWHESSVPLTTKEIPDGHWSWIAAEIKKVATIPVVTGYRETDPLVMEKVLAEGKADLIGGVRYCIADPEFPNKVREGRLEDIQMCITCCRCLDEMAAGHGLEYCSVNPRLGPELLTPVEPVARPKKVMVVGSGPGGLAAALTAAKRGHQVTLYERGPRVGGCLVMSAIFSPTYERLTRYYKAQLSKTPNIQVKLNTLVTPELVRSEKPEAVIIAVGGHPVDLKAPGVERGDVVRSHDFLEMLNGKPPQKPGLINKVMWNGGAVFLRLFYSPKLVRSLMGMPWPFGKRVAIIGGGLPGCELGQELLAHQRKMAILEERKKIGYDVGASDRFHVVSKFKKSPDVQMEPSTKVLAITAEGVKFRREDSTEAIYPADTVAVTLGFEKNLELADRLKGKVPILKVIGDCEDPKRMADATKKGYRAAMEL

SEQ ID NO: 3451 - protein, 289 aa, Bifidobacterium longum
MTNGHINPANVPDIALKDGHSIPQVGLGVLRIDDEGVVPVVESALEAGYRHIDGAAGYNNEAGVGRALAASGYNKGTKRETLWVTTKLRDSQQGYDSALKAFDNSLKLLQLDYVDMYMIHWPTPFDWRSTDTWKAFVKLRDEGMARTLGVCNFMPADLKRLHEETGAWPAVNQIELHPTWQQREVVAFCKEHGIAVEAYSPMARGADLNAGDGTIEKIAAAHEVSPAQVILRWHIENGTIIIPKSVHADRQKENLNLFGFALTADEHAAIDALDGPTRAGHDPLTFTYA

SEQ ID NO: 3452 - protein, 148 aa, Alkaliphilus metalliredigenes
MDLTMKICYNDIRIKKERGYFMKYKMLHTCIRVMDLEKSLRFYEDALGLVEKRRKDFPEHEFTLVFLSDEAGHYDLELTYNYNQDQSYEIGNGFSHIAVSVDDLEASQERHRKMGYKVTKLTGLPGSPPRYYFVTDPDGYDVEVIRAD

SEQ ID NO: 3453 - protein, 367 aa, Saccharomyces cerevisiae
MSSSAPKYTTFQGSQNFRLRIVLATLSGKPIKIEKIRSGDLNPGLKDYEVSFLRLIESVTNGSVIEISYTGTTVIYRPGIIVGGASTHICPSSKPVGYFVEPMLYLAPFSKKKFSILFKGITASHNDAGIEAIKWGLMPVMEKFGVRECALHTLKRGSPPLGGGEVHLVVDSLIAQPITMHEIDRPIISSITGVAYSTRVSPSLVNRMIDGAKKVLKNLQCEVNITADVWRGENSGKSPGWGITLVAQSKQKGWSYFAEDIGDAGSIPEELGEKVACQLLEEISKSAAVGRNQLPLAIVYMVIGKEDIGRLRINKEQIDERFIILLRDIKKIFNTEVFLKPVDEADNEDMIATIKGIGFTNTSKKIA

SEQ ID NO: 3454 - protein, 429 aa, Arabidopsis thaliana
MESLPQPQNQSSPATTPAKILLGKYELGRRLGSGSFAKVHLARSIESDELVAVKIIEKKKTIESGMEPRIIREIDAMRRLRHHPNILKIHEVMATKSKIYLVMELASGGELFSKVLRRGRLPESTARRYFQQLASALRFSHQDGVAHRDVKPQNLLLDEQGNLKVSDFGLSALPEHLQNGLLHTACGTPAYTAPEVISRRGYDGAKADAWSCGVILFVLLVGDAPFDDSNIAAMYRKIHRRDYRFPSWISKQAKSIIYQMLDPNPVTRMSIETVMKTNWFKKSLETSEFHRNVFDSEVEMKSSVNSITAFDLISLSSGLDLSGLFEAKKKKERRFPAKVSGVEVEEKAKMIGEKLGYVVKKKMMKKEGEVKVVGLGRGRTVIVVEAVELTVDVVVVEVKVVEGEEDDSRWSDLITELEDIVLSWHNDIM

SEQ ID NO: 3455 - protein, 170 aa, Brassica napus
DLDDSSTVSGDASVSSTGNQNPPPQSAVKKKRNLPGMPDPDSEVIALSPKTLMATNRFVCEICSKGFQRDQNLQLHRRGHNLPWKLRQRSSKEVRKKVYVCPVSGCVHHDPSRALGDLTGIKKHFCRKHGEKKFKCEKCSKSYAVQSDWKAHSKICGSKEYRCDCGTLFS

SEQ ID NO: 3456 - protein, 434 aa, Psychrobacter arcticus
MLESADQTDDLIDSVADESVLNNESAVINTDIPAEVAQVSLNAISPETLKTFVTLIDLVRREYVDTVNDEELFNNAMSGMLTKLDSHAEFLDAEAYENLRAFTEGDVGDIGIKVEYQSALGYWVITEVLDDSPADKKGIAVGDYLHQVDEFKLGEDEESNDIEQLLTGIAGTQVDVVTSKAGRRKHITTLQRNSSHPQIIETRFVDGMAVVRLPAFQNNSREKLLQSLIDLNKPVTGILLDLRDNPGGVLASAVSVASLFMTDTDVVQIKSRQADSRTLSTKGAALFKSLPVVVLQNRYSASAAEVLTSSLQAQKRATILGEISYGKGSVQSVIPLNDAQAVKLTVANYMTALGKKIDGIGVEPDVALSGSESTWEEQALNLLRKKALTSGIQFVYRAALEDLSKKKSDPKNSVIKNNTVINNVIEKPTFKEKS

SEQ ID NO: 3457 - protein, 492 aa, Yarrowia lipolytica
MSGKRVPTYTTTNGNPVKDPLASQRIGKHGPLLLQDFALIDLLAHFDRERIPERVVHAKGSGAYGEFEVTDDITDLNCADFLSKIGKKTKTFTRFSTVGGEKGSADAARDPRGFATKFYTDEGNIDWVYNNTPVFFIRDPSKFPVFIHTQKRNPETNLKDATMMWDYIANNQECCHQIMVLFSDRGTPANYRQMNGYSGHTYKWIKKDGSFNYVQIHMKTDQGIKNLTNDEAVALSGTNPDHAQEDLFNSIKSGSFPSWTCYVQVCTPEQAEKLKWSVFDLTKVWPHDQFPLRRFGKLTLNKNVQNYFAETEQAAFSPSNTVPGWETSADPVLQSRLFSYPDTQRHRLGTNFAQIPVNCPYHAHTPYHRDGQMAVNGNSGSLPNYPSSFEPLQYRQDINLHEKHEKWVGEAVAYQWVVGTDGVDFQQPAELWKVLGKTPDQQEHLVYNIAVSLSGARPEVQDKTFGMFDKVDAHFGKLVRDATLQRSPRSKL

SEQ ID NO: 3458 - protein, 318 aa, Unknown
  Synechocystis sp. PCC 6803
MLNPLNIEYLYLSKLFDNSLIVFNKRQLFRFFVRFFFMTAALPNDSKPKLTPAWTVIFFFTSIHLVALLAFLPQFFSWKAVGMAFLLYVITGGIGITLGFHRCISHRSFNVPKWLEYIFVICGTLACQGGVFEWVGLHRMHHKFSDTTPDPHDSNKGFWWSHIGWMMFEIPAKADIPRYTKDIQDDKFYQFCQNNLILIQVALGLILFALGGWPFVIWGIFVRLVFVFHFTWFVNSATHKFGYVSHESNDYSRNCWWVALLTFGEGWHNNHHAYQYSARHGLQWWEVDLTWMTIKFLSLLGLAKDIKLPPETAMANKA

SEQ ID NO: 3459 - protein, 1683 aa, Colwellia psychrerythraea
MIKLNKSSFIVFFFLQSFFLQNGMAENLPTDLVTWAHANPVVHIGVDGTFPPFDYIDEQGVTAGAGKLIRQQLSAILPVDLQETSVSDFRLEYDDMLRGNIDAISVCGNIEQRRDEVLFTKPFLQMTPIVVVNKNSDIKSEMDITSELKIASIAGYADANFAKQLSVNSKGLSSNLQGYQSIESGKYDVFITYLYLYKYMLKKHDFKNIKPIAISQFESLPIGFCVNKNKPQLVGLLNWGIDQLGDDFILAMQSKWAESSLDEGQNSRAHIDKSISLTSVFIYAVIFVLLALFFARKFASTIAIKLDTLAFRTTYFTVLILIISLSTGGIYLFLNDFKDQLLIDQKETFNVTRDVTKKTLAGWYRERELLAHNIAKSKSFKRLVNQLVIASEIDDTIKLAQAKKALRVYFSKRPYTTQGGRAYTITDVQGRYLLNLVQSAEGKKSPIISQRPELFNEVLMGRTEFIPPVWANVNIDGNRNAEDKDAEVFIATPVRNEQQEIIAVLGFRFDPDREFSQLFIDGRLGKSFESFAVDSRGYMISSSRFTSELQQKGIVPAGESTVLNVRLQNPETNPIVQAAKFKLNGQNLHGYTNYRGKTVVGQWISLKNSNITVVSEIELSEMLAEYYDVRNLLLIGLIISSAFILSISIFMITISNRANDISRRSQQELAEQVTIRTKELAASEQKSKLINSSVADGILGVDKLGHFIFANESATKITGYSEEQILSSDLISLFAGDNKENLTFEDTEVYKAIQSKEVIRISNEYVLMSGARELPLEYSISPVEDDESELACVIALQDITLRVQETERLEKMLEHLPVCMVIMNQNDEVEQINQTGIELLGFERDEIVGNPVDLFIPQEQVESHKALLKKFFQEETVIDTRSLERDFKVKHKSGKLIEIQAVYTPVHFHNGLYAAVMVRDITLDRQAEFALLEAKRISDDASKAKSDFLANMSHEIRTPMNAIMGMSHLALGCELDRKPKNYVTKVYKAAESLLGIINDILDFSKIEAGKLDIEVIEFSLHDTFADLANIIGLKAGEKNLELLFDISPDVPVNLKGDPLRLNQILINLAGNAVKFTEQGQVVISVNVVTNVSTSHCDDINLEFSVKDSGIGMDDEQQKKLFQSFSQADSSTTRKYGGTGLGLTISKKLVELMNGQIWLESKAGEGSCFSFTTTLQVSDVIDNRLVEQQKSFLADKRILIVDDNLLALDVLSSILKSFHCHVVAANSGEEAIELVKQATLTFDFIMLDWNMPDLDGIETYHIIKSQNNYQDNQFILVTSNANDNEAVDQLKKRINSVLVKPVTSSSIFDEMMRLNGDEAYSNTREMKRDDELIQNQQHLSGAKILLVEDNELNQELALELLKQSNIDVELAENGAIAVEKFSSRHFDGILMDLQMPVMDGFTATKIIRESDSSIPIIAMTANAMVSDKEKVLASGMNDHITKPINVNTMFATIAKWVSPSIKLDHDIDKAKLSVYTLPEKVISIPDFNTINTSAGLAVANGNKSLYVKLLGRFVSGQDDFVERFKVAMLKQDKEEVTRFAHTLKGSAGNIGANALQGYADQLELVCANDANTDELVNLLDQVTEELTLVLNELTEYLAKENSVESTAPINDFNFNEEFTVQLAQLLELIENFETESIELAEDILNQLKGTKQEALFEKIYQQIESYEFTEAETALNEFIDVLNN

SEQ ID NO: 3460 - protein, 368 aa, Synechococcus elongatus
MSESLKLLTPVQVGRYELRNRIVMAPLTRNRATGPDNIPNDLNVLYYQQRASAGLIITEASQISPQGQGYPLTPGIHSPEQVEGWKPIVQAVHDRGGCIFLQLWHVGRISHPSLQPDGALPVAPSAIQPAGMAATFQGEQPFVTPRALETEEIAGIVEDYRRAAENALAAGFDGVEVHGANGYLIDQFLQDGTNQRSDRYGGSFENRSRFLREVLDAVISVWGSDRVGLRLSPWGQFNDMRDSDPVGLFSYVAQMLNPYNLAYLHWIEPRWDKAEESPEFNQMATPVFRSLYNGPVIAAGGYSRSTAEAAIASGAADLVAFGRLYISNPDLVERFALDAPLNPYDRNTFYGGDEHGYTDYPSLEAASV

SEQ ID NO: 3461 - protein, 1519 aa, Unknown
  Azoarcus sp. EbN1
MPFRILRSPRSVRCVPRAGSGRQTGSDSFDSALMTAIADIPAEQTASASTVGPVALSSRIVVLAAMYIAVGLFARALTQSSGYSSPVWPAAGFALAALLVWGARCWPGVWLGAFVIVLLPDRTTSGALVAALGASGMTLQALLGVCLARRCLRSSSFPARNRDIARLVLLTGPLASLVASSIAVAALLAFERIAPAAGPSEWLTWWAGDTLGVLLFAPLVLLAWPGPLRGWIRRSGGGRISILLVLAAALFSAGSFTVDRLWKERERTEIAQRMDEVFEIGFLLLPEVIASLEGVERFVSASSAVTRDEFETFTVWITRHPAVVSIDWAPRVLAEERESFERAVRAEGGRDFRIFEPGDDGNTRPATGRPEYFPVLYSAPREAGRSILGLDHGYDPHRRVAMEQARQSREAHTVRGVPLLRTKRLSLLVFQPVHDVARASWDAAARAGPRDLLGHVVGVFDVEKLFIPLAEAAHTRSIGFRVSDVTSGEPAQILLDEMPAGVAPTLRKEIGFGGRTWSLELAAKAPTGYVDTHGEEEIYLAFSVLAAVLVAYIALSNAGHTAAIQREVAEQTAELTRALDARLAAEDERDRIFEQSVDLLGIVGIDGYFKRVNPAFARTLGWSNEEFLSRPYLDFVHPDDVEGTRADAARVAAGHTTVGFENRYRCKDGNWRWLEWKAVPRTGGLMFVTAIDTTQRRENARHLRTLNAELVHRVDEREAALEALGAKKDEIRAVLDNLIECVVTINAQGIVQGANAAVEAVFGYPLGEVIGRNVSLLMPSPERERHDDYLARYLDTGARHVIGSTREVEGQHKLGHRIPMELSVAEYRVRDEQFFVGTLRDISERKAFIAALTRAREDAEQASRAKSAFLAAMSHEIRTPMNGVMGLIEVLARTSLSEHQADLVATICGSSSTLLRIIDDILDFSKIEAGRLKLDVRPVSIGDLVESLAGSLLPLAARLDVDLSVFVSPEVPERVEADEVRLRQVLYNLVGNAVKFSAGRQNVRGRVAVRVAVADVVPLQLAVSIVDNGIGIDPEKVEELFNPFTQAEASTTRRFGGTGLGLAICRRLVDLMEGGIKVRSEPGQGSTFTVTIPFVLSDEQPAPILPEVRGINCVVIDSPEINSEDLRVYLEDAGASVFRVDDEAAAGVKAASLAAPVVLIDFAREGKNTETDGTVPASGAARVRITRGRRRRPRIKDRQVVMLNGNALRRQSLLRAVAVAAGRASPEIIHAGTAERAVLPSTTAPTIDEAREHGRLILVAEDDPINKKVILEQLALLGHAAEIAGDGAEALEMWRRGTYALILTDLHMPKMDGYRLTEAIRQAEGEAARIPIVALTANALQSESRRAREAGMDEYLTKPVRLEVLGAHLDRWLPRQETALAETAQVPPDAAPDAVACTLPILDVSVLNGLIGDDPQVIREFLGDYLASTRSLAAETRTAFSDGDRGAVAASSHKLKSSSRAVGALALGDLCNRIESAVITGDRVAFEQEMSRYDDVVRTTETHVIKLLNEPISAAGGTQ

SEQ ID NO: 3462 - protein, 397 aa, Clostridium acetobutylicum
MCGIAGFVNFKKNLIDKKSIIEDMTNTLIKRGPNEKGYYISKNALLGHRRLIVVDPKGGSQPMIKIHNGKKYIIVYNGELYNTEDIRKELLEAGYEFSSYSDTEVLLTSYIHWKEDCVNHINGIFAFAIYSETDKKIFLARDPLGVKPLFYTIKNNNLIFGSEIKTLLANPLVEPILTKEGLTEIFALGPARNLGSGVLKDIHEIPPANFIEFTEHKFKLHEYWRLSCKPHTENASETAEHIKFLLTDAIKRQLYADVPVCTFLSGGLDSSIISAVAASEFKKHGKTLNTYSIDYKDNNLYFKNDNFVITPDSVWAEKMRKFIGSNHHKIINNNLDLASALYDAVKANDIPGMADIDSSLFLFCKGVAEKNVVSLSGERAIQMITNLVKQFINIGEL

SEQ ID NO: 3463 - protein, 441 aa, Rickettsia prowazekii
MLLRFIIALFLSINCAIEGKETENKISNQEAYKQFQDVFERIEKDYVQVPDRQKMIDEAINGMLNSLDPHSNYYTDEDLEDIFTFTKGEFGGIGVEIMYDSGAIKIISSIDDLPAFKAGLKGGDYIVGVNDELVSTLGPNKAIKEMRGTPGTKVRLLIIKEEEAKPQELELTREIVKIKPIKAHLEKNNIAYIRITTFNESTISELKAAVKKLKTESKDNLKGIILDLRNNAGGILDQAIAVSDYFIDSGVIVTTKGRTTSSNSETKANEFSLKAPKVPMIVLINGNSASASEIVAGALQDHKRAIILGTKSFGKGSVQALTQINSRAAVKLTISKYYTPSGRSIQAEGIEPDILIEPAKVEYPEVKKIDKRFSESSLKNYLKNDNAKNKDSNKETKTKNNKQEESELSELYKKDYQFARAYDVITGLIINTNLETQGKAK

SEQ ID NO: 3464 - protein, 279 aa, Bacillus cereus
MKNLQSKAVLNNGVEMPWFGLGVFKVEEGPELVEAVKAAIKAGYRSIDTAAIYGNEKAVGEGIRAGIEATGIAREDLFITSKVWNADQGYETTIAAYEESLKKLGLDYLDLYLVHWPSEGKYKDTWRALETLYKEKRVRAIGVSNFQIHHLQDVMKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 3465 - protein, 480 aa, Bacillus subtilis
MNQKIMAVIAAGSMLFGGAGVYAGINLLEMDKPQTAAVPATAQADSERDKAMDKIEKAYELISNEYVEKVDREKLLEGAIQGMLSTLNDPYSVYMDKQTAKQFSDSLDSSFEGIGAEVGMEDGKIIIVSPFKKSPAEKAGLKPNDEIISINGESMAGKDLNHAVLKIRGKKGSSVSMKIQRPGTKKQLSFRIKRAEIPLETVFASEKKVQGHSVGYIAISTFSEHTAEDFAKALRELEKKEIEGLVIDVRGNPGGYLQSVEEILKHFVTKDQPYIQIAERNGDKKRYFSTLTHKKAYPVNVITDKGSASASEILAGALKEAGHYDVVGDTSFGKGTVQQAVPMGDGSNIKLTLYKWLTPNGNWIHKKGIEPTIAIKQPDYFSAGPLQLKEPLKVDMNNEDVKHAQVLLKGLSFDPGREDGYFSKDMKKAVMAFQDQNKLNKTGVIDTRTAETLNQQIEKKKSDEKNDLQLQTALKSLFVN

SEQ ID NO: 3466 - protein, 497 aa, Burkholderia mallei
MFRQLFIGALPLSSSISIAPAVVWFCDDLRVSDHPALMRAAESGRPVIGVYVFDERAGGRPLGGAARWWLHGSLRALGAALAALGGTLALLRGDEHDTIVSFAAALGAGAVYWSRRYALAARAVDNAVQTALDAQGIAVETFNASLLFEPGDLVNADGRPYQVFSAYWRAAMRRGVPAPPLGAPRRLNGGALPAALARQCVALDALGLEPTGPDWAGGLRDAWRFGEDAAHRRLRAFVDSRLGGYAAERDRPGIASTSRLSPYVRFGNLSARQLWHAAADAYAHGAATQADLDKFLSELGWREFGWTQLHHFPDLPRRNLRHTLDGMPWRDDPAALAAWRRGATGYPFVDAGMRELWATGWMHNRVRMVCASFLVKHLLIDWRAGEAWFWDTLVDADAASNAANWQWVAGCGADAAPYFRIFNPVAQGRKFDPDGAYVRRWVPELAGLPPATIHEPWAAPGAQLAAAGVRLGETYPLPIVAYDAARRRALDAFGAIR

SEQ ID NO: 3467 - protein, 483 aa, Oryza sativa
MREEARTMVATRSTTSRRCLTWWWLACCCFVSWVASSSWTAAACVAVSSLPGFDGPLPFSLETGYVEVNESTGVQLFYYFVRSEKNPDLDPLLLWLTGGPGCSSISGLAHEIGPFQFAAKRYYSGGLPIIIYRPETWTKVSNIIFVDSPVGAGFSYAATEEGSKSSDTNAVKQLLIFLRKWLHDHPRFSLNPLYIGGDSYSGMIVPTLTLAIDESNGSEEKPFFNLKGYIAGNPVTDYKIDEDGRIPFLHGMGLISDELYEHAKETCGEKYSAPSNAQCAHSVQAINDDINRGHILEPLCEELQSPIHNTAARDVMSRLMLESRPAAADDDIIIFECRKASHVLLKIWANDETVRESLGVQKGTVGEWKRCNRDIDYNSDVRSTVEYHLTLMRKGYRAIIYSGDHDSRVPSISTQAWIRLLNLSIADDWRPWYVDGQVAGFTRSFASNNLTYATVKGAGHTAAEYKPKECQEMFARWISGTPL

SEQ ID NO: 3468 - protein, 193 aa, Brassica napus
  misc_feature (162)..(162): Xaa can be any naturally occurring amino acid
  misc_feature (167)..(167): Xaa can be any naturally occurring amino acid
MEEKKAESTNKNVKKANLLEHNSIKHILDESVSDIVRSRGYKEDVRLSNLKLILGTVIIVVALVAQFYNKKFPENRDFLIGCIASYVVLNGVLQLILYTKEKNAILFTNPPEGSFTSTGLVMSSKLPRFSDEYTLTIDSADPKSISAGKSVQLTKSVTQWFXKDGVXVEGLFWKDVEALIKDYAEEGEPKKKK

SEQ ID NO: 3469 - protein, 1102 aa, Desulfotalea psychrophila
MKEFRNGWNRASVWLTIILGLLLSGIMAYINYQQVSENTIAQFQREADRQAAAIRRDIEVDLSILTPAVAFFDASHLVERYEFRLWFQSVKVVDNSLDVLGWIPRVANSQRAKFVDEARAVGLSGFRFSELQNGKLVRAGVREKYFPVFYIEPTGVNGAAFGFDLSSEPKRRTMLMQARDSGKVTASQVIHLVQHKKKRFSFLVVAPVYQGLASTIAERRETLRGFVVAAFAVDTIGERALAQIDPGQFHIMMHIHDGAELIYPAGGKCPGEQYFKEGIRTSGLHVIREIAVAGRQWRVCLSPSEAGQIQGFPPSAMAVFIVGIVLTVLLALQFRNNALRTSEIEWQVAEKTAQLRKSELRAEAIIDKAVIPIITIDETGIVQSFNRSAEKMFGYGPEEIIGRNVRMLMPEPHRSSHNKYVDHYLKTGRMKAIGVGNKLTGVRKDGVEFPMHLSVSEVRLEKRIFVGMVVDLSEINRAEEALRKHRDNLARLVEERTYELKIAKEAAETANIAKSAFLANMSHEIRTPMNSVLGFIQITLESRLLCAELRRHLETAYSSAKGLLIIINDILDVSKLESGEFALEATCLDMPRIVQEALKTVESQAEEKGIGLDFHFDADLPHCYLGDPTRLGQVIINLVGNAIKFTKTGKITIGVRASDQGDASLHFSVADRGIGMTAEQAANIFNPFTQADISTARCYGGTGLGLTISKQLVELMGGRIWVESELGRGVTFHFTAQLPVISPCRATGVDHALTGEASSPESPRRFQILLAEDVPGNATLAQLRLEQQGHRVRHVWNGSQAVEMYKGGTFDLILMDVMMPEMDGIEATRKIRALERESKGHITIIALTASIMKEDRQRYMRAGMDAVVGKPIILEGLFATMERVVPKGIGSLNEETFPGDQARQDIDLTPLADVVDIDRGLASWRDPLVFAKSLASFADRHSADAEKIQQLLDENSKEARMISHTLKGLAGNLSLPEVARLATEINAALKAGSHEPAATLLPSLQAALKNAAVVIRKLKMPVARIATPEFDSKAVSSLLQELLIMLDQDDPVVAEPGLSKLGEYLTQDDMINIRRAIDAFDFARAKSQTRILAERLGIQLEG

SEQ ID NO: 3470 - protein, 479 aa, Bordetella bronchiseptica
MTNKTLTTAAGAPVADNNNTMTAGPRGPALLQDVWFLEKLAHFDRERIPERVVHAKGSGAYGTFTVTHDISRYTRARIFAEVGKQTPLFLRFSTVAGERGAADAERDVRGFAIKFYTDEGNWDLVGNNTPVFFIRDPLKFPDFIHTQKRDPKTNLRNATAAWDFWSLNPESLHQVTILMSDRGLPQNYRQQHGFGSHTYSFVNDAGERFYVKFHFKSQQGIACYTDGEAAELVGRDRESAQRDLFQNIEQGQFPRWTLKVQVMPEAEAATYHINPFDLTKVWPHADYPLIEVGVLELNKNPENYFAEVEQAAFTPANVVPGIGFSPDKMLQGRLFSYGDTHRYRLGINHHQIPVNAPRCPFHSFHRDGMGRVDGNGGATLNYEPNSFGEWREAKHAAEPPLALDGQAADRWNHRVDEDYYSQPGALFRLMNDDQKQQLFGNIGRHMAGVPEEIQRRQLEHFRRADPAYAAGVAKALGLK

SEQ ID NO: 3471 - protein, 492 aa, Lycopersicon esculentum
MDPYKYRPSSAFNSPFCTTNSGAPVFNNNSSLTVGARGPVLLEDYHLVEKLANFDRERIAERVVHARGASAKGFFEVTHDIAHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLHMFTFLFDDIGIPQDYRHMDGSGVHTFTLINRAGKSTYVKFHWKPTCGVKSLLEEKAIRVGGANHSHATQDLYDSIAAGNYPEWKPSIQIMGPEHEDKFDFDPLDVTKTWPEDILPLQPVGRLVLNKNIDNFLYMNEQLAFCPSIVVPGVYYSDDKMLQTRIFSYSDTQRYRLGPNYLQLPANAPKCAHHNNHYDGSMNFMHRDEEIDYFPSRYDQVRHAEVYPIPSTVCSGKREKCIIQKENNFKQPGERYRSFTPDRQERFIRRWVEALSDPRITYEIRSIWITYWSQADKSLGQKLASRLNVRPSI

SEQ ID NO: 3472 - protein, 334 aa, Aspergillus nidulans
MSLGKKVTLNTGAQIPQLGFGTWQSAPGQVGEAVYQALKVGYRHLDLATIYQNQREVAEGIKRAYKDIPGLKREDIFITSKLWNTQHDPAVVEKALDDCLAELELDYLDLYLVHWPVAFKTGDNYFPLDESSDHPDGDVLIDDSISIVDTWKAMTKLPKEKARAIGVSNHTVEHLEAIINATGVVPAANQIERHPVLQSNDLIEYAAKKNIHITAYSAFGNNMFNIPLLVAHPEVKAVAEEASKRLGKTVTPAQVILNWSQEGGHSVIPKSVTASRIAENFQEVELTKEELAKVSKLGEERRRYNTPYVANKPRWNINIFGEEDEKPAKHKVIV

SEQ ID NO: 3473 - protein, 576 aa, Gibberella zeae
MAPSADTSFSAHVASQFQSYEEDRQSASKESTYATSNGVPVAHAYEAQRCGENGPLLLQDFHLIDLLSHFDRERIPERVVHAKGSGAHGFFECTDPLDDLCLADIFSAKGKKCPVSMRFSTVGGESGSHDMARDPRGFSVKMRTEEGNLDWVFNNTPVFFLRDPAKFPHFIHTQKRDPSTHLTHADDSFAFWDYLSQNPESIHQVMILMGDRGIPKGYRKMHGYSGHTFKLVNKAGDWVYTQIHLKSMQGTDFVTQEDSADYSPDFSQKDLYEAIQNGDYPKWTLEVQTMTPKEAEELWEKEKINVFDLTHVWPQKQFPRRKVGEFTLNENAINYFAEVEQIAFNPAHLPPGIEPSADPVLQSRLFSYPDTHRHRIGVNYQQLPVNATRTGYKFGNFQRDGQMAFYNQGARPNYLSSIDPIKFRTRTVDLDKTHGHFTGEAITFLTAIRPEDFNAPRALWRNVFDEPARERFINNVTGKMKLCKQEEPLKRQIAIFREVDPEIADRLEKSTGIKGYDGIADMKFNGSHNCMNGEMKLANDIIANKGKSATARNGAPAKGCHSRLETNGHLNGTNGK

SEQ ID NO: 3474 - protein, 546 aa, Lactobacillus acidophilus
MAKDIKFAENARRSLLKGVDKLADTVKTTIGPKGRNVVLEQSYGNPDITNDGVTIAKSIELKDHYENMGAKLVAEAAQKTNDIAGDGTTTATVLTQAIAREGMKNVTAGANPVGIRRGIEKATKAAVDELHKISHKVESKEQIANVAAVSSASKEVGELIADAMEKVGHEGVITTEDSRGINTELSVVEGMQFDRGYLSQYMVTDNDKMEADLDNPYILITDKKISNIQDILPLLQEIVQQGKSLLIIADDVTGEALPTLVLNKIRGTFNVVAVKAPGFGDRRKAQLEDIAALTGGTVITDDLGFELKDTKIDQLGQARRVTVTKDSTTIVDGAGSKEAIKEREDSIRKQIEESTSDFDKKKLQERLAELTGGVAVIHVGAATETELKERRYRIEDALNSTRAAVDEGYVAGGGTALVDVEKAIKDLKGETSDEQTGINIVLRALSAPVRQIAENAGKDGAVVLNKLESQENEIGYNAATDKWENMVEAGIIDPTKVTGKVTRTALQNAASIAALLLTTEAVVADIPEDKPEAPQAGAAGAPGMGM

SEQ ID NO: 3475 - protein, 463 aa, Novosphingobium aromaticivorans
MHAHSRKAPRAMKSASFKFAGLLRVTALVSAVALIPATTAGLAAVDARTGPEFGKLIAVYERVKANYVEPVDDEKLLKGAIDGMLATLDPHSSYLDARDFENLRTQTEGSYGGLGLSVTMDDGAVKVIAPTKGSPADLAGVKAGDFITHLDGKLIYGGSLDEAVDQMRGVPGTKIRLSVFRPGRDEPFDVTITRQIIELKPVEWEMRGNVGVISVSSFSADVGTSVQKAWNEIRARSGGKVAGLVLDLRGNPGGLLDEAVALSDLFLDKGTIVSQRGRYARDNEVYPAEIDTKGDIAKGTPMIVLIDEGSASASEIVAGALQDQHRAVVMGQRSFGKGSVQTLIPLTRDTAIKLTTARYYTPSGRSVQEGGIEPDIAVPQISDPDLRKRQLRSYRESDLRGHLINEIKLEDKDLEKDKTEDPRFKMTAEELKAKDIKDFQLYYAVQTLSRTAPRGALAAKVKG

SEQ ID NO: 3476 - protein, 95 aa, Brassica napus
GAMYSFPQIRLPPGALQAAKQAGKVPDVFYCLKLLEATGISTVPGSGFGQKEGVFHLRTTILPAEEEMPEIMDSFKKFNDEFMAQYDNGFGYSRM

SEQ ID NO: 3477 - protein, 460 aa, Arabidopsis thaliana
MLSSKVVGDSHGQDSSYFLGWQEYEKNPFHESFNTSGIVQMGLAENQLSFDLIEKWLEEHPEVLGLKKNDESVFRQLALFQDYHGLPAFKDAMAKFMGKIRENKVKFDTNKMVLTAGSTSANETLMFCLANPGDAFLIPAPYYPGFDRDLKWRTGVEIVPIHCVSSNGYKITEDALEDAYERALKHNLNVKGVLITNPSNPLGTSTTREELDLLLTFTSTKKIHMVSDEIYSGTVFDSPEFTSVLEVAKDKNMGLDGKIHVVYSLSKDLGLPGFRVGLIYSNNEKVVSAATKMSSFGLISSQTQHLLANLLSDERFTTNYLEENKKRLRERKDRLVSGLKEAGISCLKSNAGLFCWVDLRHLLKSNTFEAEHSLWTKIVCEVGLNISPGSSCHCDEPGWFRVCFANMSDQTMEVAMDRVKGFVDNNNGGKQKRTMWDTRRRSLINKWVSKLSSVTCESER

SEQ ID NO: 3478 - protein, 386 aa, Oryza sativa
MDSSSGGAGGGGGAQIKGMGTHGGRYVLYNVYGNFFEVSSKYAPPIRPIGRGAYGIVCAAVNSENGEEVAIKKIGNAFDNHIDAKRTLREIKLLRHMDHENSDGDFNTGSQIIAIKDIIRPPRRDNFNDVYIVSELMDTDLHQIIRSNQPLTDDHCQYFLYQLLRGLKYVHSANVLHRDLKPSNLFLNANCDLKIADFGLARTTTETDLMTEYVVTRWYRAPELLLNCSQYTAAIDVWSVGCILGEIVTRQPLFPGRDYIQQLKLITELIGSPDDSSLGFLRSDNARRYMKQLPQYPRQDFRLRFRNMSAGAVDLLEKMLVFDPSRRITVDEALHHPYLASLHDINEEPTCPAPFSFDFEQPSFTEEHIKELIWRESLAFNPDPPY

SEQ ID NO: 3479 - protein, 403 aa, Arabidopsis thaliana
MAWNSERSIRECINRRQVHGPSMLPTLNLTGDVILAEHLSHRFGKIGLGDVVLVRSPRDPKRMVTKRILGLEGDRLTFSADPLVGDASVSVLVKQHGIANLGLRVKRCMIDELGWSRRFRKVMFGFREITCMLQLIHVILGLYLTVSLKEKLFYGNHLFACLGLATRILWVIEMTIIYTYTFSNRRKAMVLILFLKPELQYQMLRFILLVSKKLLYEPTRSKEFIAKQSFKTEQTQRVAITRGSETMSLIPSIFGGRRTNVFDPFSLDVFDPFEGFLTPSGLANAPAMDVAAFTNAKVDWRETPEAHVFKADLPGLRKEEVKVEVEDGNILQISGERSNENEEKNDKWHRVERSSGKFTRRFRLPENAKMEEIKASMENGVLSVTVPKVPEKKPEVKSIDISG

SEQ ID NO: 3480 - protein, 414 aa, Arabidopsis thaliana
  misc_feature (47)..(47): Xaa can be any naturally occurring amino acid
  misc_feature (99)..(99): Xaa can be any naturally occurring amino acid
  misc_feature (125)..(125): Xaa can be any naturally occurring amino acid
  misc_feature (238)..(238): Xaa can be any naturally occurring amino acid
MATLKCIDWQFSGSEAAKDAAAASLGSYTSALYALCDPHGKPILPPXNEILETSNTAEKAVVKAVLYGSGNAYAPSLGLAAAKSAVAEYLNQGLPKKLXTADDVFMTLGCKQAIELAVDILAKPXKANVLLPSPGFPWDLVRSIYKNLEVRHYNFLPEKNFEIDFDSVRALVDENTFAIFIINPHNPNGNTYSEAHLKQLAELAKELKIMVVSDEVFRWTLFGSNPFVPMGKFSSIKXWKVPGWQPGWLTLHDLDGVFRNTKVLQAAQDFLQINNNPPTVTRAAIPDILEKTSSKFFQKLGNFMKDKVEFGSCKLKYIPSLTCCMKPEACTFLGTELDLSSFVDIEDDQDFCNKLAKEENLVVLPGIAFSQKNWLRHSIDMETPVLEDALERLKSFCDRHSNKKAPLKDVNGVK

SEQ ID NO: 3481 - protein, 613 aa, Moorella thermoacetica
MCGITGWVDWELDLTGQKNILEAMTATLACRGPDAAGTWVAPRVALGHRRLVVVDPAGGGQPMVRRRGNQTFVLTYNGELYNTGEIREELLSRGYTFRGHSDTEVLLTAYMEWGVECVRRFNGIFAFAIWDEARERLFLARDRLGVKPLFYATLPHSFLFGSELKALLAHPAIKPEVDAEGLAEVFVLGPARTPGHGVFHNLAELKPGYYMTYDRQGLRLHQYWALQSHPHTDNLETTIAKVRQLLQDTVERQLVADVPVCTLLSGGLDSSAVTVFAARAFQGRGQGHIHTWSVDYIDNDRYFQPSHFQPNPDAPWVKLVSEHLETIHHYVYIDTPELVDSLKAAMRARDLPGMADVDSSLLLFCREVKREATVALSGEAADEVFGGYPWFRSEKALAANTFPWNRAGQERIRLLSPELKAMVRPEEYVARRYREALAEVPALPGEEARAARLREISYLSLTRFMPVLLDRKDRMSMAVGLEVRVPYCDHRLVEYVWNIPWEMKFVGQMEKGILRRALAGILPAEVINRRKSPYPKTYNPAYLEAVRNWMLDILADPASPLLPFIDVAAVKALTQSREVFNLPWFGQLMSGPQLFAYLAQIDTWMREYGVSVR

SEQ ID NO: 3482 - protein, 591 aa, Bacillus subtilis
MTDTLSKRGPDDSNVWGEHHVLFGHKRLAVVDIEGGRQPMACTYKGDTYTIIYNGELYNTEDLRKELRARGHQFERTSDTEVLLHSYIEWQEDCVDHLNGIFAFAVWDEKRNLLFAARDRLGVKPFFYTKEGSSFLFGSEIKAILAHPDIKARVDRTGLSEIFGLGPSRTPGTGIFKGIKEIRPAHALTFSKDGLNIWRYWNVESEKHTDSFDDTVANVRSLFQDAVTRQLVSDVPVCTFLSGGLDSSAITAIAAGHFEKEGKAPLHTYSIDYEENDKYFQASAFQPNDDGPWIEKMTEAFGTTHHKCVISQKDLVDHLEEAVLVKDLPGMADVDSSLLWFCREIKKDFVVSLSGECADEIFGGYPWFHTADVESGFPWMRSTEERIKLLSDSWQKKLNLKEYVNAKYEETLAETPLLDGETGVDKARRQLFYLNMLWFMTNLLDRKDRMSMGASLEVRVPFADHRLVEYVWNIPWEMKMHDNREKGILRKALEGILPDDILYRKKSPYPKTHHPEYTKGVSEWLKTIRSQKDSVLHTLLDRKQLDQLLETEGSSFKVPWFGQLMKGPQLIAHLAQIHTWFEAYRIDIDER

SEQ ID NO: 3483 - protein, 505 aa, Arabidopsis lyrata
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALT

SEQ ID NO: 3484 - protein, 371 aa, Rhodopseudomonas palustris
MTKSKLFAPLQVGGLKLENRIVIAPMCQYSAREGQMTDWHLMHLGHLALSGAAMLTIEATAIAPEGRITPFDVGLWDDRTEAAIGRVIDAVRSWSSIPIAIQLSHAGRKASADVPWRGGRHLPPHDPDGWQTVAPSALPLSVGGRTPVALHAESLEQIRQGFAQSARRAARLGVDAVQLHAAHGYLLHQFFSPISNKREDEYGGSLENRMRFPLEVFEGVRAAFPTDRPVTVRISGADWIDGGATIDDAVAFAQALEARGCSALNVSSGGIDPLQRISDGPNYQVPFARAVKQAVSIPVVAVGLITDYEQAEAIIATGDADLVALARGILYDPRWPWHAAAHLDGRVRAPDQYRRSQPYQYKNLFDYRSED

SEQ ID NO: 3485 - protein, 546 aa, Psychrobacter arcticus
MMADDKTKSTQAERLVQLRRDKGMTAEQLAQAMTAAGAKVSRGAISNWERGTNGIVSSKLPTLARILGCSEGYLLRGELESDSKSDVDLKNIASDNTNVYVESDEQAHSASQITHTTTIPSTPRKISPNNLMSGPFMNTIKKSDKLQNVCYDIRGPLLQTANKMEAEGKRILKLNIGNPAPFGLEAPHEILRDVAMNLPEATGYSDSQGIFSARKAVLQYYQSKGLLSAVDVRDVYLGNGVSELIVMTLQALMNDGDEVLIPMPDYPLWTAATNLAGGTAVHYRCNEEDNWHPDIEDIKSKITSKTKGIVVINPNNPTGALYSDEVLLQIIEVAKEHDLIIMADEIYDRILYDDMEHTPMSTLTDEVLVLSYNGLSKSHRIAGFRAGWMMISGRKEHAADFIEGLDMLASMRLCSNVQGQYAIQTAMGGYQSMKDLTSKKGRLYKQRELAVTRLNAIKGISCTMPQGAFYCFPKMDPEIYPIKDDMQFMMDLLLEENVLMVQGTGFNWDKHDHFRLVFLPNLHDLEDAMDRLDRFFAKKRKQFGTD

SEQ ID NO: 3486 - protein, 140 aa, Arabidopsis thaliana
MASLEMNDLKKIGLGLTGFGVFFTFLGVIFVFDKGLIAMGNILFLAGVTLTIGINPAIQFFTKRQNFKGTISFGLGFLLVVFGWPIFGLLLESYGFLVLFSGFWPTLAVFLQRIPLLGWLLQQPYIRSLLDRYRGRRVPV

SEQ ID NO: 3487 - protein, 442 aa, Oryza sativa
MDSVVRTHIGHMLKMIHFCSMFLITFSDYKIQAILSSQQKRKAPEESDVAESSDCMITSPGFAVSPMLTPVSGKAVKTSKSKTKNNKAGPQTPTSNVGSPLNPPTPVGTCRYDSSLGLLTKKFINLLKQAPDGILDLNNAAETLEVQKRRIYDITNVLEGIGLIEKTLKNRIRWKGLDDSGVELDNGLSALQAEVENLSLKEQALDERISDMREKLRGLTEDENNQRWLYVTEDDIKGLPCFQNETLIAIKAPHGTTLEVPDPDEAGDYLQRRYRIVLRSTMGPIDVYLVSQFDEKFEDLGGGATPSGHANVPKHQPTEVFNTTNAGVGQCSNSVAVDNNIQHSQTIPQDPSASHDFGGMTRIIPSDIDTDADYWLISEGDVSITDMWKTALLNMETADVQWDESLDTDVFLSEDVRTPSSHNQQPSAVGGPQMQVSDMHKP

SEQ ID NO: 3488 - protein, 218 aa, Ipomoea batatas
MGRGKVEIRRIEKSTNRRVTFWKRRNGLLKKAMEMGILCDAEVGLMIFSSTGKLHEFATTSIRSVIERYNKTQGDGLQSPLDPTLELKFWQIKVAILRKQLHNMQEDHRKAMGEVYGLSVKDLLNLENQLEMSMSSIIMKKEQLLIDQILELTHQQRSIVLQENFELFNKFQAYGTSDPNAVNGDTISPYDFTISEESQGHIHFQLPQNFSDLARALY

SEQ ID NO: 3489 - protein, 338 aa, Ralstonia metallidurans
MTRISLTRYLVEEQRKHNTIEPELRLLIEVVARACKAISNAVSKGALAGVLGSAGTGNVQGETQQKLDVIANEVLLDANEWGGHLAAMASEEMDSFYEIPNRYPKGEYLLLFDPLDGSSNIDVNVSIGTIFSVLHMHKPGQTVTEHDFMQPGTQQVAAGYAVYGPQTTLVLTVGNGVHMFTLDREAGSFVLTQSDVMIPEDTKEFAINMSNMRHWAPPVRRYIDECLAGDEGPRGKNFNMRWIASMVADVHRILTRGGVFMYPWDKREPEKPGKLRLMYEANPMAFLVEQAGGAATNGQQRILDVEPTKLHQRVSVILGSKNEVERVTRYHQEDAAKA

SEQ ID NO: 3490 - protein, 545 aa, Borrelia burgdorferi
  misc_feature (200)..(200): Xaa can be any naturally occurring amino acid
MAKDIYFNEDARKSLLSGVEKLSNAVKVTLGPKGRNVLIDKKFGSPTVTKDGVSVAREIELENPFENMGAQLLKEVAIKTNDVAGDGTTTATVLAYAIAREGLKNVSSGINPIGIKKGIDHAVSLAAEKIRQSAKKITTKEEIAQVASISANNDSYIGEKIAEAMDKVGKDGVITVEESKTFDTTISYVEGMQFDRGYLXPYFSTNKENMSVSFDDAFILIYEKKISSIKELLPVLEKVLGTNKPLLIIAEDIEGDALAALVLNSVRGALKVCAIKSPGFGDRRKAMLEDIAVLTGGVLISEELGLTLETVEIEQLGQAKTIKVDKDNTTIINTGNKEQIKERSELIKKQIEDSTSEYDKEKLQERLAKLVGGVAVINVGAVTEVELKEKKHRVEDALSATRAAVEEGVVPGGGSTLIEVAMYLDTIDTSKLSYEEKQGFEIVKRSLEEPMRQIISNAGFEGSIYIHQIKTEKKGLGFDASSFKWVNMIESGIIDPAKVTRSALQNAASIAGLLLTTECAITDIKEEKNTSGGGGYPMDPGMGMM

SEQ ID NO: 3491 - protein, 237 aa, Gossypium barbadense
LTDDHCQYFLYQLMRGLKYIHSANALHRDLKPSNLLLNANCDLKICDFGLARTTSETDFMTEYVVTRWYRAPESLLNCSEYTAAIDIWSVGCILMEIIRREPLFSGKDYVQQLGLITQLLGSPEDSDLGFLRSDNARKYVKQLPHFPKQPFAGKFPDVSPLAIDLAEKMLVFDPSKRITVEEALNHPYLSSLHEINEEPTCPSPFVFDFEQMALNEEDIKELIWRESLNFNQDKMPE

SEQ ID NO: 3492 - protein, 471 aa, Lycopersicon esculentum
MLKMLSKMAMCKSHGQDSSYFIGWQEYEKNPYDPLQNPSGIIQMGLAENQLSFDLIESWLTRNQDVIQFRENGGSMFRDLALFQDYHGLQAFKNVLVSFMAEIRRKKVKFDPKNLVLTAGSTSANETLIFCLAEPGEALLIPTPYYPGFDRDLKWRTGAEIVPIQCYSSNNFRITESALEEAYEQAQKRNLTVKGVFITNPSNPLGTTMSRNELNILITFAMTKNIHIVSDEIYAGTVFDSPKFVSIIEALIDRKLEKSKMWNQVHIVSSLSKDLGLPGFRVGMIYSNNETLIAAATKMSSFGLISSQTQYLLSKILGDRRFIKRYVKQNKKQLIHRREMLASGLANSGIECLDSNAGLFCFVDMRDLLNSNTFEAEMELWKKIISNVGLNVSPGSSCHCSEPGWFRVCFANMSKETLDLAMQRINNFVNSDRDIHRQQPLRFVTGAGSRRRRTIANWVVKFSSGDGRRDR

SEQ ID NO: 3493 - protein, 227 aa, Glycine max
LCRYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 3494 - protein, 339 aa, Bacillus pseudofirmus
DQVLKKDGTPYKVFTPYYKAWAKERKRTPAVIKRDVLLGSVHKGTAPDREAETLFNNLIKKCSYDWSAIGEEHAIKRLQMFTKKRLSGYKANRDFPSITGTSRLSPYIKTGAVSSRSIYYHILNAEADSYSAETFLKELAWRDFYRMVHFYEPDCKDREIMEGYRELNWSHDQDDLTSWKRGETGFPIVDAGMRQLLNEGWMHNRLRMITASFLTKDLLIDWRLGERYFERMLIDYDPSSNIGGWQWAASVGTDAVPYFRIFNPVTQSKRFDENGTYIRTYIPELNHVPDHYIHEPWKMSEEEQVKYKCRLDEDYPLPIVDHSKQRKKALSFFKGDDEE

SEQ ID NO: 3495 - protein, 443 aa, Thlaspi caerulescens
MSESQQDSEQYPPSKRQYHPSVSSMKPPLVAPGEYHRFDAAETRGGGASDQLKRKTDMVNQIEEPNELNTGVLQTPVSGKGGKPKKSSRSVKSNKTGTQASGSNAGSPGNNFAQATCRYDSSLGLLTKKFINLIKQAEDGILDLNKAADTLEGTKETDIRYTNVLEGIGLIEKTLKNRIQWKDLDVSKPGETVESIANLQDEIQNLTAEEVKLDDQIRESQERLTSLSEDENNKRFLFVTEDDIKNLPCFQNKTLIAVKAPHGTTLEVPDPDEAGGYPQRRYRIILRSTMGPIDVYLVSQFEEKFEEIPNADEPSNLPSTSGLPENQDVAMPMEEDSSDKNMETQEVDDTQRVYSEIESHDFVDGIMKIVPPDLDMDVDYWLRSEVGEVSITDLWPNESGADWNQIVTFDQDHAGPSNTTLEQPRTPLSPAPENSTATKSTGS

SEQ ID NO: 3496 - protein, 477 aa, Lycopersicon esculentum
MGLISKIATNDGHGENSAYFDGWKAYENDPFHPTQNPNGVIQMGLAENQLCFDLIQEWIVNNPKASICTYEGVQDFQDTAIFQDYHGLPEFRKAVARFMEKVRGDRVRFDPERIVMSGGATGAHESLAFCLADPGDAFLVPTPYYPGFDRDLRWRTGVQLFPVVCESSNNFKVTKEALEEAYSKAQESNIKVKGLLINNPSNPLGTILDKETLKDILRFINDKNIHLVCDEIYAATAFSQPSFISISEVKSEVVGCNDDLVHIVYSLSKDLGFPGFRVGIIYSYNDAVVNIARKMSSFGLVSTQTQRLIASMLLDTIFVEDFIAKSSMRLLQRHGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 3497 - protein, 131 aa, Streptococcus thermophilus
MTKFLHTCVRVKDLEASLQFYQEALGFKEVRRNDFPEYKFTLVYMQLEDDPDYELELTYNYDHEVYDLGNGYGHIAVGVDDLEATHQAHKEAGYNVTDLSGLPGKPKMYYFITDPDGYKIEVIRLAQFLEK

SEQ ID NO: 3498 - protein, 307 aa, Arabidopsis thaliana
MSVTSTVEENHQKNPSTPAAVEEKKKRRWVFWDRRWRRLDYVKFSASFTVHSLALLAPFYFTWSALWVTFLFYTIGGLGITVSYHRNLAHRSFKVPKWLEYLLAYCALLAIQGDPIDWVSTHRYHHQFTDSERDPHSPKEGFWFSHLLWIYDSAYLVSKCGRRANVEDLKRQWFYRFLQKTVLFHILGLGFFLFYLGGMSFVTWGMGVGAALEVHVTCLINSLCHIWGTRTWKTNDTSRNVWWLSVFSFGESWHNNHHAFESSARQGLEWWQIDISWYIVRFFEIIGLATDVKVPTEAQRRRMAIVR

SEQ ID NO: 3499 - protein, 567 aa, Magnaporthe grisea
MPGTSRIPQSLRDGLISVKRNRPTSVVQLLSIDLLRNIVFTLFVLRWTRRAFWKLRGRGLLGWLAELYAAMRVTAYGWLLRAPGVRNKVRSEVDTALSKLSKKTLPPPEAPRYLQIPKQGWTNEAVRAELESLANMDHTRWEDGYVSGAVYHGEDELISLQTDAYGKFTVANPIHPDVFPGVRKMEAEVVAMVLSLFNAPVGAAGVSTSGGTESILMAVLSARQKAYNERGVTEPEIILPETSHTAFRKAAEYYKIKVNFVACPAPDYQVDVSRVRRLINANTIMLVGSAPNFPHGIIDDISGLSKLAVRYKIPLHVDCCLGSFLVPFLERAGFETRPFDFRLKGVTSISVDTHKYGFAPKGNSTVLYRTAELRKYQYFVCPDWSGGVYASPGIAGSRPGALIAGCWASMMAVGEAGYLAACVEIVGAAKKLVDHINASPSLAAELEIIGKPLSSVVAFRARNLNIYDIADAMGEKGWHLNSLQNPPAMHVAFTLPTAKVWERLATDLEACVEGEREKERARIAEGKGAKGAAVGDSAALYGVAGSLPNKSVVVELANGFLDLLYKT

SEQ ID NO: 3500 - protein, 547 aa, Brassica juncea
HELLHGLALVFLLAASSCKADEEITCEENTPFTCGNTDILSSKNFGKDFIFGVASSAYQIEGGRGRGVNIWDGFSHRYPEKSGSDLMNGDTTCESYTRWQKDVDIMGELNATGYRFSFAWSRIIPKGKVSRGVNQGGLDYYHQLIDALLEKNITPFVTLFHWDLPQTLQDEYEGFLDRQIIQDFKDYADLCFNEFGGKVKHWITINQLYTVPTRGYASGTDAPGRCSYMVDTKHRCYGGNSSTEPYIVAHNQLLAHAAVVDLYRTKYKFQNGKIGPVMITRWFLPFDESDPACVEAAERMNQFFHGWYMEPLTKGRYPDIMRQIVGSRLPNFTEEEAALVAGSYDFLGLNYYVTQYAQPQPNPYPSETHTAMMDPGVKLTYNNSRGELLGPLFAEDKVNGNSYYYPKGMYYVMDFFKTNYSNPLIYITENGISSPGTENRCEAIADYKRIDYLCSHLCFLRKVIREKGVNVRGYFAWALGDNYEFCKGFTVRFGLSYVNWDDLDDRNLKESGKWYQRFINGTVKNHANQDFLRSSLSSQSQKKRLAC

SEQ ID NO: 3501 - protein, 251 aa, Arabidopsis lyrata
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLNAMSPKELQNLEQQLDTALKNIRTRKNQLMYESINELQRKEKAIQEQNSMLSKQIKEREKILRAQQEQWDQQNHGHNMPPPPPPQQHQIQHPYMLSHQPSPFLNMGGLYQEEDPMAMRRNELELTLEPVYNCNL

SEQ ID NO: 3502 - protein, 424 aa, Ustilago maydis
MSAHPSNPHRTPYNVLNQTFLIDNAYAITKDLGQGAYGCVAAATHKGTGESVAIKKITNVFTKKILTKRALREIKLLRHFRGHKNITCLYDMDIIDPVGFNEVYLYEELMEADLHAIIRSGQPLSDAHFQSFIYQTLCGLKYIHSASVLHRDLKPGNLLICDFGLARGFETDPELAKQVGAGFMTEYVATRWYRAPEIMLSFQNYTTAIDIWSLLGGRPIFKGRDYVDQLNQILHYLGTPSEETLRRVGSPRAQDYIRSLPYQPRIPFDRLYPQANPQALNLLERMLEFDPAKRISCEEALQHPYLSVWHDPADEPVCPRKFDFGFESVDEVQGMKTLILEEVRSFRTEVRRQARLMQQPKRQESLPIPSREDIQRSSPTEEGNPAYSVLGASAGIIQGATNSEHASGVLNDACSKDVGLGSLG

SEQ ID NO: 3503 - protein, 585 aa, Elaeagnus umbellata
MCGILALLGCSDDSQAKRVRVLELSRRLKHRGPDWSGLFQFGDCYLAHQRLAIIDPASGDQPLFNEDKTVVVTVNGEIYNHEELRKKLSHHKFRTGSDCDVIAHLYEEYGEDFVDMLDGIFAFVLLDTRDNSFIVARDAIGVTSLYIGWGLDGSIWISSELKGLNNDCEHFETFPPGHLYSSKAGGMRRWYNPVWFSETIPSAPYDPLALRRAFENAVIKRLMTDVPFGVLLSGGLDSSLVASITARHLSGTKAAKQWGTKLHSFCVGLEGSPDLKAAKEVAAYLGTVHHEFHFTVQDGIDAIEDVIYHVETYDVTTIRASTPMFLMSRKIKSLGVKMVMSGEGSDEIFGGYLYFHKAPNKEEFHEETCRKIKALYLYDCLRANKSTTAWGLEARVPFLDKEFINVAMNIDPEYKKIKRDEGRIEKWVLRKAFDDEERPYLPKHILYRQKEQFSDGVGYSWIDGLKAHAAKHVTDKMIRNAAHIFPHNTPNTKEGYYYRMIFERFYPQNSARLTVPGGASVACSTAKAVEWDESWSKNLDPSGRAALGVHLSAYDNQVPSGVVQPEIISNVPQITVNTLGLEIQS

SEQ ID NO: 3504 - protein, 299 aa, Arabidopsis thaliana
MGDTTKDDGSSQSKAVRGEKRALFFRKWTRIDLARASAVGAVHLLCLLAPFNYKWEALRFGVILAIVTSLSITFSYHRNLTHKSFKLPKWLEYPFAYSALFALQGHPIDWVSTHRFHHQFTDSDRDPHSPIEGFWFSHVFWIFDTSYIREKCGGRDNVMDLKQQWFYRFLRNTIGLHILTFWTLVYLWGGLPYLTCGVGVGGTIGYNGTWLINSACHIWGSRAWNTKDTSRNIWWLGPFTMGESWHNNHHAFEASARHGLEWYQVDLTWYLICFFQALGLATDVKLPTDAQKRKLAFAR

SEQ ID NO: 3505 - protein, 551 aa, Ehrlichia ruminantium
MANMVVTGEQLDKSIREVVRILEDAVGCTAGPKGLTVAISKPYGAPEVTKDGYKVMKSIKPEDPLALAIANIIAQSASQCNDKVGDGTTTCSILTAKVIEEVSKVKAAGADIICVREGVLKAKEAVLEALKCMKREVLSEEEIAQVATISANGDKNIGTKIAQCVKEVGKDGVITVEESKGFKELDVEKTDGMQFDRGYLSPYFVTNSEKMLVEFENPYILLTEKKLNIIQPLLPILENIARSGRPLLIIAEDVEGEALSTLVLNKLRGGLHVAAVKAPGFGDRRKDMLGDIAILTGAKHVINDELAIKMEDLTLCDLGTAKNIRITKDTTTIIGSVDNSCAHVQSRICQIRMQIDNSTSDYDKEKLQERLAKLSGGVAVLKVGGSSEVEVKERKDRVEDALHATRAAVEEGVVPGGGAALLYTLSALDNLKSKNDDEQLGINIVKRALQAPIKRIIKNAGSENAPCVIAHLLKQNDKELIFNVDVMNFANAFTSGVIDPLKVVRIAFDFAVSLAAVFMTLNAIVVDIPSKDDNSAAGGAGMGGMGGMGGF

SEQ ID NO: 3506 - protein, 132 aa, Prosthecochloris aestuarii
MLVKLSQDPLQLFDDIWQGSNAPSSPAFKVDISEDNHAFYIDAELPGLAKENITLGIEDDVLTFKAERKKESEEKEKNYHRIERTYGSFSRSFNLGELIDKENIGASYDNGMLHVTLPKAQEVKRTRAISIT

SEQ ID NO: 3507 - protein, 737 aa, Bifidobacterium longum
MPVAQGDLDATSNAEFYNPHGVLGGHLGIGKHADTATIRVLRPLAKSVTILTQDGEYPMTHEYNGVFVVTVPASGTKKQPTIPDYRVRTEWESGAVLIEDDPYRYMPTVGDMDTYLFGEGRHEKLWETLGAHVLRYDDPMGGADGTPGEQVVGTAFSVWAPNAHAVRVVGNFNAWDGRRHAMRELGSSGVWEIFIPGIGAGETYKFQILNANYTWEMKADPMERQHEVPPSTASIVTESTYKWNDDAWMQHRRTTNPHDGPVSIYEVHAGSWKQGLTYRDLAKQLVDYVKQEGFTHVEFMPLAQHPFSGSWGYQVTGYYAVDSRLGSPDDFRYLVDQFHQAGIGVIMDWVPAHFPKDAFALGRFDGTPLYEDPDPLRGEHPEWGTYVFNFGRREVRNFLVANALFWLEDLHVDALRVDAVSSMLYLDYSREPGHWRPNIYGGRENLEAIDFLKEATATAYKNNPGVMVIAEESTAWPGITAPTSAGGIGFGMKWNMGWMHDTLEYLHEEPINRKWHHNEITFSMVYAYSEHYVLPISHDEVVYGKGSLYGKMPGDDWQKLAGVRSMFAYQWAHPGKKLSFMGNELAQWGEWDHDASIDWDCLNWQEHRQVQTMVADLNAFYKAHPALWSQDFDPAGFQWLTSDDADHNTLSFLRIGTKGETLAVVVNFSGEAWSDYQVALPTGGKWTEVFTTDDAKYGGSDIHNGTFEAVEGEYHSRPFSAKITVPALGVVFLKPED

SEQ ID NO: 3508 - protein, 237 aa, Populus tremuloides
SGTENKINRQVTFAKRRNGLLKKAYELSVLCDAEVALIIFSNRGKLYEFCSTSNMLKTLERYQKCSYGAEEVNKPAKELENSYREYLKVKARFEALQRTQRNLLGEDLGPLNTKDLEQLERQLESSLNQVRSTKTQYMLDQLADLQNKEHLLLEANRGLTIKLDEISARNSLRPSWEGDDQQNMSYGHQHAQSQGLFQALECNPTLQIGYNAVGSDQVSAITHATQQVHGFIPGWML

SEQ ID NO: 3509 - protein, 445 aa, Pseudomonas syringae
MLHLSRLTSLALAIAIVIGAPLAQAAEKTAPATPAAVSPAKTNATAKPPLPLDELRTFAEVMDRVKAAYVEPVDDKTLLENAIKGMLSNLDPHSAYLGPEDFQELQESTSGEFGGLGIEVGVEDGFVKVVSPIDDTPASKAGIEAGDLIVKINGTPTQGQNMQEAVDKMRGKIGEKITLTLVRDGGTPFDVTLARATIQVKSVKAQMLENGYGYIRITQFQVKTGDEVGKALAKFRKDNGKKMSGLILDLRNNPGGVLQSAVQVADHFLTKGLIVYTKGRIANSELRFSADPADASEGVPLVVLINGGSASASEIVAGALQDQKRGILMGTDTFGKGSVQTVLPLNNDRALKITTALYYTPNGRSIQAQGINPDIVVRRAKVTNEADGENYKEADLLGHLGNGNGGADKPTVKSGAAAKARPQDDDFQLSQALSLLKGLSITRGN

SEQ ID NO: 3510 - protein, 545 aa, Borrelia burgdorferi
MAKDIYFNEDARKSLLSGVEKLSNAVKVTLGPKGRNVLIDKKFGSPTVTKDGVSVAREIELENPFENMGAQLLKEVAIKTNDVAGDGTTTATVLAYAIAREGLKNVSSGINPIGIKKGIDHAVNLAAEKIRQSAKKITTKEEIAQVASISANNDSYIGEKIAEAMDKVGKDGVITVEESKTFDTTISYVEGMQFDRGYLSPYFSTNKENMSVNFDDAFILIYEKKISSIKELLPVLEKVLGTNKPLLIIAEDIEGDALAALVLNSVRGALKVCAIKSPGFGDRRKAMLEDIAVLTGGVLISEELGLTLETVEIEQLGQAKTIKVDKDNTTIINTGNKEQIKERSELIKKQIEDSTSEYDKEKLQERLAKLVGGVAVINVGAVTEVELKEKKHRVEDALSATRAAVEEGVVPGGGSTLIEVAMYLDTIDTSKLSYEEKQGFEIVKRSLEEPMRQIISNAGFEGSIYIHQIKTEKKGLGFDASSFKWVNMIESGIIDPAKVTRSALQNAASIAGLLLTTECAITDIKEEKNTSGGGGYPMDPGMGMM

SEQ ID NO: 3511 - protein, 173 aa, Gibberella zeae
MWSNCKVTCTDLAFQVVAVLPSPLRSILSLSPSRNTAHRALSVPTEPISTTSNIIQEMSSRGGKLAPEVNRALFVKNLSYNVTPEELFDLFGKFGPIRQVRQGIANNTKGTAFVVYEDVTDAKQACDKLNGFNFQNRYLVVLYHQPDKMAKSKEDLEARRESLAQLKQQHGID

SEQ ID NO: 3512 - protein, 547 aa, Novosphingobium aromaticivorans
MAAKDVKFGRDARERILRGVDILADAVKVTLGPKGRNVVIDKSFGAPRITKDGVSVAKEIELKDKFENMGAQMLREVASKANDAAGDGTTTATVLAQAIVREGMTAVAAGMNPMDLKRGIDIAVGKVVENLKARSTPVAGSSEIAQVGIISANGDTEVGQKIAEAMEKVGKEGVITVEEAKGLEFELDVVEGMQFDRGYLSPYFITNPEKMTVELENPYILIHEKKLSSLQAMLPILEAVVQSGRPLLIIAEDIEGEALATLVVNKLRGGLKIAAVKAPGFGDRRKAMLGDIATLTAGEMISEDLGIKLESVTLAMLGQAKKVTIDKDNTTIVDGAGSAEEIKARVEQIRAQIEVTTSDYDREKLQERLAKLAGGVAVIKVGGATEVEVKERKDRVDDALHATRAAVEEGIVPGGGTALLYATKALEGLKGANDDQTKGIDIVRRAIQAPIRQIAANAGHDGAVVSGNLLRENDENQGFNAATDTYENLKAAGVIDPTKVVRTALQDAASVSGLLITTEAAISEKPDDKPAMPPMGGGMGGMGGMDF

SEQ ID NO: 3513 - protein, 319 aa, Arabidopsis thaliana
MANIIFLDQPVGSGFSYSKTPIDKTGDISEVKRTHEFLQKWLSRHPQYFSNPLYVVGDSYSGMIVPALVQEISQGNYICCEPPINLQGYMLGNPVTYMDFEQNFRIPYAYGMGLISDEIYEPMKRICNGNYYNVDPSNTQCLKLTEEYHKCTAKINIHHILTPDCDVTNVTSPDCYYYPYHLIECWANDESVREALHIEKGSKGKWARCNRTIPYNHDIVSSIPYHMNNSISGYRSLIYSGDHDIAVPFLATQAWIRSLNYSPIHNWRPWMINNQIAGYTRAYSNKMTFATIKGGGHTAEYRPNETFIMFQRWISGQPL

SEQ ID NO: 3514 - protein, 194 aa, Triticum aestivum
  misc_feature (175)..(175): Xaa can be any naturally occurring amino acid
  misc_feature (188)..(188): Xaa can be any naturally occurring amino acid
MMGRKALDYEELNENVKKVQYAVRGELYLRASELQKEGKRIIFTNVGNPHALGQKPLTFPRQVVALCQAPFLLDDPNVGLIFPADAIARAKHYLSLAPGGLGAYSDSRGIPGVRQEVAEFIQRRDGYPSDPELIYLTDGASKGVMQMLNAIIRNERDGILVPVPQYPLYSAAISXLGGSLVPYYLEEXEANWGT

SEQ ID NO: 3515 - protein, 152 aa, Zea mays
MSLVRRSNVFDPFSMNLWDPFDTMFRSIVPSAASTDSETAAFASARIDWKETPEAHVFKADLPGVKKEEVKVEVEDGNVLVISGQRSKEKEDKDDKWHRVERSSGQFVRRFRLPENAKVDQVKAGLENGVLTITVPKAEEKKPEVKAIEISG

SEQ ID NO: 3516 - protein, 385 aa, Lithospermum erythrorhizon
MSIPSSKLLFTPYQLGKHLLSHRIVMSPMTRNRSFDAMPQKHAILYYSQRTSPGGFIVTEATGVSDTAQGYPHTPGIWTKEQTEAWKPIVDAVHAKGGVFFCQLWHVGRVSNKGFQPNGQDPISSTTKGFTPAVRASYVQEDWFSPPRALETDEIPKIIEDFVVSARNAIDAGFDGIELHGAHGYLLEQFLKDNVNDRTDKYGGSLENRCRFVLELVEAVVKEVGADKVGIKLAPFSDFMEAGDSDPAALGTYLVEALNKYGLLYLHVLEPRMKTTGETNNQSIDPMRKAFKGTFMVGGGYDKDLGEKALEEGRADLVVYGRPFVANPDLPKRFEVDAPLNEPDRNTFFSHDPVVGYTDYPFLEEATCLVPVFDTHCIFSIFLFN

SEQ ID NO: 3517 - protein, 214 aa, Prunus persica
IDFEPVKPYEVPMTAAGALQSYKLAAKAIARLQSLPSGSMERLCDTMVQEVFELTGYDRVMAYKFHDDDHGEVVSEITKPGLEPYLGLHYPSTDIPQASRFLFMKNKVRMIVDCCAKQVKVLQDEKLPFDLTLCGSTLRSPHSCHLQYMKNMESIASLVMAVVVNEGDDEVASPDSVQPQKRKRLWGLVVCHNTSPRFVPFPLRYACEFLAQSS

SEQ ID NO: 3518 - protein, 366 aa, Lithospermum erythrorhizon
MASKKLLFTPYQLGKHLLSHRIVMSPMTRNRSFDAMPQKHAILYYSQRASKGGFILTEATGVSDTAQGYPHTPGIWTKEQPEAWKPIVDAVHAKGAVFFCQLWHVGRVSNKGFQPNGQDPISSTTKGFTPAVRASYVQEDWFSPPRALETDEIPKIIDDFRIAARNAIDAGFDGVELHGAHGYLLEQFLKDNVNDRTDKYGGSLENRCRFVLELVEAVVNEVGADKVGIKLAPFSDFMEAGDSDPATLGTYLAEALNKFGILYMHVLEPRMKTTGETNNESIDPMRKAFKGTFVVGGGYDKELGEKALEEGRADLVVYGRPFVSNPDLPKRFEIDAPLNEYDRNTFFTHDPVVGYTDYPFLEEATA

SEQ ID NO: 3519 - protein, 144 aa, Nitrosomonas europaea
MAITRYEPWGLLTQLQRELERARDDMATEGASAIAEWAPAVDIKEESDKFIVHADLPGVKPEAIDVTTENGVLTIKGEKQTEARTEKEGYKRVERTHGSFYRRFSLPDTADLGAISAVTKDGVLVVTIPKREAVQPKKVSVTAQ

SEQ ID NO: 3520 - protein, 305 aa, Brassica napus
  misc_feature (294)..(294): Xaa can be any naturally occurring amino acid
MSCFGWCGNDDGFRNGDDTRPMPSHIPAGDSGSHYLRSDPPMNQPVVQMEPIAVPAIPADELSDVTDNYGSKALVGEGSYGRVFHGVLKSGITSAIKKLDSSKQPDQEFLSQISMVSRLRHGNVIALVGYCVDGPLRVLAYEYAPNGSLHDVLHGRKGVKGALRGPVMTWHQRVKIAVGAARGLEYLHEKVNPQVIHRDIKSSNVLLFDDDVAKIGDFDLSNQAPDMAARLHSTRVLGTFGYHAPEYAMTGTLSTKSDVYSFGVVLLELLTGRKPVDHTLPRGQQSLVTWATPXLSEDKVKLCVD

SEQ ID NO: 3521 - protein, 377 aa, Pseudomonas putida
MPDTSFSNPGLFTPLQLGSLSLPNRVIMAPLTRSRTPDSVPGRLQQIYYGQRASAGLIISEATNISPTARGYVYTPGIWTDAQEAGWKGVVEAVHAKGGRIALQLWHVGRVSHELVQPDGQQPVAPSALKAEGAECFVEFEDGTAGLHPTSTPRALETDEIPGIVEDYRQAAQRAKRAGFDMVEVHAANACLPNQFLATGTNRRTDQYGGSIENRARFPLEVVDAVAEVFGPERVGIRLTPFLELFGLTDDEPEAMAFYLAGELDRRGLAYLHFNEPDWIGGDITYPEGFREQMRQRFKGGLIYCGNYDAGRAQARLDDNTADAVAFGRPFIANPDLPERFRLGAALNEPDPSTFYGGAEVGYTDYPFLDNGHDRLG

SEQ ID NO: 3522 - protein, 206 aa, Thermoanaerobacter tengcongensis
MKILVTAFDPFGGESINPSYEVLKNLKDNIEGAEIVKIQVPTVFYLSVEKAIEKIKEVNPDAVLSIGQAGGRYDISVERVAINIDDARIPDNIGQQPIDTPIDPEGAPAYFATIPIKEIVEEIKKENIPASISNTAGTYVCNHLMYGILNYIHKNKLNIKAGFIHIPYLPVQVLNKPSTPSMSLGDMVKAIETAIKVIVKSCKKSR

SEQ ID NO: 3523 - protein, 258 aa, Xylella fastidiosa
MRLTPLPAFDNNYIWTLIAPDGRAIIVDPGQALPILEAHSKGLIPTAILLTHHHADHIGGVPELLERWPTLPVYAPHDTRIALNYHRIGEGDSLNILGMRFQVIHTPGHTHSHLTFIGNDLLFCGDTLFSLGCGQIFEGTPTQMLASLQRLAALPIQTRVCCGHEYTLSNAAFALHVDPTNTALQKRRQQANAMRLAGLPTLPISLESELNTNPFLRTAAPTIHAATATHLQRTPIDEVEVFATLRHWKNNFPIKNIP

SEQ ID NO: 3524 - protein, 108 aa, Triticum aestivum
  misc_feature (47)..(47): Xaa can be any naturally occurring amino acid
  misc_feature (49)..(50): Xaa can be any naturally occurring amino acid
  misc_feature (62)..(62): Xaa can be any naturally occurring amino acid
  misc_feature (64)..(64): Xaa can be any naturally occurring amino acid
  misc_feature (66)..(70): Xaa can be any naturally occurring amino acid
  misc_feature (72)..(80): Xaa can be any naturally occurring amino acid
  misc_feature (83)..(83): Xaa can be any naturally occurring amino acid
  misc_feature (85)..(88): Xaa can be any naturally occurring amino acid
  misc_feature (92)..(96): Xaa can be any naturally occurring amino acid
  misc_feature (98)..(98): Xaa can be any naturally occurring amino acid
  misc_feature (100)..(105): Xaa can be any naturally occurring amino acid
MAAASLRKGNARLPPEVNRALFVRNLPFNISSEEMYDIFGKYGAIRXIXXGNAKDTRGTVFXLXPXXXXXKXXXXXXXXXKEXKXXXXGGEXXXXXMXGXXXXXXKEG

SEQ ID NO: 3525 - protein, 297 aa, Yersinia pestis
MRYAFPTQQLKDNVMQTVKLNNGIAMPLLGFGVFQMTNTAECERAVIDAIETGYRLIDTAASYQNETQVGNALKLSGIARDELFITTKLWLQDTYYEGAKAQFERSLNRLQLDYVDLYLIHQPYGDVHGAWRAMEELHQAGKIRAIGVSNFHPDRLADLMAFNKIIPAVNQIEVNPFNQQLHAVPWMQSRGIQPEAWAPFAEGRNGLFQNPVLTAIGEKYGKSVGQVVLRWIFQRGIVSLAKSVRKGRMEENINILDFELSAEDMLQIAALDTATSAFFSHRDPAMVEWLTGRKLDV

SEQ ID NO: 3526 - protein, 431 aa, Magnetospirillum magnetotacticum
MFETDPDTFERAGLGQLDEAGSAALMKSIFSDILGDHPVLTNRSIWRQFPMIRNARWVRGNRVLLGDAKATAHFSIGSGTKLAMEDAIALYEALVAEAEVPAALDRFEKGRREEVEKIQHAADVSLVWFEHVARYLDFEPVQFAFGAMTRAKAITYDNLRLRAPGFVAQMDRAFAEGVRREGFDVSLDKPAAPMFQPLRLREMVVPNRVAMSPMCLYAATEGVPNDFHLVHYGSRAIGGPGLMFTEMTCVSRDARITPGCAGLWNDAQETAWRRIVDFVHANAATKFCLQLGHAGRKGATKRMWEGIDRPLESGGWEVMSASALPYFPDSTVPREMTRADMDAVIADFVAATRRAERAGFDMLELHCAHGYLLASFLSPLTNHRSDVYGGSVENRLRFPLEVFTAMRAAWPAERPMSVRVSATDWAEGGLT

SEQ ID NO: 3527 - protein, 656 aa, Burkholderia pseudomallei
MCGITGFVGPVACAPQTARATLARMTDSLAHRGPDDTGLWIDHDAGVALGHRRLSIVDLSEHGHQPMLSACGRYAMTFNGEIYNFRALRSELEREHRAPEWRGHSDSEVLLAAFCAWGVDRALQKAVGMFALALWNRESRVLTLARDRIGEKPLYYGRIGGSFVFGSELKALRRFPGFDAHPIDRDALCLYLRHASVPAPYTIYEGIRKLPPGTYAQFEDLAEAPAPRRYWSLERAIAAGRANPFDGDANAAVAQLDHVLRDAIAEQSVADVPLGAFLSGGVDSSVIVALMQTQTAQPVQTFTIGFHEAGYDEAGYAKAVARHLGTSHTELYVKPADVLATVPRMPCVYDEPFADSSQIPTLLVSELTRRHVKVSLSGDGGDELFGGYTRYFLTPRLWGRLRRVPAAVRMRIAAALHALRPDHADQIASLVQGAWSASAQRDASPRVGDRLHKLANVMTADSRASLYRLLMSSVHHPERFTLAGHEPQTLIDTPGAWPPGLSFAEQAMAVDTLTYLPTDILTKVDRAAMAVSLETRMPFLDYRVVEFAWRLPEALRIPDGQDKWLLRKLLYRYVPRPLIDRPKQGFCAPVGAWLRGELSDWAAELLRPARLRDEGYLDAARVERLWRQHQSGRMNWQHPLWTVLMFQAWLERQRAE

SEQ ID NO: 3528 - protein, 981 aa, Desulfovibrio desulfuricans
MMNNMLRYGVRGVQTRICLLTLVVSTLVALAFGSYEYVTALDAEYARLERFAVSQADRVARLLLVPVWNVDRQASMSIIDTEMDDERVHAVIVYDEGGSIFIGRQRGSGGVLVNTSRSIPRGEFIVTSRPLRQGSLRFATLQLYVTPEYVHRTMKDNVVAAVMHMLALELVLVLGILLVVRRSLIVPLSALTAWVRRESPLYDYGTRIPKQADDELGELVDSMNGMLSEIEKRDRMLNDHSKHLEKLVAERTQELEHARHTAEQASKAKGDFVASMSHELRTPMNAIIGMIEIALKTELTVKQREYLTIIRSSARSLLGVVNDILDISKIEAQKMELEHIPFSTQEMLEEVTDLFRERVGMKGVELVLDIEADVPAVLVGDPLRLKQVLVNLVTNAFKFTKQGEVRIRVAVGSRSQDVVQLEFSVRDTGLGIGEEARNRLFDTFSQAEGSTARLFGGSGLGLSIARELVRLMGGTITVASEPGKGSDFRFTGRFSLPVEAVEARHHRTGEAPRGRVLLVEDNESNRLVMTRMLERLGYDCDALQDGYTAYERLKRQAALYDLILLDWRLPGVDGLEVLEKLRAEKQPLPPVFMMTAFGREAELERAEELGVASFLSKPVKLSSLSDAIRAMRGEMTPEEQTDTAMIRQFDGMRALLVEDNIINRHVALDMLQDMGFSVVSAEHGEEALAVLDDVEPPSGPGFDVVFMDIQMPVMDGIEATRVIRQHPRWRHIPIIAMTAHVMSEDRDKALEAGMNDYVTKPVDRMMLLQVLQRHVGEHAARAAEDGARRIRQSFDARSEHLQEHNILHMHGMGVAGAEQEGAVGGVSSGHAGAGVPEQGTDIISDGGPDGVPPMPARLPGLILEEGVDRLGGKQDIYFEILKKFAEVYAQAADAVRQAAEQNHRDVVAEKAHAIAGAAANISAGELRESALALERAARDGAPMELELEQFAYWLEQVVRSIGVLKSRMRPVPDAPEDGMHP

SEQ ID NO: 3529 - protein, 766 aa, Saccharomyces cerevisiae
MSEEETVSAPAPASTPAPAGTDVGSGGAAAGIANAGAEGGDGAEDVKKHGSKMLVGPRPPQNAIFIHKLYQILEDESLHDLIWWTPSGLSFMIKPVERFSKALATYFKHTNITSFVRQLNIYGFHKVSHDHSSNDANSGDDANTNDDSNTHDDNSGNKNSSGDENTGGGVQEKEKSNPTKIWEFKHSSGIFKKGDIEGLKHIKRRASSRNNSSINSRKNSSNQNYDIDSGARVRPSSIQDPSTSSNSFGNFVPQIPGANNSIPEYFNNSHVTYENANHAPLESNNPEMQEQNRPPNFQDETLKHLKEINFDMVKIIESMQHFISLQHSFCSQSFTFKNVSKKKSENIVKDHQKQLQAFESDMLTFKQHVMSRAHRTIDSLCAVNAAATAASVAPAPAPTSTSAYAPKSQYEMMVPPGNQYVPQKSSSTTNIPSRFNTASVPPSQLLYNTNRSRNQHVTYASEPAHVPNFINQPIPIQQLPPQYADTFSTPQMMHNPFASKNNNKPGNTKRTNSVLMDPLTPAASVGVQGPLNYPIMNINPSVRDYNKPVPQNMAPSPIYPINEPTTRLYSQPKMRSLGSTSSLPNDRRNSPLKLTPRSSLNEDSLYPKPRNSLKSSISGTSLSSSFTLVANNPAPIRYSQQGLLRSLNKAANCAPDSVTPLDSSVLTGPPPKNMDNLPAVSSNLINSPMNVEHSSSLSQAEPAPQIELPQPSLPTTSTTKNTGEADNSKRKGSGVYSLLNQEDSSTSSADPKTEDKAAPALKKVKM

SEQ ID NO: 3530 - protein, 348 aa, Saccharomyces cerevisiae
MPTLVNGPRRDSTEGFDTDIITLPRFIIEHQKQFKNATGDFTLVLNALQFAFKFVSHTIRRAELVNLVGLAGASNFTGDQQKKLDVLGDEIFINAMRASGIIKVLVSEEQEDLIVFPTNTGSYAVCCDPIDGSSNLDAGVSVGTIASIFRLLPDSSGTINDVLRCGKEMVAACYAMYGSSTHLVLTLGDGVDGFTLDTNLGEFILTHPNLRIPPQKAIYSINEGNTLYWNETIRTFIEKVKQPQADNNNKPFSARYVGSMVADVHRTFLYGGLFAYPCDKKSPNGKLRLLYEAFPMAFLMEQAGGKAVNDRGERILDLVPSHIHDKSSIWLGSSGEIDKFLDHIGKSQ

SEQ ID NO: 3531 - protein, 456 aa, Securigera parviflora
MCGILAVLGCSDDSQAKRVRVLELSRRLKHRGPDWSGLHQHGDCFLAHQRLAIVDPASGDQPLFNEDQSIIVTVNGEIYNHEELRKQMPNHKFRTGSDCDVIAHLYEEHGENFVDMLDGIFSFGLLDTRDNSFIVARDAIGVTSLYIGWGLDGSVWIASELKGLNDDCEHFETFPPGHLYSSKEREFRRWYNPPWFSESIPSAPYDPLALRQAFEKAVVKRLMTDVPFGVLLSGGLDSSLVASITARHLADTKAAKQWGAKLHSFCVGLEGSPDLKAGKEVADYLGTVHHEFQYTVQDGIDALEDVIYHIETYDVTTIRASTPMFLMSRKIKSLGVKWVISGEGSDEIFGGYLYFHKAPNKEELHKETCRKIKALHKYDCLRANKSTFAWGLEARVPFLDKEFINVAMNIDPENKMIKLDEGRIEKWILRKAFDDEENPYLPKHILYRQKEQFSDG

SEQ ID NO: 3532 - protein, 156 aa, Arabidopsis thaliana
MDLEFGRFPIFSILEDMLEAPEEQTEKTRNNPSRAYMRDAKAMAATPADVIEHPDAYVFAVDMPGIKGDEIQVQIENENVLVVSGKRQRDNKENEGVKFVRMERRMGKFMRKFQLPDNADLEKISAACNDGVLKVTIPKLPPPEPKKPKTIQVQVA

SEQ ID NO: 3533 - protein, 227 aa, Pisum sativum
  misc_feature (200)..(200): Xaa can be any naturally occurring amino acid
IILLKGKSKRNHSTLVHEGKDLVVYALINAVAIRKILKKYDKIHYSKQGQLFKSHAQTMHKEILQSPWLIELMALHINLRETKVKSRKSSALFDECYLTIKDGKPSLACELCDSIKIDIDLTCSICLETVFDPVSLSCGHIFCYSCACSSASLTIVDGLKEAHPKEKCPLCRSAGVYEGAVHLEELNIMLGRSCTEYWEXRLQMERVERVKQAKEHWETQCRAFMGI

SEQ ID NO: 3534 - protein, 240 aa, Glycine max
MALEALNSPTTTAPSFPFDDPTIPWAKRKRSKRSRDHPSEEEYLALCLIMLARGGTTTVNNRHVSPPPLQPQPQPTPDPSTKLSYKCSVCDKSFPSYQALGGHKASHRKLAGAAEDQPPSTTTSSAAATSSASGGKAHECSICHKSFPTGQALGGHKRCHYEGNGNGNNNNSNSVVTVASEGVGSTHTVSHGHHRDFDLNIPAFPDFSTKVGEDEVESPHPVMKKPRLFVIPKIEIPQFQ

SEQ ID NO: 3535 - protein, 412 aa, Thermosynechococcus elongatus
MGIRWLQRLIGCLVVLVGIWGIFPPDSAIALTEEQKLFNEAWRIVNQAYVDPTFNGQNWWRVREKALKRPLPDREATYAAIEAMLATLEDPFTRFLRPEQFRSLQTTTAGELIGVGLQISTDPKTGVLEVIAPIDGSPAAEAGIQPRDRILAIDGISTNQLSLDEAAERMRGTAGSAVHLLLQRGNDTPQELILHRGHIEINPVTAEVRQVQGHTVGYIRLSQFSAMAPTEMRKAIQILEQQGAEEYILDLRNNPGGLLQAGVEIAQLWLDSGAIVYTVDRQGIVDSLNASGGALTHDPLVVLVNGGTASASEILAGALQDHGRARLVGDRTFGKGSIQSLFHLSDGSGLAVTIAHYETPNHHNINKVGIEPDRRVLDAPESLMAMGTAADPQYLAALELLHSPIQVATSAG

SEQ ID NO: 3536 - protein, 544 aa, Francisella tularensis
MAAKQVLFSDEARAKMLDGVNTLANAVKVTLGPKGRNVVLDKSFGAPTITKDGVSVAKEIELEDKFENMGAQIVKEVASKTADVAGDGTTTATVLAQALLTEGLKAVTAGMNPMDLKRGIDKATARLVEELKALSKPCSDPKSIEQVGTISANSDATVGKLIADAMAKVGKEGVITVEEGKGFEDELDVVEGMQFDRGYLSPYFATNQENMTTDLENPYILIVDKKISNIRDLLPILEGVSKSGRALLIIAEDVESEALATLVVNNMRGVVKVCTVKAPGFGDRRKAMLEDIATLTGATFVSEDLSMKLEETNMEHLGTASRVQVTKDNTTIIDGAGEKEAIAKRINVIKANIAEANSDYDREKLQERLAKLSGGVAVIKVGAVTEAEMKEKKDRVDDALHATRAAVEEGIVAGGGVALIRAQKALDGLTGENDDQNHGIALLRKAIEAPLRQIVSNAGGESSVVVNQVKANQGNYGYNAANDTYGDMVEMGILDPTKVTRSALQHAASIAGLMITTEAMIGEIKEAAPAMPMGGGMGGMPGMM

SEQ ID NO: 3537 - protein, 436 aa, Oryza sativa
MDSVVRTHIGHMLKMIHFCSMFLITFSDYKIQAILSSQQKRKAPEESDVAESSDCMITSPGFAVSPMLTPVSGKAVKTSKSKTKNNKAGPQTPTSNVGSPLNPPTPVGTCRYDSSLGLLTKKFINLLKQAPDGILDLNNAAETLEVQKRRIYDITNVLEGIGLIEKTLKNRIRWKGLDDSGVELDNGLSALQAEVENLSLKEQALDERISDMREKLRGLTEDENNQRWLYVTEDDIKGLPCFQNETLIAIKAPHGTTLEVPDPDEAGDYLQRRYRIVLRSTMGPIDVYLVSQFDEKFEDLGGGATPSGHANVPKHQPTEVFNTTNAGVGQCSNSVAVDNNIQHSQTIPQDPSASHDFGGMTRIIPSDIDTDADYWLISEGDVSITDMWKTAPDVQWDESLDTDVFLSEDVRTPSSHNQQPSAVGGPQMQVSDMHKP

SEQ ID NO: 3538 - protein, 549 aa, Wolbachia endosymbiont
MTNVVVSGEQLQEAFREVAAIVDSTVAITAGPRGKTVGINKPYGAPEITKDGYKVMKGIKPEKPLNAAIASIFAQSCSQCNDKVGDGTTTCSILTSNMIMEASKSIAAGNDRVGIKNGIQKAKDVILKEIASMSRTISLEKIDEVAQVAIISANGDKDIGNSIADSVKKVGKEGVITVEESKGSKELEVELTTGMQFDRGYLSPYFITNNEKMIVELDNPYLLITEKKLNIIQPLLPILEAIVKSGKPLVIIAEDIEGEALSTLVINKLRGGLKVAAVKAPGFGDRRKEMLEDIATLTGAKYVIKDELGIKMEDLTLDDLGTAKNVKITKDNTTVVSENSDSDSVKARIEQIKSQIETSTSDYDKEKLRERLAKLSGGVAVLKVGGATEVEVKERRDRVEDALHATRAAIEEGIVPGGGVALLYASSVLDKLKGASDEEQIGINIIKKVLSAPIRRLVKNAGLESAVIIDYLIKQNDKELIYNVEAMNYANAFTAGVIDPAKVVRIAFETAVSVASVLITTESMIVDVPSKENASSPMGAGEMSGMGGF

SEQ ID NO: 3539 - protein, 578 aa, Arabidopsis thaliana
MCGILAVLGCVDNSQAKRSRIIELSRRLRHRGPDWSGLHCYEDCYLAHERLAIVDPTSGDQPLYNEDKTIAVTVNGEIYNHKDLRENLKSHQFRTGSDCEVIAHLYEEHGEEFVDMLDGMFAFVLLDTRDKSFIAARDAIGITPLYIGWGLDGSVWFASEMKALSDDCEQFMCFPPGHIYSSKQGGLRRWYNPPWFSEVVPSTPYDPLVVRNTFEKAVIKRLMTDVPLGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSDTMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 3540 - protein, 578 aa, Arabidopsis thaliana
MCGILAVLGCIDNSQAKRSRIIELSRRLRHRGPDWSGLHCYEDCYLAHERLAIIDPTSGDQPLYNEDKTVAVTVNGEIYNHKILREKLKSHQFRTGSDCEVIAHLYEEHGEEFIDMLDGMFAFVLLDTRDKSFIAARDAIGITPLYIGWGLDGSVWFASEMKALSDDCEQFMSFPPGHIYSSKQGGLRRWYNPPWYNEQVPSTPYDPLVLRNAFEKAVIKRLMTDVPFGVLLSGGLDSSLVAAVALRHLEKSEAARQWGSQLHTFCIGLQGSPDLKAGREVADYLGTRHHEFQFTVQDGIDAIEEVIYHIETYDVTTIRASTPMFLMSRKIKSLGVKMVLSGEGSDEILGGYLYFHKAPNKKEFHEETCRKIKALHQFDCLRANKSTSAWGVEARVPFLDKEFLNVAMSIDPEWKLIKPDLGRIEKWVLRNAFDDEERPYLPKHILYRQKEQFSDGVGYSWIDGLKDHANKHVSDTMLSNASFFFPDNTPLTKEAYYYRTIFEKFFPKSAARATVPGGPSIACSTAKAVEWDATWSKNLDPSGRAALGVHVAAYEEDKAAAAAKAGSDLVDPLPKNGT

SEQ ID NO: 3541 - protein, 242 aa, Glycine max
MEFPNEAIPEGCSQKKTGRGKIEIKRIENTTNRQVTFCKRRNGLLKKAYELSVLCDAEVALVVFSSRGRLYEYANNSDLGTIDRYKKACAASTNPESVSEANTQFYQQEASKLKRQIRDIQNLNRHILGEALSSLSLKELKNLESRLKKGLSRVRSRKHETLFADIEFMQKREIELQNHNNFLRAKIAEHEKAQQRQQDMIPGNVCESTIPPQSYDRNFFPVNLIDSNNQYSNQDQTALQLV

SEQ ID NO: 3542 - protein, 377 aa, Unknown
  Dehalococcoides sp. CBDB1
MTFRIKVLLGTILSMVGLLGSFALGYFSGGVSALNSDENLSSIVTAWQIITTEYVEPDIIDQAALAEAAIKGMMDELNDPHSVYLNAEDYQASLEYDDGQYVGIGATVQIEDGVITLIPYEGSPAALAGIQAGDILLEVDGQSVDGFSLADLSPLVRGEKGTLITLKVERSTSAQPLLFNVTRNEILIPSVSSEMMGDIAYIRLSRFSERTDAELEQVLKNLGDAKGIVLDLRGNPGGLVSSVINVTSRFVSSGVVLTTVDNAGNSEEYKIVPKAVTTSLPMVVLVDQYSASGSEALSGALQDYGRATIVGKTTYGKGSVNRTFDVTGNTGIYLTIGRWYTPNGRMIEGQGITPDIELELAGDEAVNWALNFMHGEA

SEQ ID NO: 3543 - protein, 546 aa, Xanthomonas oryzae
MAAKDIRFGEDARTRMVRGVNVLANAVKATLGPKGRNVVLEKSFGAPTITKDGVSVAKEIELADKFENMGAQMVKEVASKTNDNAGDGTTTATVLAQALIREGAKAVAAGMNPMDLKRGIDQAVKAAVVELKNISKPTTDDKAIAQVGTISANSDESIGNIIAEAMKKVGKEGVITVEEGSGLENELDVVEGMQFDRGYLSPYFINNQQSQSADLDDPFILLHDKKISNVRDLLPVLEGVAKAGKPLLIVAEEVEGEALATLVVNTIRGIVKVVAVKAPGFGDRRKAMLEDMAVLTGGTVISEEVGLALEKATIKDLGRAKKVQVSKENTTIIDGAGDSAAIESRVGQIKTQIEDTSSDYDREKLQERVAKLAGGVAVIKVGASTEIEMKEKKARVEDALHATRAAVEEGVVPGGGVALVRALVAVGNLTGANEDQTHGIQIALRAMEAPLREIVANAGEEPSVILNKVKEGTGNYGYNAANGEFGDMVEFGILDPTKVTRSALQNAASIAGLMITTEAMVADAPKKDEPAMPAGGGMGGMGGMDF

SEQ ID NO: 3544 - protein, 538 aa, Thermotoga maritima
MPKILKFNEEARRALERGVDKVANAVKVTLGPKGRNVVIEKSWGSPTITNDGVSIAKEIELEDKFENLGAQLVKEVASKTNDVAGDGTTTATVLAQAMIKEGLKNVAAGANPILLKRGIDKAVEKAVEEIKKVSKKLSGREDIAHVAAISANSAEIGELIAEAMDKVGEDGVITVEDSKTLETYVEFTEGMQFDRGYISPYFVTDAEKMEVVLKEPFILITDRKLSAVKPLIPILEKVAQTGKPLLVIAEDVEGEVLTTLVLNKLKGTLQSCAVKAPGFGERRKAMLQDIAILTGGQVASEELGINLEDLTLEDLGRADLVRVKKDETIIIGGKGDPEAIKKRIAQIKAQIEETTSEYEKETLQERMAKLAGGVAVIKVGAATETELKEKKHRIEDALSATRAAVEEGIVPGGGVTLLRARKAVEKVIEELEGDEKIGAQIVYKALSAPIKQIAENAGYDGAVIIEKILSNDDPAYGFDALRGEYCNMFERGIIDPAKVTRSALQNAASIAGMLLTTEVLIVEKPEEKKETPSMPEEF

SEQ ID NO: 3545 - protein, 461 aa, Oryza sativa
MGGKLLPAAAFAGSAPPLSQVSTSAAHGEDSPYFAGWKAYDEDPYHAVDNPDGVIQMGLAENQVSFDLLEAYLRDHPEAAGWSTGGAGAGSFRDNALFQDYHGLKSFRKAMASFMGKIRGGKARFDPDHIVLTAGATAANELLTFILANPGDALLIPTPYYPGFDRDLRWRTGVNIVPVRCDSANGFQVTVAALQAAYDEAAAVGMRARSVLITNPSNPLGTTVRRKMLDDILDFVSRNDIHLISDEIYSGSVFAAPDLVSVAELVEARGGGGIAGRVHIVYSLSKDLGLPGFRVGVVYSYNDAVVTVARRMSSFTLVSSQTQKTLAAMLSDEAFAGEYIRTNRRRLRERHEHVVAGLARAGVPCLRGNAGLFVWMDMRRLLLGGGGVGGELRLWEKLLRQAKLNISPGSSCHCSEAGWFRVCFANMSLDTLDLALHRISRFMDTWNGTKQQASCQQQEQQ

SEQ ID NO: 3546 - protein, 772 aa, Pseudomonas aeruginosa
MDIALTHRLSFKQASLTVLVAFILGTLLSLIQVGVDYASQDASINREVRALLDVSHNPAARIAYNIDAELAQELVLGLLRSPAVVRAEIIDTSGLPLASASREPAESRLRPLSDFLFGHKRVYEDPLHVDHAPGEALGVLQLEIDTFVFGNDFLRRAGITLLSGFVRSLLLSLILLVLFYTLLTKPLVSLIQALSGHDPRSPARMRLPCPKGHERDEIGVLVEVINRQLGRISVEIEQRREAENRLTQYLEELESIVAARTAELKAANARLTLSNQELEEARQTALDMAQARASFLANMSHEIRTPLNGLLGMLSLSLDGPLTPEQRQQLSIAHDSGKVLVELLNDVLDLSKFEAGQLVLEQIPFDLGVLVEDTASLLSQNAAAGVELTCLVDPALPAQVSGDPTRIRQVVSNLLSNALKFTRLGRVDVRVEATAEGVRISVRDTGIGIAQEALDRIFQPFTQADAGITRQYGGTGLGLALTRKLCEAMQGELTVESTVGLGSLFSVGLPLAPVSPPLQALPLRGRVIAQCSANSGLAQLLQTWLPRWGLEYKRLETDDSLLGHSLDVLISDCPDCLMGLRPSIGTPILLVTAYGSFLEPELARRLSPLRQLARPLSRNQLYQALKHVLEHTAIAPSSASDTAGEQRDTRVLLVEDNPVNQLVAKGLLHKLGCQVWIAEHGLNALKMLEEHPIDLVLMDCNMPVMDGYEATRQIRDSGRWGGLPIIALTANALPDERERCRAAGMDDYLAKPFHRDELKAILDRWCPLTAGD

SEQ ID NO: 3547 - protein, 355 aa, Unknown
  Nostoc sp. PCC 7120
MTHLFEPLRIREVTFRNRIALSPMCQYSSTNGFANDWHLVHLGSRAVGGAGLVMTEAAAVEARGRISPQDLGIWSDAHIEALARTVGLIHNFGAVAAIQLAHAGRKASTSKPSKGGKFLDESHEGWRPVVSSSAIAFSKESPVPEALSIEGIQQVIQAFVQATKRSLQAGFKVIEIHAAHGYLLHQFLSPLVNQRQDDYGGSFENRTRLLREVVEAVREVWPESYPLFVRLSATDWVDKGWDIEQSIAISDKLKSLGVDLIDCSSGGVIPGINIPVKPGYQSQFAERIRKEAHIPTGAVGLITSPEQADQIIRSGVADIVLLGRELLRNPYWPHLAAKELGHEKHWPVQYDRAWL

SEQ ID NO: 3548 - protein, 192 aa, Metasequoia glyptostroboides
DDHGEVISEIRRSDLEPYLGLHYPATDLPQASRFLFMKNKVRMICDCYATPVKVVEDSRLPRELILCGSALRAPHGCHAEYMSNMGSIASLVIAVTINAKEEDGDTDGQQHQQKGRRLWGLVVCHHTSPRFVPFPMRYACEFLMQVFAIQLNKEVELADQLREKHILRTQTLLCDMLLRDAPMGIIGQKPNI

SEQ ID NO: 3549 - protein, 719 aa, Nocardia farcinica
MTGHTPDTPDNAADADHAAGGADRKQRQLDAHRVDREQGHLTTQQGVRVRHTDDALSAGARGPTLLDDFHAREKITHFDHERIPERVVHARGAGAYGYFQPYDDRLAEYTVAKFLTDPAERTPVFVRFSTVAGSRGSADTVRDVRGFATKFYTSQGNYDLVGNNFPVFFIQDGIKFPDFVHAVKPEPHNEIPQAASAHDTLWDFVSLQPETLHAIMWLMSDRALPRSYRMMQGFGVHTFRFLDAAGTPTFVKFHWTPKLGVHSLVWDECQQIAGRDPDYNRRDLWDCIEAGHYPEWELGVQLIPVEKEFDFDFDLLDATKLVPEEQVPVLPVGRMVLDRNPDNFFAETEQVAFHTANLVPGIDFTDDPLLQLRNFSYLDTQLIRLGGPNFAQIPINRPVADVRNHQQDGYGQHAIPRGQASYTVNSIGGGCPVVGGDGSYEHYPRQVDGRAQRRRAESFREYYRQPRMFWRSMSAPEAEHIVEAFAFELGKVQRVEIRERTLGQLVRIDPDLAVRVAGRLGLPAPPPDPEAGTDAFVSPALSQAHTAKDSIATRQVAVLAADGVDAAGVRALRSALTERGAIVEVIASHGGMVHADGGDGDTLPVDRTLMTVASVLYDGVVVAGGQTGVETLTRNGEAVHFVLEAFKHAKPVAAFGAGVSLLRIAGILDAARAHDADPATGVITTEARGDGLDEEFVTDLARALANHRTWQRATSAIPA

SEQ ID NO: 3550 - protein, 333 aa, Zea mays
KGDQKGGVSPGGGGPFKKKGVPPGGRNFPGALSLDILIWKPFPSRALRPSSVSFIHTERETQKTKTLRKEMMEWDNQQQPSNNPSSNLQGIDVNGGSGSGGMYVKVMTDEQLETLRKQIAIYATICERLVEMHKTLTSQQDLAGRVGGLYADPTFGHKMTGGRQRWTPTPVQLQILERIFDQGIGTPSKQKIKDITEELSQHGQIAEQNVYNWFQNRRARSKRKQHGGGGGGVGSSSNNNNGESEVEAETETVNEKRKMPESLLVFPDGNKNAIGTTSATSPRPEDLYFQSPEMSSDLDLLGVLSNPRDEHFVGKMGLSESYNMYDHVEDYGM

SEQ ID NO: 3551 - protein, 181 aa, Metasequoia glyptostroboides
DDHGEVVAEMRRPDLEPYLGLHYPATDIPQASRFLFLKNRVRMICDCRAPAVKVRHDKRVAQALSLSGSTLRAPYGCHAQYMANMGSIASLVMAVTVSNNEEGGRRLWGLVVCHHTVPRFVPYPLRYACEFLMQVFGVQLNKEVELAARLRERHILRTQTVLCDMLLRDAPVGIVTKTPNI

SEQ ID NO: 3552 - protein, 192 aa, Stangeria eriopus
DDHGEVVAEIRRSDLEPYLGLHHPATDIPQAARFLFMKNRVRMICDCCAAPVRVIQDKNLARDLTLCGSTLRAPHGCHSHYMSNMGSIASLVMAVIINEREDEEGDNLGQQQVKGRRLWGLVVCHHASPRFVPFPLRYACEFLMQVFGIQLNKEVELAAQLREKHILRTQTLLCDMLLRDAPIGIVIRSPSI

SEQ ID NO: 3553 - protein, 189 aa, Stangeria eriopus
DDHGEVLAEIRRSDLEPYLGLHYPATDIPQASRFLFMRNRVRMIYDCSSPPVKVIQDKRLPKPLSLCGSTLRAPHGWHAQYMANMGSIASLVMAVTINDSDDDIGSSGQQKGRRLWGLVVCHHTSPRFVPFPLRYACQFLMQVFGIQLNREVELAAQLREKHILRTQTMLCDMLLRDAPVGIVAQTPNI

SEQ ID NO: 3554 - protein, 131 aa, Glycine max
  misc_feature (67)..(67): Xaa can be any naturally occurring amino acid
  misc_feature (93)..(93): Xaa can be any naturally occurring amino acid
MASKAPKKANLLDHHSIKHILDESVSEVVTSRGFVEDVRLSNVRLLIGAIIIVIALFAQFYKKKFPXENRDFLIACIALYVIFNGLLQLIIYXTKEKNAILFTYPPVIVKGPTTQTDLRKTSALIMKSVYF

SEQ ID NO: 3555 - protein, 488 aa, Bacteroides thetaiotaomicron
MEEKKLTAANGRPIADNQNSQTAGQRGPVMLQDPWLIEKLAHFDREVIPERRMHAKGSGAFGTFTVTHDITKYTRAAIFSEVGKQTECFVRFSTVAGERGAADAERDIRGFAMKFYTEEGNWDLVGNNTPVFFLRDPLKFPDLNHAIKRDPKTNMRSPNSNWDFWTLLPEALHQVTITMSPRGIPYSYRHMHGFGSHTYSFINADNQRIWVKFHLRTLQGIKNLTDQEAEAIIAKDRESHQRDLFESIEKGDYPKWLFQIQLMTEEEADHYRINPFDLTKVWPHKDFPLQDVGILELNRNPENYFAEVEQAAFNPINTVDGIGFSPDKMLQGRLFSYGDAQRYRLGVNSEQIPVNKPRCPFHAYHRDGAMRVDGNYGATKGYEPNSYGEWKDSPHMKEPPLKASGNGEIYNYNEREYDDDYYSQPGDLFRLMPADEQQLLFENTARAMGDSELFIKQRHTRNCYKADPAYGAGVAKALGIDLQEALKE

SEQ ID NO: 3556 - protein, 137 aa, Brassica napus
  misc_feature (126)..(126): Xaa can be any naturally occurring amino acid
MASDGAAATPAKVTPKKANLLDPHSIKHLLDETISEVVKSKGYTEDTRLGNWKLGIGAAVIAVALLAQFYPKKFPQNRDFLLGCIALYVVLNVVLLILSYTKEKDAILFTHPPMGSFNNTGLVISXKLPRFSDMYTL

SEQ ID NO: 3557 - protein, 381 aa, Methylobacillus flagellatus
MIPARPSGVPELLTSPFSANRQDLSMAKLFTPIRFRDTEIKNRIFVSPMCQYSAEEGIANHWHLVHLGGLAVGGAGLIIVEATAVAPEGRITPFCLGLWSDAHTQAFKPIVDFIKQQGAIPAIQIAHAGRKASCDAPWRDGKFLPPEQGGWQTFAPSAIPVTPEHGTPHALSREEIQQVAAQFHAAAKRALDAGFEVLELHCAHGYLLHEFLSPLSNRREDEYGGSLENRCRLALDIARDLRTLWPQDKPVFVRISATDWVEGGWDIDQSIQFAKWLKEAGIDLIDCSSGGLILDAKIPAGPGYQTEFAQRIRHETGIATGAVGLITSAVQAEHILVSGQADVVMLARKLLSDPHWPLHAAKELRTDVTWPAQYVRAKHIE

SEQ ID NO: 3558 - protein, 205 aa, Eucalyptus globulus
MVRGKTQMKRIENDTSRQVTFSKRRNGLLKKAFELSVLCDAEVALIIFSPRGKLYEFSSSSLCKTIEKYQTRAKDMEAKTAEISMQPSKGNTLDMEKKIEHFEISRRRLLGEGLDSCSVEELQQTENQLERSLTKIRARKNHLIREHIERLKAEERKLLEEKRKLLQEIECGKGLTPVSSERPREEIRAESMDVETELFIGPPKR

SEQ ID NO: 3559 - protein, 306 aa, Oryza sativa
MPSHADLDRQISQLRECKFLGEAEVRALCEQAKAILMEEWNVQPVRCPVTVCGDIHGQFYDLIELFRIAGDSPDTNYLFMGDYVDRGYYSVETVTLLVALKVRYRDRITILRGNHESRQITQVYGFYDECLRKYGNANVWKYFTDLFDYLPLTALVENQVFCLHGGLSPSLDTLDNIRALDRIQEVPHEGPMCDLLWSDPDDRCGWGISPRGAGYTFGQDIAQQFNHTNGLTLISRAHQLVMEGFNWCQDKNVVTVFSAPNYCYRCGNMAAILEIGENMDQNFLQFDPAPRQIEPDTTRKTPDYFL

SEQ ID NO: 3560 - protein, 268 aa, Thiomicrospira crunogena
MKIVGLPTLSDNYTWVIQSENADDKRAWIVDPGESQKVIHYFEENQLQLDGILLTHHHYDHTDGIMGVMDALGEVAIVSNAQGPFKPVTHPVKEGDQVQVLNETFQVIETPGHTDEHICFYHPEALFSGDTLFTGGCGKIWQNPPEQMAESLLKLRALNDDCMVYCGHEYTYANLNFAKIAEPNTPAILDRLAEVKTNTQRNIPCVPARLGLEKQTNPFLRFDHPPLMQTLMERQAQPNESVSTLFATLRAWKDELDQTNILEAGLND

SEQ ID NO: 3561 - protein, 403 aa, Pseudomonas aeruginosa
MQVSKSNKLANVCYDIRGPVLKHAKRLEEEGHRILKLNIGNPAPFGFEAPEEILQDVIRNLPTAQGYSDSKGLFSARKAVMQYYQQKQVEGVGIEDIYLGNGVSELIVMSMQALLNNGDEVLIPAPDYPLWTAAVSLAGGKPVHYLCDEQANWWPDLEDIKAKITPNTRAMVIINPNNPTGAVYSREVLEGMVELARQHNLVLFSDEIYDKILYDGAVHVSTASLAPDVLCLTFNGLSKSYRVAGFRSGWVAISGPKQRAQSYIEGLDILANMRLCANVPAQHAIQTALGGYQSINDLVLPPGRLLEQRNRAWELLNDIPGVSCVKPMGALYAFPRIDPKVCPIHNDEKFVLDLLLSEKLLIVQGTAFNWPWPDHFRVVTLPRVDDLEQAILRIGSFLKGYQQ

SEQ ID NO: 3562 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPRSDLPERLVQNRSFNTFDLTKEDFEEIAKLDIGLRFNDPWDWDNIPIFV

SEQ ID NO: 3563 - protein, 589 aa, Zea mays
  misc_feature (559)..(559): Xaa can be any naturally occurring amino acid
  misc_feature (572)..(572): Xaa can be any naturally occurring amino acid
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIMPLYEKYGENFVDMLDGVFAFVLYDTRDRTYVAARDAIGVNPLYIGWGSDGSVWIASEMKALNEDCVRFEIFPPGHLYSSAGGGFRRWYTPHWFQEQVPRTPYQPLVLREAFEKAVIKRLMTDVPFGVLLSGGLDSSLVASVTKRHLVETEAAEKFGTELHSFVVGLEGSPDLKAAREVADYLGTIHHEFHFTVQDGIDAIEEVIYHDETYDVTTIRASTPMFLMARKIKSLGVKMVLSGEGSDELLGGYLYFHFAPNKEEFHRETCRKVKALHQYDCLRANKATSAWGLEVRVPFLDKEFINVAMGMDPEWKMYDKNLGRIEKWVMRKAFDDDEHPYLPKHILYRQKEQFSDGVGYNWIDGLKSFTEQQVTDEMMNNAAQMFPYNTPVNKEAYYYRMIFERLFPQDSARETVPWGPSIACSTPAAIEWVEQWKASNDPSGRFISSHDSAATDHTXAVSRRWPTAAATXAANGTVNGKDVAVAIAV

SEQ ID NO: 3564 - protein, 511 aa, Oryza sativa
MARMGISKGGSGKEAKKPPLLLGRFEVGKLLGQGNFAKVYHARNVATGEEVAIKVMEKEKIFKSGLTAHIKREIAVLRRVRHPHIVQLYEVMATKLRIYFVMEYVRGGELFARVARGRLPEADARRYFQQLVSAVAFCHARGVFHRDIKPENLLVDDAGDLKVSDFGLSAVADGMRRDGLFHTFCGTPAYVAPEVLSRRGYDAAGADLWSCGVVLFVLMAGYLPFQDRNLAGMYRKIHKGDFRCPKWFSPELIRLLRGVLVTNPQRRATAEGIMENEWFKIGFRRFSFRVEDDRTFTCFELDDDAAVDAPTSPPDTPRTVDSGDVGAAPTRPRKAGSLTSCDSAPSLLEGRFGLGGSSRRRSSLNAFDIISFSPGFDLSGLFDQDDGGGAGAGSIPEQQKHTARFVSAAPVEVIVATLEAAAAAAGMAVREREDGSISMEGTREGEHGALAVAAEIYELTPELVVVEVRRKAGGAAEYEEFFRARLKPSLRELVCDDRPCPEDSGELSRSL

SEQ ID NO: 3565 - protein, 140 aa, Glycine max
MVSFEMNDRKKIGLGLTGFGIFFSFLGLIFFFDKGLLAMGNILFVSGVSLTIGLKSTMQFFMKRSNFKGTISFGIGFFILILGWPILGMIVESYGFIILFSGFWPTLAVFLQKIPVLGWLFQQPYVRSLLDRYRGRRVPV

SEQ ID NO: 3566 - protein, 311 aa, Capsicum chinense
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGLSKTRPQLYQTTDVKGTFGYIDPEYFIKGRLTEKSDVYSFGVVLFEVLCARSAMVQSLPREMVNLAEWAVESHNNGQLEQIVDPNLADKIRPESLRKFGETAVKCLALSSEDRPSMGDALWKLECALRLQESVI

SEQ ID NO: 3567 - protein, 138 aa, Candida glabrata
MWLSESQKFGVAFTFGGVLFFIFGIFTFFDRALLALGNILFLIGVVLIIGSQKTLIFFSRPTKRRGSILFLLGIFLILIKWTFIGFLVESLGIVGLFGDFFGIIVQFLRSLPIIGPILSHPAVAPIVDKIAGVRVLPV

SEQ ID NO: 3568 - protein, 688 aa, Haemophilus ducreyi
MLTKIRIFMKVNKLSRLIAFCLGTMISTAFAIEPKIKANELVLPQPTELHNLSTKRVTARLTQSHYRKFNLDDEFAGKIFNRYIDWLDVAHNTFLQSDIDELRTKYASKLDEELYEGKLDSAFEMYDVMVKRRYERYKHVLSLLDKPLDLKGRDQIENEREKAPFPVTIEEANKLWEQRVKNDVISLTLKNKKWPEIKKTLIKRYNLAIKRLTQVKPDDVLQTYLNAFAREIDPHTSYLSPRAAKAFQESMNLSLEGIGATLSMEDDITTIKSLIPGAPAARSKKLGVGDKIVGVGQEKGEIEDVIGWRLDDVVDKIKGKKGSKVRLEIEPAKAHKTKIITLTRDTVRLEDSAAKLTIDKVAGKNIAVIKIPAFYIGLANDMHKLLAKIKTKKIEGLIVDLRDNGGGSLTEVVELTRLFIKSSPVVQVRDAFNRIKVYEDEPQIQVDKSVVTTNKPLYDGKLMVMINRHSASASEIFAAAMQDYNRAIIIGQQTFGKGTVQQSRSLNFVYDLDRDPLGFIQYTIQKFYRIDGGSTQLKGVQADIKFPEIIDAEKTGESFEDNALPWDKIPAANYQEVGNARDVVAVLTEKHQARIAKEPEFITLSENIAIRKERDQRKFTSLNLEERKKEDQADDMKRLKDLNARFIREGKKPLKNLDALPKDYEGPDFFLKEAKQMMFDWLQINKKA

SEQ ID NO: 3569 - protein, 1038 aa, Unknown
  Mesorhizobium sp. BNC1
MKFAESRTELLLYSAIAGLMALTFIADLYFPLGTAIWVIYLFPIALCYLVSRPVVPVAAATVVSFFVVIGFFYAPAGVDPDIARTNRVLGALTSWIIALTGYFFIRNKLAIQKQEWLQAGQVHLARSVSGNQKIEELSGNILAFLAEYLDAQAGALYVRRGSTFGRSGVYGVPAGAPIPDRFKPGDGLLGQAVADRRSFVLRDVPENYLYFGSGLGRAKPRHLLIAPASVDDEVNAVLELGFLKEAGEEVGELLERISEPMAIALRSARYRAQLQELLEETQRQAEELQTQSEELRSANEELENQSRSLQDSQVRLEEQQAELEQSNAQLEEQTQLLEVQRDELSRAQGALQAKARDLEEASRYKSEFLANMSHELRTPLNSLLIMARLLADNREGNLTSDQVKFAETIETAGNDLLNLINDILDISKIEAGHIELQIERVRVEPMLEKLRATFQSSASEKGLNFRIETVPGTPDRIESDPQRIEQVLKNFLSNAIKFTEKGEVVLSVAEEEDGRIAFAVRDTGIGIPEDQQQAIFEAFRQADGSINRKYGGTGLGLSISSELTRVLGGEIRVESTVGQGSSFILVVPKIYDAASVQKSAGAGRRTPVVSRAAPAAAESEAEKIDTVPARPRIIEDDRDKLTGGRVILVVEDDPAFARILMDLAHELGFECLVAETADEGVLLARRYLPAGVILDIGLPDHTGLSVLDRIKHDVRTRHIPVHVVSVSDYTRTARSFGAAGYMLKPVKREELERALTGLAKQLAQTVRRVLIVEDDATQLEALQLLLSSQDVETIAAASAAECFGKLKAETFDCMVLDLSLPDASGFEVLEQLSAEDAYSFPPTIVYTGRDLTPDEELRLRKFSKSIIIKGAKSPERLLDEVTLFLHQMVAELPERKREMLVRSLNRDAALEGRRILVVEDDIRNVYALMSVFEGHGAAVQIARNGREALQALEKMADEGNPAIDLVLMDVMMPEMDGLTATREIRKRERWKNLPIIVLTAKAMPGDQEQCLAAGANDYLAKPLDVDKLLSLARVWMPR

SEQ ID NO: 3570 - protein, 258 aa, Xylella fastidiosa
MRLTPLPAFDNNYIWTLIAPDGRAIIVDPGQALPILEAHSKGLIPTAILLTHHHADHIGGVPELLERWPTLPIYAPHDTRIALNYHRIGEGDSLNILGLRFQVIHTPGHTHSHLTFIGNDLLFCGDTLFSLGCGQIFEGTPTQMLASLQRLAALPIQTRVCCGHEYTLSNAAFALHVDPTNTALQKRRQQANAMRLANLPTLPISLESELNTNPFLRTAAPTIHAATATHLQRTPIDEVEVFATLRHWKNNFPIKNIP

SEQ ID NO: 3571 - protein, 140 aa, Zea mays
MVSFEMNDLKKIGLGLTGFGIFFSFLGIVFFFDKGLIAMGNILFLSGLGLTIGLKSTMQFFTKPKNYKGTISFGAGFFLVLIGWPFFGMLLEAYGFIVLFSGFWPTLSVFLQRIPIIGWIFQQPFVTSFLDRYRGKRVPV

SEQ ID NO: 3572 - protein, 678 aa, Agrobacterium tumefaciens
MSNDPLLQPYQLKHLTLRNRIIVTSHEPAYPEDGMPKGRYRAYTVERAKGGVALTMTAGSAAVSRDSPPVFNNLLAYKDEIVPWIREMTDAVHEQGAAIMIQLTHLGRRTRWDKGDWLPVLAPSHQREAAHRAFPKKIEDWDIERVIKDFADAAERMKAGGMDGVELEAYGHLIDQFVSPLTNELDGPYGGSLDNRMRFCLDVFKAMRERVGDDFILGVRYTADECLKGGTGKAEGLEISRRLRDSGLIDYLNVIRGHIDTDPGLTDVIPIQGMANAPHLDFAGEIRAATQFPTFHAAKIQDVATARHAIASGKVDMVGMTRAHMTDPHIVRKIMEKREDDIRPCVGANYCLDRIYQGGLAFCIHNAATGREETMPHDITRAAERRKVVIVGAGPAGLEAARVCAERGHDVVVFEAANDAGGQIRLTAQSERRREMIGIIDWRMSQCERLGVTFHFNSWAEADTVLSENPDVVIIATGGLPHTDVLSKGNDLVVSAWDIISGDVKPGTNVLVFDDAGDHAGLQAAECLAKAGAKVEIMTPDRAFAPEVMAMNLVPYMRALQKLDVTFTVTYRLEAAERNSNQLIAHVGSDYGGVAKSRNVDQIVVNHGTVPLDELYFELKSGSKNLGETSYDALLAGEAQTVERNPAGTYRLFRIGDAVAARNTHAAIYDALRLAKDI

SEQ ID NO: 3573 - protein, 677 aa, Unknown
  Burkholderia sp. 383
MTTTFPHLLAPLDLGFTTLKNRVLMGSMHTGLEDSRKTLPRLAEYFAERARGGVGLIVTGGFAPNVAGWTKPFGGTLMTSAAARRHREITDAVHREDGKIALQILHTGRYGYHPFAVAPSKIKSPISPFAPHELSAGGVERQIRAFVRCAKLAREAGYDGVEIMGSEGYLINQFISMHTNKRTDQWGGSYENRIRLPIEIIERTREAVGRDFILIYRLSMLDLIPDGSDWSETVQLAKAVERAGATIINTGIGWHEARVPTIATSVPRGAFAWVTKKMKGEVGIPLVTTNRINRPEVAEQILADGCADMVSMARPLLADAEFVVKAAQGRADEINTCIGCNQACLDHAFKNKIASCLLNPRACHETELKYTPAAQPKRIAVVGAGPAGLACSTVLAQRGHQVDLFDGAAEIGGQFNMAKRVPGKEEFHEALSYFGRQVELTGVNLHLNRRVDASDLIAGGYDEIVLATGVAPRDPKIPGQDGPNVLSYIDVLAGRQPVGRRVAVVGAGGIGFDVAEYLVQEGESPALDLDEWKAEWGVTDPAATRGGVTRAQVTAPAREVTLLQRKAAPLGKGLGKTTGWIHRATLKMKQVKMIGGVNYELIDARGLHVSYGEQRTDHELIEADTIVLCTGQEPQRALLAPLQAAGRSVHLIGGAELAAELDAKRAIDQGSRLAARL

SEQ ID NO: 3574 - protein, 502 aa, Glycine max
  misc_feature (421)..(421): Xaa can be any naturally occurring amino acid
  misc_feature (451)..(451): Xaa can be any naturally occurring amino acid
  misc_feature (470)..(470): Xaa can be any naturally occurring amino acid
  misc_feature (480)..(480): Xaa can be any naturally occurring amino acid
  misc_feature (493)..(493): Xaa can be any naturally occurring amino acid
FGSRLAQAQECVFENTIAKGSTPGVCAKISRQVGIYYEEALAALNVAPLSQHFDKSWIVHVQLKAALFYAEACYRYGLELHDKEEIAEEIARLRSAVNVLTEAKKSSKGAAAQILDAIGKLEANINRNLERAVKENDRVYLMRVPSPSSLPPLPAFSMVKSMVMNEMLDASKEKMFASLVPDNSAKALSRYTEMVDDVIRTQAEKLQQASELTRVRLKEMELPESILALEGNFTLPTSLKEDVEAVQISGGPAGLEAELQQLKDLRRVNQELLVQTEELLQKEAREDSQFRSQFGTKWTRPQSSTLTKNLQDRLNRFAGNLKQAAESDGRIERSVREHSALMSILDARPIESALPSLARPIMSFDQNEDAIVGSLKQSLRQLETLGAQRAGLEDMLKEMKRKDDILPKLMTSTGSYDDLFXKEIAKYDHICEEIAQNIEAQEQLLLQIQAXNDEFSVIFNLEDYKASREXLQQIEAAIAXFKRNKGHINERLXKFYVTLQDA

SEQ ID NO: 3575 - protein, 107 aa, Candida albicans
MSSYEFPIVSVKNLPYNTSNSSLYEFFGKYGYINQIRINSSQPGTCFIIYHNIKNAQRAAQDLNGVNFNGRYLVTSMYQVDKSKINEEEMALRQEQLNLLKQQYSIK

SEQ ID NO: 3576 - protein, 502 aa, Medicago sativa
MDGASGGSGGGEGSTTQIPAPTPMLNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPMSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 3577 - protein, 255 aa, Rhodobacter blasticus
MALNLLTVPCLKDNFAFLLHDAASGRTALVDAPEAAPVLSALAAQGWRLTDILLTHHHDDHIQAVPEIHAATGARVHGAAADAHRLPPLDHALREGDRVAIGAESAVVIDVPGHTRGHIAFHFPGSALAFTGDSLMAAGCGRLFEGTPAEMWASLSKLAALPPETLICSGHDYLDGNLRFALALEPGNPALISRQGRLSEMRREGRLPMPWTLAEELATNPFLRAPLPQMKAAVGLPQASDTVVFAEIRARKDLF

SEQ ID NO: 3578 - protein, 535 aa, Ralstonia metallidurans
MRKTLKNISLVSIGVVAGVLATLQISATAQNTTGPLPLDQLRLMADIFGQIKREYVEPVDDKKLLTEAIKGMVASLDPHSAYLDEKDFKELQEGTRGRFAGLGIEISQEEGLVKVINPIEDTPAFRAGIQPGDLITRIDDKPVRGLPLEQAVKRMRGEPGTKVTLTIYRKSEERTFPVSITRAEIRVQSVKTKMLDNNTIGWVRLTSFQERTVTDLGRRLKEMADKNPNLRGIVLDLRNNGGGVLQGAVGVAAAFLPEDSVVVSTNGQVPDAKRVYKASFSNYRLSSLEDDPLKDLPAEFKKLPMVVLTNAYSASASEIVAGALQDHKRATLMGKTTFGKGSVQTVRPLTNDTGIKLTIAYYYTPSGKSIQAKGIRPDIPVDQNPDGDPDDALITREIDTERHLHNKQESEEPEMAEREQRRVEELRRLEEENAKKTPEEREKERKKKPVEFGSADDFMLQQAIAQLDGKPVQRSKSRLEATGTAGKPDSSDNPKPASKAPAKPAAKPAAPAKPSSPPPASAPIGEPLGTPTGKK

SEQ ID NO: 3579 - protein, 276 aa, Triticum aestivum
MMSMMADLSCGASGVTANDHQLAAPAPEDSAVAGSEKMGRGRIEIKRIENTTNRQVTFCKRRNGLLKKAYELSVLCDAEVALIVFSSRGRLYEYSNNSVKATIERYKKANSDTSNSGTVAEVNAQYYQQESSKLRQQISSLQNSNSRSLVRDSVSTMTLRDLKQLEGRLEKGIAKIRARKNELMYAEVEYMQKREMELHNDNIYLRSKVSENERGQQPMNMMASGSTSSEYDHMVPPYDSRNFLQANILQQQQQQQQHYSQQLQPTALQLGQQYFN

SEQ ID NO: 3580 - protein, 374 aa, Leptospira interrogans
MSFHFQTFYGIFSLEFTDPQKNSVGIIFLEESMSVHPTQTLSLSQYLIEEQLKLPQATGDFTALMSHLVYAAKIVSREVRKAGLLENILGATETVNVQGETQMKLDEYADKVFNHTLTRSGHLCILGSEEHEETVPVPNGYKIGKYTIAIDPLDGSSNIDANVSIGTIFSVHLRKSPAGTPGTLSDLLQQGSGQRAAGYVLYGSSTMLILCTGKGVSGFTLDPSCGEFILSHPDMQIPETGGIYSINEGNYNYWSDEVKNYIRDIKSIEGGRKPQSGRYIGSLVADFHRNLLKGGIFLYPNDTKSTKYPNGKLRLLYEAAPMAFIAEQAGGMAVTVYGERILDLTPKELHERTTLVVGSKKEVEHFLKFAPKKS

SEQ ID NO: 3581 - protein, 639 aa, Solibacter usitatus
MCGIAGFTRLNKYASRGVAQRITEALSHRGPDQQGVFEGSEATLCAVRLKIIDLAGGDQPILSDDGDTAIAFNGEIYNHREVRGELEALGHRFRSNCDTETVLRAFLQWDTAAFQRLRGMFAIALWTESRKRLLLVRDRMGIKPLYYYRSGDDLYFGSELKAILEHPDVPRTLDLSALDTYLSVNYVPGPQTLIRGIRKVPPGHLLEWRHGKAWCEAWWKRPDSGTRRISLGAAKEQLDVLMKDSVREHLVSDVPLGVWASGGLDSSAILHYAAAQTAGRLKTFSVSFEGRSFDESRYFREIAQVYGTDHHEFDLNPDVELQSAIEDFAYYSDEPSADAGALPVWFLSRMSRRHVTVALSGEGADELFGGYLTYQADRLARPFRMVPAGLRRLMRGALDRYMPVSDDKISLEYKLKRWIDGSLLNADEAHFFWNGTFSPEQLRQIRPGTNGNGLQRMVEGLNGPREVVQRYLDVDQSFYLPDDILYKTDRMSMAHSLEVRPPFLDHRIVEFAASLPQRLKIRGAKQKHVLRELMRGKLPESVLTRKKSGFDIPTHDWFRGTLRGMLMDTLTPDAIAATGVFDANAIDGLIRDHMERRINVGYHLWGLLTLFLWMKRWKVEALPPEEEMRQVPARVLATR

SEQ ID NO: 3582 - protein, 252 aa, Thermosynechococcus elongatus
MMIYRLNALTDNYIFLLHDPQTGTAAVVDPAEPEPVLAKLAELGATLRAIFNTHHHWDHVGANCALRSRFPDIAVYGSSEDQGRIPEQTVFLKAGDRVPFGQTYFDVLFVPGHTRGHIAYYAPTTGDLFCGDTLFGGGCGRLFEGSPAQMLDSLNQLRQLPEETRVWCAHEYTQKNLSFALTVEADNPTLQERYAQVCRDRAQGKATIPSTIGLEKATNPFLRCEVRSIQIAVGATTPLQTFTRLRGKRDQY

SEQ ID NO: 3583 - protein, 216 aa, Dendrobium thyrsiflorum
KAHEISVLCDAEVAVIVFSNKGKLYEYSTDSSMEKILERYERYSYAERALFSNEANPQADWRLEYNKLKARVESLQKSQRHLMGEQLDSLSIKELQHVEQQLESSLKHIRSRKAQLILDSISELQKKEKILLEQNKTLEKEIIAKEKAKALMQNAPWEKQNLSRYSSAPLHVISDSVPTPTSRTFQAIANEEESPQAQLRVSNTLLPPWMLGHMNG

SEQ ID NO: 3584 - protein, 229 aa, Ipomoea batatas
MAREKIKIKKIDNITARQVTFSKRRRGLFKKAEELAVLCDADVALIVFSATGKLFEFASSNMKDILGKYELHSSNLDQATQPSRELQLENSLHVRLSKEVADKTRELRQMKGEELQGLSLEELQKLEKRLENGLTRVLETKGERVVTEIATLQRKGAELMKENKQLKEKMARVNGEKFPVIADVEAAGLIPEEGQSSESITTNVCSCNSGPPPEDDCSDTSLKLGLPIN

SEQ ID NO: 3585 - protein, 445 aa, Arabidopsis thaliana
MEEERRVLFGKYEMGRLLGKGTFAKVYYGKEIIGGECVAIKVINKDQVMKRPGMMEQIKREISIMKLVRHPNIVELKEVMATKTKIFFVMEFVKGGELFCKISKGKLHEDAARRYFQQLISAVDYCHSRGVSHRDLKPENLLLDENGDLKISDFGLSALPEQILQDGLLHTQCGTPAYVAPEVLKKKGYDGAKADIWSCGVVLYVLLAGCLPFQDENLMNMYRKIFRADFEFPPWFSPEARRLISKLLVVDPDRRISIPAIMRTPWLRKNFTPPLAFKIDEPICSQSSKNNEEEEEDGDCENQTEPISPKFFNAFEFISSMSSGFDLSSLFESKRKVQSVFTSRSSATEVMEKIETVTKEMNMKVKRTKDFKVKMEGKTEGRKGRLSMTAEVFEVAPEISVVEFCKSAGDTLEYDRLYEEEVRPALNDIVWSWHGDNNNTSSEDC

SEQ ID NO: 3586 - protein, 248 aa, Populus trichocarpa
MGRGRVQLKRIENKINRQVTFSKRRTGLLKKANEISVLCDAEVALIVFSHKGKLFEYSTDDSMEKILERYERYSYAERQLVATDLDSQGNWTLEYNRLKAKVELLQRNHRNYLGEDLDSMSLKELQNLEQQIDTALKHIRARKNHLMSQSISELQRKEKAIQVQNNMLVKQIKEKEKNDKALAQPAFWDLQDHGPNASSFLLSQPAGLPLPCLNIGGSHQEEAPEARRNELGHTLEPIYSFHLGGYGA

SEQ ID NO: 3587 - protein, 678 aa, Aspergillus nidulans
MTTFKLNTGATIPALGFGTWQDADAQETAVLEALRAGYRHIDTARVYGTEAAVGRAIKKSGIPRNQIFLTTKIWNNKHHPDDVAQALQDSLNDLDQDYVDLLLIHWPVAFKRGTEQFPKTEDGKPAVADTDYLDTYKALEKLLSTGKVKAIGVSNFSKAEMERILANATVPPAVHQLEGHPWLQQREFAEWHKKHGIHITHYSPFGNQNEVYSREGTIGRLIEDPVLVEIGKKYNKSAAQVALAWGVTEGHSVLPKSKTPERIKANLEGDFKLEEEDLKKIRGIDRKLRFNDSSKDFGNAASATPRAYSALMADSVILRGQAIHDQDSDSSGLLQVGTFQNALLNLIESPSGRFMQQNWQEYLGRSVDSVVNVVGNAKEDTKFPLDRLSKMDRYGQTGNKTYKNILDSLRFSIDLQPRNQFGGLWYYVYPNWSYLDGMFSLLSFSPMYASTFDIANSTLMNRDLFNQLDLLWSHCRDNRTGLLVHGYDASRTAPWANPVTGASPIVWIRALGWFMMALVDLFEHDLMDARVSIWRTRFVDLANALVDAVDSTSGAWWQVMSAPGQEGNYIESSGSAMFVYALYKGVRVGILPAPEKGGEAYIEVAERAYSELVKRFIVENEDGTLSYNGTVGVCSLNSTATYDYYIHQPLVYDSVLGSAAFIRASTEHELHLEASLNL

SEQ ID NO: 3588 - protein, 480 aa, Pantoea agglomerans
MKNGMLALGMTAADVPDNFLWGAASAAYQVEGATNKDGKGRSVWDYYLDEKHLAGPGISGALRLTFTDRDQYLKDIQLFKELGLNSYRFSHRLDTYYPDGQGPVNLRAVAHYRQFITDLEAAGIKPLVTLYHWDMPESLSAAGGWENRESVEWFQRYAEVIFANFSDQVDQFVLINEPTVEVATKIMAEKRLKGEELTLPPIVPAGSYLETSLKSYNHILLASAAAAESFKVKGYKGRLGIALPFFPVLTTENASDEDKADARLVDGILNRWFLDAMYKGNYPADVLKLAADRHLNIDVQPGDAERIHDAGLGFLGINYYAPFFIRHQKNASEVYSPEIIFPKNEKLAFNGAVRPDQFSALLERVRDEYGNPPVIITENGAGFEGEDQLTNGKVNDVNRCLYLVDHIHAMRESIARGANVQGYYVWSSHDNLEWLSGYKSRFGMIYVDYDTQKRTPKLSAEIYGKIIRGENISDVDCKSD

SEQ ID NO: 3589 - protein, 550 aa, Photobacterium profundum
MAAKDVKFGNDARIKMLEGVNVLADAVKVTLGPKGRNVVLDKSFGAPTITKDGVSVAREIELEDKFQNMGAQMVKEVASQANDAAGDGTTTATVLAQSIIAEGLKAVAAGMNPMDLKRGIDKAVIAAVAALKELSVPCEDTKAIAQVGTISANADATVGNLIAEAMEKVGRDGVITVEEGQALHDELDVVEGMQFDRGYLSPYFINNQEAGSIDLESPFILLVDKKVSNIRELLPALEGVAKASRPLLIIAEDVEGEALATLVVNNMRGIVKVAAVKAPGFGDRRKSMLQDIAVLTAGTVISEEIGLELEKVQLEDLGQAKRITITKENTTIIDGAGEETMIQGRVAQIRQQIEDATSDYDKEKLQERVAKLAGGVAVIKVGAATEVEMKEKKDRVQDALHATRAAVEEGVVAGGGVALIRAASKVAASGLEGDNEEQNVGIRVALRAMESPLRQIVKNAGDEDSVVANNVRAGEGNYGYNAATGVYGDMIAMGILDPTKVTRSALQFAASVAGLMITTEAMITDMPAKDASAMPDMGGMGGMGGMGGMM

SEQ ID NO: 3590 - protein, 434 aa, Leptospira interrogans
MRRNIVHSGADALIYEIRQIVAVAKKLEALGLQITYENIGDPILKGESIPDWMKEIVSNLILKDKSWAYTATQGYEPTRKFLAEKVNERGGAQISADDLLFFNGLGDAVAKIFGFMRREARVLGPSPAYSTISSAEAAHSGYEHLTYNLLPEHNWMPDLEDMENKVKYNDSIAGILLINPDNPTGAVYDKNLMKKIVAICEKYDLMLICDETYAHVNYSDHGPLHLSEVIGDKVPGMALRSISKEFPWPGGRCGWLEIFNKEKDPVFSRYVKSLLDAKMLEVCSTTLPQMAIPEVYSHPDFIPHLKRRNEKFKKRAHVATEYFAELRGVKVVEPKGAFYLTVAFDDDVLNSSMKLEIENKKADEFIQPLLASAANDRRFVYYLLASTGICVVPLSAFCTLKDGFRVTLLEEDEEKFNWIYKTLRDKIGEYIASA

SEQ ID NO: 3591 - protein, 263 aa, Zea mays
MRTCTTFSPNSSMFRNYEFNSKNLKWDFLGLVCPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSMLKLFLISFNLIQYMCNGRTSSDQYQFVFRLNEIERV

SEQ ID NO: 3592 - protein, 214 aa, Dendrobium thyrsiflorum
KAHEISILCDTEVALIIFSTKGKLYEYSTDSCMDRILERYERYCYAEKALQNTEPESQGDMSQEYGKLKNKIEALQKSRSHLMGENLDTLSLKELQHLEQQLETALKHIRSQRTQLLLNSIAELQRKEKSLLEHNSLLEKKITENESTTAMTQDLNPKQQRQAQESSSPPPFINDIPTLNLGTYPVSHGEEVAEPPLTGMNSNSLPPWMLRSLT

SEQ ID NO: 3593 - protein, 475 aa, Streptococcus agalactiae
MTVFPKHFLWGGAVAANQVEGAFRTDGKGLSVQDVLPNGGLGDFTAKPTPDNLKLEAIDFYHNYKNDIKLFAEMGFKVFRTSIAWSRIFPNGDDSAPNEAGLQFYDNLFDELLKYNIEPLVTLSHYETPLHLAKTYNGWADRRLIAFFEKFAQTVMERYKDKVKYWLTFNEVNSILHMPFTSGAIMTDKSQLSPQELYQAIHHELVASARVTKLGRSINPNFKIGCMILAMPAYPMTSDPRDVLAARQFEQHNLLFSDIHVRGKYPTYIQSYFKNNGIKIKFEEGDEEVLAQNTVDFLSFSYYMSVTQAYDFENYQSGQGNILGGLTNPHLTTSEWGWQIDPIGLRLVLNQYYERYQIPLFIVENGLGAKDQLIETLDGDYTVEDDYRIDYMNQHLVQVAKAIEDGVEIMGYTSWGCIDCVSMSTAQLSKRYGLIYVDRNDDGTGSLQRYKKKSFGWYQKVIKTNGQSLFEHHNR

SEQ ID NO: 3594 - protein, 428 aa, Pfiesteria piscicida
MKWGDVGGSGSKDVPIAKDAARGAEIGGRGAAVAPSIGQSESSGSFQKLCGEVLLDLPKHLVAVKQVGKGAYGEVFLCKDERTQGQVAVKVIRDFTKDLLFGKRIFREVKILMALQHENLMRLIDLPAVPSPDFNVVYMVMPYMLADLHRMIYSSLKLVESHCQAFTCQILRGLKYLHSAGIVHRDLKPANIMVNKNCTLRITDFGLARGRCDDEEVLTDYVVTRWYRAPELMLVPSSYFEAIDLWSVGCIHFECVARTVLFPGEHHFDMLKKIADTLGMFTPEGVAWCPQDQKGEVDTMLNKLEDLRSKELNSLASRLPEASEVCLDLLLKLLDKVPSTRISAAEALEHPYLQHLRDPAGETVAKRPFAWDFDVFEPSERALKDRIYAECARIHPEIITRDAKYLMDRGFKVPAQRPSPADEKPDGS

SEQ ID NO: 3595 - protein, 420 aa, Symbiobacterium thermophilum
MFATERMTLNMDERRTRFGLSLLLVAVTGVVSYALGALGWPPALQESMSQLRDRLPVAGSSLSGLQVERLEEVMRAIQGQYVEEVDVEALNVGALRGMVEALGDRYSTFFTPEEYRSFVEGFEPTFSGIGVTVEISQQTGLLTVVSPIKGSPGAKAGLRTGDAIIQVDGRDITGMSLNEAVALIKGPKGTQVRLLVKREGEPEPLEFVITRDTITVPVLDYRMIDQEAGIGYIQLFEFSKKGAASQVKEAIAELRSQGMTRLIFDVRQNPGGLLDEVVEIASFFLPTGDPVVHIVERAKEPRALTAKEAEKWTGPLVVLVDGGSASASEILAGAVKDAGVGTLIGAKTFGKGSVQTFWRLQDGSGIKLTTAKYLTAGGHSIDGQGVEPDIVVGNPNRIIPGEPGDPQLEAAVRHIREMEP

SEQ ID NO: 3596 - protein, 583 aa, Securigera parviflora
MCGILAVLCAENSQAKRVRVLELSRRLKHRGPDWSGLHQHGDCYLAHQRLAIVDPASGDQPLFNEDKSLIVTVNGEIYNHEELRKQLPNHKFRTGSDCDVIAHLYEEHGENFVDMLDGIFSFVLLDTRDNTFIVARDAIGVTSLYIGWGLDGSVWISSEMKGLNDDCEHFECFPPGHLYSSKDRAFRRWYNPPWFSETIPSAPYDPLALRHAFEKAVIKRLMTDVPFGVLLSGGLDSSLVASITSRYLATTKAAEQWGSKLHSFCVGLEGSPDLKAAKEVADYLGTVHHEFTFTVQDGIDAIEDVIYHVETYDVTTIRASTPMFLMSRKIKSLGVKWVISGEGSDEIFGGYLYFHKAPNKEEFHRETCRKIKALYQYDCLRANKSTFAWGLEARVPFLDKEFINVAMNIDPENKMIKRDEGRMEKYILRRAFDDEEHPYLPKHILYRQKEQFSDGVGYSWIDGLKEHAAKHVTDKMIFNAANIFPHNTPTTKEAYYYRMIFERFFPQNSARLTVPGGASVACSTAKAVEWDAAWSNNLDPSGRAALGVHLSAYDNQNNLANKPVEFEKIIPMEAPSLGVAIQS

SEQ ID NO: 3597 - protein, 309 aa, Kluyveromyces lactis
MTSPSGEFPSLKLNTGASIPQLGFGTWPSSHADAYTAVITALKTGYRHIDAAAMYGNEAAVGKGIRDSGIPREEIFVTTKLWNTQQRDPASALDESLERLGLDYVDLFLIHWPVPLKPVGGPENLLKYPTPGIKPQIDTEDWSFIKTWELMQTLPKTGKTRAVGVSNFSIKNLEDLLNSSPDVLVPAVNQFEIHPQLPQTELINYCKSKGIVVEAYCPLGSSSSAMLSDPTIAEIADKYHVKPANVLINWGISRGYCVLPKSFTPARIASNKTPVHLSREDTERITKLSETLGVKRYVHPDFEPYPLFE

SEQ ID NO: 3598 - protein, 269 aa, Brassica napus
  misc_feature (15)..(15): Xaa can be any naturally occurring amino acid
PTRPCLLDEEAIKVXGGSNHSHATKDLYDSIAAGNYPEWHLFVQVDPRVRMDPAHEDKVDFDPLDVTKIWPEDVLPLQPVGRLVLNKNIDNFFNENEQIAFCPAIVVPGVHYSDDKLLQTRIFSYADSQRHRLGPNYLQLPVNAPKCAHHNNHHEGFMNFMHRDEEVNYFPSRLNPVRHADKYPTTPVFCSGNREKCMIEKENNFQQPGERYRSWDADRQERFVKRFVEALAEPRVTHEIRSIWISYWTQADKSLGQKLASRLNVRPKY

SEQ ID NO: 3599 - protein, 205 aa, Brassica rapa
MAMLGGVRDVPANQNSGEVESLARFAVDEHNKKENALLEFARVVKAKEQVVAGTMHHLTLEIIEAGKKLYEAKVWVKPWLNFKELQEFKPASDDGSPSATITPSDLGCKKGEGASGWREVPGDDPEVQHVADHAVKTIQQRSNSLFPYELQEVVHANAEVTGEAAKYNMVLKLKRGEKEEKFKVEVHKNHEGVLHLNHMEQQHHD

SEQ ID NO: 3600 - protein, 282 aa, Thermosynechococcus elongatus
MFESFMTSVSSLPSRPLRPNWGVIFFMAIVHLGALLVFVPGTFSWSAVLLCFVLYWVSGGLGITLGWHRLVTHRSFQCPKWLEYFFVFCGTLACEGGIIEWVGLHRNHHLHSDQELDQHNSQKGFWWSHMGWMLQEVPAKAEVERLTKDINTDPVYRFLNQQFLPIQGVLGVLLYLWGGLPFVVWGIFVRLVLVYHLTWFVNSATHKFGYRTFESGDRSTNCWWVALLTFGEGWHNNHHTYPHSARHGLQWWEFDITWITIRALQGIGLAQKVRLVEAPPKQ

SEQ ID NO: 3601 - protein, 323 aa, Vicia faba
MSAQGQPQVQAQVQGIDEAVLDDIIRRLTEVRLSRPGKQVQLSEAEIKQLCLASRDIFLQQPNLLELEAPIKICGDIHGQYSDLLRLFEYGGLPPKSNYLFLGDYVDRGKQSLETICLLLAYKIKYPENFFLLRGNHECASINRIYGFYDECKRRFNVRLWKAFTDSFNCLPVAALIDDKILCMHGGLSPDLTNLDQIRILPRPVAIPDTGLLCDLLWSDPGRDVKGWGMNDRGVSYTFGPDKVAEFLSMHDLDLICRAHQVVEDGYEFFADRQLVTIFSAPNYCGEFDNAGAMMSVDENLMCSFQILKPAEKKTKFVMSNKM

SEQ ID NO: 3602 - protein, 845 aa, Arabidopsis thaliana
MRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWISYWSQVRPSSAHDSPFFTTNSGAPVWNNNSSLTVGTRGPILLEDYHLLEKLANFDRERIPERVVHARGASAKGFFEVTHDITQLTSADFLRGPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPGIHYSDDKLLQTRIFSYADSQRHRLGPNYLQLPVNAPKCAHHNNHHDGFMNFMHRDEEVNYFPSRLDPVRHAEKYPTTPIVCSGNREKCFIGKENNFKQPGERYRSWDSDRQERFVKRFVEALSEPRVTHEIRSIWISYWSQADKSLGQKLATRLNVRPNF

SEQ ID NO: 3603 - protein, 630 aa, Fusarium oxysporum
MSLLRLCMHASPLRALRYSFIPNRVQLARSTTILHPARFTTMPPKRTKRESSSPPAKKAKTSKTNGSSTSDALRQPHHKAGEAEENGIAIRKFYPPEMSNARARAYNNNELPRPIEVLISALENTAQERKSIDVKKAVVHWFKMDLRLSDNRALALASDKAKEAGVPLIAMYIISPQDYEAHLRSPVRVDFMLRTLEVIKHDLAKLDIPLYVETVEKRKRVPDRILELMDQWGAGHLYANMEYEVDELRREASMIRDFAENGKAFEVVHDTCVVPPGELHTGAGKQYAVYTPWYRSWVAHIHENLDLLELYEPPEKNPSSARKVFAKLFDVEIPDAPKSKRLDGEEKERLRSLWPCGEHEAKKRLDKFCEEMIGNYQKKRNIPAEAGTSSISVHLASGTISARTCVRTARDRNKTKKLNGGNEGIQTWISEVAWRDFYKHVLVHWPYVCMNKPFKPEYSNISWSYDNEHFAAWCEGRTGFPIVDAAMRQLNHLGYMHNRCRMIVACFLAKDLLLDWRKGERYFMEHLVDGDFASNNGGWGFSASVGVDPQPYFRIFNPLLQSEKFDPDGDYIRKWVPELKDLDRKAIHDPYNRGAGSKAKKNGYPAPIVTHKDCRDRALAAYKEGLASGE

SEQ ID NO: 3604 - protein, 77 aa, Unknown
  Fragaria x ananassa
PTDWRSPYAHVLVSDLPGMKKEEVKVEVDDGRVLQISGERKVKDGNGGSDKNDPECKWHRVERCRGKFLRRFTQDSS

SEQ ID NO: 3605 - protein, 727 aa, Yersinia pestis
MSVLPDRQVINQLISGHYGDPFSILGMHETSQGLQICALLPDAREVWLVETENGRRIAQLTLEDPRGFFIAQLTRRKKSFRYQFAVTWQENPQIIEDPYRFGPLLQDIDSWLLAEGTHLRPYERLGAHLMSLDGVSGVSFAVWAPNAQRVSVVGDFNFWDGRRHPMRLRRENGIWELFLPGIEAGQLYKFEIIDCHGQVRLKADPYAFEAQMRPETASLISPLPDVVKSSAARQKANDLCSPVSIYEVHLGSWRRHTDNNFWLSYRELADQLVEYVKYMGFTHVELLPINEHPFDGSWGYQPLGLYAPTRRYGTPEDFKAFVAKFHQAGINVILDWVPGHFPSDEHGLSTFDGTALYEYADPREGYHQDWNTLIYNYGRNEVRNYLAGNAFYWMERFGIDALRIDAVASMIYRDYSRAEGQWVPNYYGGRENLEAIAFLRYTNKTIGVERPGSVTMAEESTDFPGVTLPPDIGGLGFNYKWNMGWMHDTLNYMQCDPVHRKYHHNLMTFGMLYAYTENFILPLSHDEVVHGKRSILDRMPGDAWQKFANLRAYYAFMWAHPGKKLLFMGCEFAQGREWNFETSLDWHLLDDENGWHSGVQRLVRDLNHCYRQYAPLYEWDYQPAGFEWLVVDDHENSVFAFLRRDAEGHELIAISNFTPVPRYHYRVGIPQGGHYREVLNSDSAFYCGSNLGNQGGIDSHHVRSHNHEHSLLLTLPPLATIYLLREN

SEQ ID NO: 3606 - protein, 217 aa, Triticum aestivum
  misc_feature (156)..(156): Xaa can be any naturally occurring amino acid
  misc_feature (158)..(158): Xaa can be any naturally occurring amino acid
  misc_feature (162)..(162): Xaa can be any naturally occurring amino acid
  misc_feature (171)..(171): Xaa can be any naturally occurring amino acid
  misc_feature (186)..(186): Xaa can be any naturally occurring amino acid
  misc_feature (199)..(199): Xaa can be any naturally occurring amino acid
  misc_feature (207)..(207): Xaa can be any naturally occurring amino acid
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDALASPPLFGGNDVVGFEXSXMTMXGALNDDCEXLWEIFPPGHLYSSKXQGGFMRWYNPPWXFSEVIPSXAYDPLCSQGG

SEQ ID NO: 3607 - protein, 427 aa, Oryza sativa
MENGGGDASAAAWRFGAANPAMEAARSQSIRALVYRVYACLDRGDARSVAPLGHGDPAAFACFRAAPAATGAVVAAAASGAHNSYAPAAGIAEACSAVAAHLSRELPYAVSPADVVLTAGCNHAVEIMMSVLASPGANVLLPRPGYPLYASRAALSGLEFRHFDLLPDSEWEVDLAGVEALADANTVAMVIVNPNNPCGCVYSRDHLAKIAETARKLGIMVISDEVYDHFAFGSKPFVPMGVFGDVAPVMTLGGISKRWMVPGWRLGWIAATDPNGILRNKKIIDSVIDYRAISVDPVTFVQGALPDILAKTDDAFFTNALGVVKKAAEICYEKLKEIDCITCPHKPEGSMFVMAKLDLSSLDGIEDDVDFCSKLAKEESVVICPGSGLGMKNWLRITFAVDPQLLEDGLERTKCFCKRHGKIKEAS

SEQ ID NO: 3608 - protein, 186 aa, Arabidopsis thaliana
MVHSKKFRGVRQRQWGSWVSEIRHPLLVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQV

SEQ ID NO: 3609 - protein, 473 aa, Zea mays
FAAVVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDAIAAGITSRDGFPANADDIFITDGASPGVHMMMQLLIRNEKDGILCPIPQYPLYSASIALHGGALVPYYLDEKTGWGLEISDLKKQLEDARSKGIDVRALVVINPGNPTGQVLAEDNQYDIVKFCKNEGLVLLADEVYQENIYVDNKKFNSFKKIARSMGYGEDDLPLVSFQSVSKGYYGECGKRGGYMEITGFSAPVREQIYKVASVNLCSNITGQILASLVMNPPKVGDESYASYKAEKDGILQSLARRAKALEDAFNTLEGFSCNKAEGAMYLFPQIHLPHKAIEAAKAAKKAPDAFYALRLLESTGIVVVPGSGFGQVPGTWHVRCTILPQEDKIPAVITRFKAFHEAFMAEYRD

SEQ ID NO: 3610 - protein, 544 aa, Treponema pallidum
MANELLFNEEARKKLLSGVEQISSAVKVTLGPKGRNVLLEKGYGAPTVTKDGVSVAKEVELEDPFENMGAQLLKEVATKTNDVAGDGTTTATVLAYSMVREGLKAVAAGMTPLELKRGMDKAVAIAVDDIKQNSKGIKSNEEVAHVASVSANNDKEIGRILASAIEKVGNDGVIDVDEAQTMETVTEFVEGMQFDRGYISSYFVTDRDRMETVYENPYILIYDKSISTMKDLLPLLEKIAQTGRPLLIIAEDVEGEALATLVVNSLRGTLKTCAVKAPGFGDRRKEMLEDIAILSGGQVISEDLGLKLESADIALLGQAKSVKVDKENTTIIDGSGKSKDIKDRIEQIKKQIEASTSDYDSEKLKERLAKLSGGVAVIKIGAVTEVEMKEKKHRVEDALNATRAAIEEGIVAGGGLALIQAAAALEKADLSGLTPDEAVGFKIVRRALEEPIRQISENAGIDGAVVAEKAKEKRGIGFDASKMEWVDMIKVGIIDPAKVTRSALQNAASVSGLLLTTECAIAAIGQKSSSTPPAPDMGGMGGMY

SEQ ID NO: 3611 - protein, 871 aa, Solanum tuberosum
MVYILSGVRFPTVPSVYKSNGFSSNGDRRNANVSVFLKKHSLSRKILAEKSSYNSEFRPSTVAASGKVLVPGTQSDSSSSSTDQFEFTETSPENSPASTDVDSSTMEHASQIKTENDDVEPSSDLTGSVEELDFASSLQLQEGGKLEESKTLNTSEETIIDESDRIRERGIPPPGLGQKIYEIDPLLTNYRQHLDYRYSQYKKLREAIDKYEGGLEAFSRGYEKMGFTRSATGITYREWAPGAQSAALIGDFNNWDANADIMTRNEFGVWEIFLPNNVDGSPAIPHGSRVKIRMDTPSGVKDSIPAWINYSLQLPDEIPYNGIYYDPPEEERYIFQHPRPKKPKSLRIYESHIGMSSPEPKINSYVNFRDEVLPRIKKLGYNALRIMAIQEHSYYASFGYHVTNFFAPSSRFGTPDDLKSSIDKAHELGIVVLMDIVHSHASNNTLDGLNMFDGTDSCYFHSGARGYHWMWDSRLFNYGNWEVLRYLLSNARWWLDEFKFDGFRFDGVTSMMYTHHGLSVGFTGNYEEYFGLATDVDAVVYLMLVNDLIHRLFPDAITIGEDVSGMPTFCIPVQDGGVGFDYRLHMAIADKWIELLKKRDEDWRVGDIVHTLTNRRWSEKCVSYAESHDQALVGDKTIAFWLMDKDMYDFMALDRPSTSLIDRGIALHKMIRLVTMGLGGEGYLNFMGNEFGHPEWIDFPRAEPHLSDGSVIPGNQFSYDKCRRRFDLGDAEYLRYHGLQEFDWAMQYLEDKYEFMTSEHQFISRKDEGDRMIVFERGNLVFVFNFHWTNSYSDYRIGCLKPGKYKVVLDSDDPLFGGFGRIDHNAEYFTSEGSYDDRPCSIMVYAPSRTAVVYALVDKLEVAVVEEPIEE

SEQ ID NO: 3612 - protein, 189 aa, Solanum tuberosum
GNEFGHPEWIDFPRAEQHLSDGSVIPGNQFSYDKCRRRFDLGDAEYLRYRGLQEFDRAMQYLEDKYEFMTSEHQFISRKDEGDRMIVFEKGNLVFVFNFHWTKSYSDYRIGWLKPGKYKVALDSDDPLFGGFGRIDHNAECFTFEGWYDDRPRSIMVYAPSRTAVVYALVDKEEEEEVAVVEEVVVEEE

SEQ ID NO: 3613 - protein, 370 aa, Pseudomonas syringae
MSEINKHVTAPFDMSHFKLKNRFAVAPMTRVSADEQGSATQNMTRYYERFAKGGFGLIITEGNYTDRSSSQGYRFQPGLTDDEQAQAWRATTNAVHRHGSVMIAQLMHAGALSQANRFVSESAGPSAIRPKGEQMAFYYGAGSYRIPRAMTDKDIAEVIDGFAHAAQLAIGTAGFDGVEIHGANGYLLDQFLTDYSNQRTDQWGGEVVQRLRLTLEVIASVKKVAGQAPVGVRLSQGKVNDFQHKWAGGERDAEIIFATLADAGVDYIHVTEHEAWQPAFAQGKASLVELARRYAPGVALIANGGLHDPQKADQVLHQGADIIAVGKGALANPDLPQLLRQGEPLRDFDPAILGPIANIKDSELAFNGMN

SEQ ID NO: 3614 - protein, 676 aa, Treponema denticola
MHLFNKSILNFKLGKYLTESNIAYIIFSPDYVPLFWSPEAERLLPDYLIKNTKIRLQDYLKTVLLEEDYIRLSAFIKSNPKTAAFEAKFDKPSSLSDKTALKFSFTQQDDNNFFVTIDDITKQKLKERFLIIARQDAEKANSMRSLFLANVSHEIRTPIQTIIGMMELINETNLDEEQSEYTRQVNFSAEVLLTLVNDVLDFSKLESGNMTMERTVFNLTDSVEQTVDLISMEAHKKGLEIVVDISDKIPDFIYGDPARLQQVLLNFVKNAVKFTETGYVSVSVKLVFENNSDDPYAAKHFFILFEVADTGIGVNNEQKSKIFNSFYQGNAAINRKYGGTGLGLAISKNIITMMKGQIGIKDNIPRGSVFWFKIPLVPSKKKAPHESILLDKSTRFLIVDDNMQTRTILKRMLLKFGFEDIALVSSGEQAIGVMKTAAEHKNPFNVVFIDMVMPKMDGWRLGAEIHNDDSLSASKLFLMIPEGSLGRDAKMKLLEWFDGYLYKPLKSRIVFHLLNELYRKLAIALEKDDIPELEPVEAGGQGQQNGNVHNFNEDNFFGCKVLVVDDHPVNQKLLKIILEKAHCIVSTANDGEEAIDTASSEHFDIIFMDIQMPGINGYEATQILRGKGYSRPIIACTAGSQDNERNLCKSMGLNDIIKKPFNKKQLFEMVKKHYKK

SEQ ID NO: 3615 - protein, 384 aa, Arabidopsis thaliana
MASSSADNLTDKNIVFRKLKSKSENKVCFDCSAKNPTWASVTYGIFLCIDCSATHRNLGVHISFVRSTNLDSWSPEQLRTMMFGGNNRAQVFFKQHGWTDGGKIEAKYTSRAADLYRQILAKEVAKAIAEETNSGLLSSPVATSQLPEVSNGVSSYSVKEELPLSKHEATSATSSPKASNTVVPSTFKKPIGAKRTGKTGGLGARKLTTKPKDNLYEQKPEEVAPVIPAVSSTNNGESKSSAGSSFASRFEYNDDLQSGGQSVGGTQVLNHVAPPKSSSFFSDFGMDSSFPKKSSSNSSKSQVEESDEARKKFTNAKSISSAQYFGDQNKNADLESKATLQKFAGSASISSADFYGHDQDDSNIDITASDLINRLSFQVKDPYT

SEQ ID NO: 3616 - protein, 190 aa, Solanum tuberosum
GNEFGHPEWIDFPRAEQHLSDGSVIPGNQFSYDKCRRRFDLGDAEYLRYRGLQEFDRAMQYLEDKYEFMTSEHQFISRKDEGDRMIVFEKGNLVFVFNFHWTKSYSDYRIGCLKPGKYKVALDSDDPLFGGFGRIDHNAECFTFEGWYDDRPRSIMVYAPSRTAVVYALVDKEEEEEEVAVVEEVVVEEE

SEQ ID NO: 3617 - protein, 878 aa, Solanum tuberosum
MVYTLSGVRFPTVPSVYKSNGFSSNGDRRNANISVFLKKHSLSRKILAEKSSYNSESRPSTIAASGKVLVPGIQSDSSSSSTDQFEFAETSPENSPASTDVDSSTMEHASQIKTENDDVEPSSDLTGSVEELDFASSLQLQEGGKLEESKTLNTSEETIIDESDRIRERGIPPPGLGQKIYEIDPLLTNYRQHLDYRYSQYKKLREAIDKYEGGLEAFSRGYERMGFTRSATGITYREWAPGAQSAALIGDFNNWDANADFMTRNEFGVWEIFLPNNVDGSPAIPHGSRVKIRMDTPSGVKDSIPAWINYSLQLPDEIPYNGIYYDPPEEERYIFQHPRPKKPKSVRIYESHIGMSSPEPKINSYVNFRDEVLPRIKKLGYNAVQIMAIQEHSYYASFGYHVTNFFAPSSRFGTPDDLKSLIDKAHELGIVVLMDIVHSHASNNTLDGLNMFDGTDSCYFHSGARGYHWMWDFRLFNYGNWEVLRYLLSNARWWLDEFKFDGFRFDGVTSMMCTHHGLSVGFTGNYEEYFGLATDVDAVVYLMLVNDLIHGLFPDAITIGEDVSGMPTFCVPVQDGGVGFDYRLHMAIADKWIELLKKRDEDWRVGDIVHTLTNRRWSEKCVSYAESHDQALVGDKTIAFWLMDKDMYDFMALDRPSTSLIDRGIALHKMIRLVTMGLGGEGYLNFMGNEFGHPEWIDFPRAEQHLSDGSVIPRNQFSYDKCRRRFDLGDAEYLRYRGLQEFDRAMQYLEDKYEFMTSEHQFISRKDEGDRMIVFEKGNLVFVFNFHWTKGYSDYRIGCLKPGKYKVALDSDDPLFGGFGRIDHNAEYFTFEGWYDDRPRSIMVYAPSRTAVVYALVDKEEEEEEEVAVVEEVVVEEE

SEQ ID NO: 3618 - protein, 278 aa, Anabaena variabilis
MLREFASRDELIAYLREQFPQATERSDNISDTKGGRQAAQKALQKVNPATYAKTRNFLTGDVTRLSPYIRYGVLSLREIRDYVLDNVKHSDDATKLINELGWRDYWQRLYVKLGNGIWEDQEEYKTGYTPAEYASDLATDIKEGKTGLVCIDSFSRELRETGYLHNHMRMWLAAYIVHWRRIRWQEGAKWFLEHLLDGDPASNNMSWQWVASTFSQKPYFFNRENLERYTKSIYCQKCPLYGHCNFEGSYEELEQQLFPKGKFTRQPNSQSWQRGKKK

SEQ ID NO: 3619 - protein, 750 aa, Salmonella typhimurium
MSHNEKSPHQSPVHDTRESQPGLDSLAPSDGSHRPTPETTPPGAQPTAPGSLKAPETANDKLTALDAFRKGSENYALTTNQGVRIADDQNSLRAGSRGPTLLEDFILREKITHFDHERIPERIVHARGSAAHGYFQPYKDLSDITKAAFLCDPQKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAQGKATFVRFHWKPLAGKASLVWDESQKLTGRDPDFHRRDLWEAIEAGDFPEYELGLQLIAEEDEFKFDFDLLDPTKLIPEELVPVQRVGKMVLNRNPDNFFAENEQAAFHPGHIVPGIDFTNDPLLQGRLFSYTDTQISRLGGPNFHEIPINRPTCPYHNFQRDGMHRMDIDTNPANYEPNSINDNWPRETPPAPKRGGFESYQERVDGNKIRERSPSFGEYYSHPRLFWLSQTPIEQQHIIDAFSFELGKVARAYIRERVVDQLAHIDVTLAQGVAHNLGFALTHEQTQIAPPPDVNGLKKDPALSLYAVPDGDVKGRVVAILLNDKVNAAELLTILQALKAKGVHAKLLYSRMGEVTADDGSTLTIAATFAGAPSLTVDAVIVPCGNIADIESCGDARYYLLEAYKHLKPIALAGDARRFKALLNIDSQGEEGLVEADNVDHHFMDTLLTLMAAHRVWSRAGKINAIPA

SEQ ID NO: 3620 - protein, 834 aa, Ashbya gossypii
MKTALIGLKLKDTEPLDWSKALASYLKRNYGQHQWSQFYDDKKSAELDQLRISANSDLGLEALLEQNLRYYGFLEQLYLRLGSQSVQLKLDYTWYDAEHGMNGGQKYKQHTLVFEKSSTLFNIGVLLAQLAGEQLRASYKEAIPQLARAVACFEYMSETFLNSPSVDLQAENTGFLAALLHAEAQELFLLNVINGGDAARRASLLCRLSYTCARFYRKCVEFYKADGADEAAAAVPYGKAKWRDVVNMKMHLYEGVAAYNSALVLEQAGKIGHAVGLLEKAAASMATANTHRKALQGTAYLRDEVDLDGISSVVNEKLKTTAKDNDYIYHDHVPSDISLDSTKLMDAIKVPEFDAVVGPYLEAATETCNDLFRGIVPMAVYERESMYTEEKTQLLRREVDAVEQADWEYQSFVDFTNLPKLLDDLERRFLDTSSSSEDAEVVHMREQLQSWADAVRQSSFNDIEQQSKNILRTRNDIMALLSSVPPENKEDVVKIKSSLLQASQSDEKLFSQVKPYVNEIQLLNNPTLLWNNFNTFTTSQPTPDLLDLDHSKADEVLAKIRQIRQLYENLKLLKEERTSIMKDLKDLVNQDDITKQLILNNNKSDSQIKTLFQEELEKFRPFGSRIEATVFKQGNTIKDIKIGLDTIFKLADVQEKTSAQKQAASQRKEFFSKLQKAATAFKLFETDLPKGLSFYDLLYKMTKEMHDLSVTKRTTDSDLASNMAGLNISSSKETAKYNPQPLTAPPLAPRTYMPSPQAYNRNLDIRNANTYGNNLNAGSLGQRPRLPQKIPTGISGLETQNDPKLSEEESIRNPTNFYNTPSVFNESMYSKFSH

SEQ ID NO: 3621 - protein, 1550 aa, Unknown
  Nostoc sp. PCC 7120
MKAQLPDNEVQRIAALLEYKILDTPPEAAFDDITRLASYICGTPIALISLIDQNRQWFKATFGLERRETPRDEAFCAHTILESEAFIVPDATADERFATNPLVISDPKIRFYAGVPLTNPEGYSLGTLCVIDYIPRNLSFEQIEALQILGRQVIKQLELRRNLANLVLVNNQHKQAQKIRHPFFKKIAGGFGLASVFLVLLGLASYQAEIELIHNGNQVQTTQESINNLEQLLSQMKDAETGQRGYILTGKDPYLQTYQTALANIDQKFDELRNATVDPVRQQRLVILKPLITAKITELNQTIKLRQNLGFQAALQVIQSDQGQTLMDDIRKVMREMETENKVRLQQQLQAVKASEQKVIFILAIAIVSGFIILAVVYYLIYCEVIARQSMENILNEERNFISAVLDTVSALVIVLDSQGRIVRFNQACEVITGYSFDEVRGRHFWNLFLLPEDVESSKEFFAKFPADPTVPSVQESENYWVTKDGSRRLIAWSRTILQNHEGSVEYIIGTGIDITERKRADKHLTIQYAITRVLAESTTITEATPQILQAICETLGWNVCEIWMVNQQANFLSFFDLWHHTSLEMQEFRTQSQPITFASGIGLPGRIWASGQPIWLTDIVNDGSFLRNQLAAQVGLRGAFGFPIRSGQKILGVITCFSHQVQPHDPDLAKIMDSIGEQVGQFIHRKQAEEELQRQNLRSQLFTEITLKIRQSLQIEEILQITVKEVQKILQTDRVLIYQLLPDGSGSLIIEAVVAGWAAIKGQNITDFYLQTEYQQQYCLQQYRLRHLEAIANLDLGEIQQSHLELLRKFGVKANLVIPILVKDELCGLLIVHQCATSRQWTSFETHLLRQIADQVGIAVAQAQLLEVETRQRQELEVARSQAELASHAKSAFLANMSHEIRTPMNAVLGMTGLMLETLLNQEQRDFMETIRISGDALLTLINEILDLSKLEAGEMALENLNFNLSTCVEEVLDLLAPQAHSKGLEIAALIYRHVPIQLQGDASRLRQILMNLIGNAIKFTSFGEVVMRVELRSETPTTAIIHFAVTDSGLGITLEDQHKLFTPFTQVDASTTRKYGGTGLGLAICKQLVTLMGGEIGVESQLGKGSKFWFEIPFAKQLQPVSFVEDCGLLNNRRLLVVDDHATNRKIIYHQVSRWGMQVDQADRAVAALSMIVEACQQNKPYDVILIDMQMPEMDGMALGKQIKANSAIPPTPLIMLTSTNQRDEVQQAIKIGFAAYLVKPVKSSRLLDTIMSVLKTPSQLEAEKLEVKSQELEKNNLDHSRNHNFTATQAQNSVSTKTRILLAEDNLVNQKVALKQLQSLGYTADVAANGKEVLQLLKQIPYDLILMDCQMPILDGLEATKEIHRWAESSFASCRRPVIIAMTANAMKEDKQMCLDAGMDDYLSKPVMKEQLATALEYWCQLILNSRQAVEFDLNSLPLDWEHLHQLSENDTEFELHLLQIFVEDVRARLELAKEAIANTDFQQMAQQVHQLKGASTNIGATAMYLAAEKLEQLAQNQERRGSMELITEIEEGVNQIQAFLTRSQIV

SEQ ID NO: 3622 - protein, 105 aa, Glycine max
MDIRLMDLDSPLFNTLHRIMDLTEDDNVLLISGERKREEDKEKEGAKYLRMERRVGKFMRKFTLPENANTDAISAVCQDGVLTVTVNKLPPPQPKKPKTIKVKIA

SEQ ID NO: 3623 - protein, 202 aa, Oryza sativa
  misc_feature (84)..(84): Xaa can be any naturally occurring amino acid
  misc_feature (97)..(97): Xaa can be any naturally occurring amino acid
  misc_feature (110)..(110): Xaa can be any naturally occurring amino acid
  misc_feature (116)..(116): Xaa can be any naturally occurring amino acid
  misc_feature (130)..(130): Xaa can be any naturally occurring amino acid
  misc_feature (134)..(134): Xaa can be any naturally occurring amino acid
  misc_feature (139)..(139): Xaa can be any naturally occurring amino acid
  misc_feature (141)..(142): Xaa can be any naturally occurring amino acid
  misc_feature (156)..(156): Xaa can be any naturally occurring amino acid
  misc_feature (160)..(160): Xaa can be any naturally occurring amino acid
  misc_feature (165)..(165): Xaa can be any naturally occurring amino acid
  misc_feature (168)..(168): Xaa can be any naturally occurring amino acid
  misc_feature (181)..(181): Xaa can be any naturally occurring amino acid
  misc_feature (194)..(194): Xaa can be any naturally occurring amino acid
MTDKFVHNKTLTMENLNPRVIDVEYAVRGPIVLRAAEMEKEIQSGKHSFPFERVIRANIGDCHASGNQLPITYIRQFVAGCTYXAIMDSSDFPADIXQRVERLLASAAGXSLGSYXESQGLITIREDIAXYIEXRDGYXAXXSDIYLCNGALDGIXTVIXLLMNXDPXKPSGIMIPVPQYXLYSATLSEYGAYXIEYYLDED

SEQ ID NO: 3624 - protein, 586 aa, Medicago sativa
MCGILAVLGCSDDSQAKRVRILELSRRLKHRGPDWSGLHQHGDNYLAHQRLAIVDPASGDQPLFNEDKSIIVTVNGEIYNHEDLRKQLPNHKFRTQCDCDVIAHLYEEYGENFVDMLDGIFSFVLLDTRDNSFIVARDAIGVTSLYIGWGLDGSVWIASELKGLNDECEHFEVFPPGHLYSSKDREFRRWYNPPWFNEAVIPTTPYDPLVLRNAFEKAVIKRLMTDVPFGVLLSGGLDSSLVAAVTARYLAGTKAAKQWGAKLHSFCVGLKGAPDLKAGREVADFLGTVHHEFQFTIQDGIDAIEDVIYHTETYDVTTIRAATPMFLMSRKIKSSGVKWVISGEGSDEIFGGYLYFHKAPNKEEFHQETCRKIKALHRYDCLRANKSTYAWGLEARVPFLDKEFIKVAMDIDPEYKMIKHEEGRIEKWILRKAFDDEENPYLPKHILYRQKEQFSDGVGYGWIDGIKDHAAKHVTDRMMLNASHIFPFNTPLTKEAYYYRMIFERFFPQNSARLTVPGGASVACSTEKAIEWDASWSSNLDPSGRAAFGVHNSAYENQVNSVAKTVEPEKIIPKMEISNLGVAIQS

SEQ ID NO: 3625 - protein, 540 aa, Unknown
  Piromyces sp. E2
SNPDSTNGNVACDSYHKFDEDIKMMKIMNANHYRFSMSWSRLFPDGQAKKVDGKWNVNEKGAEYYDMMINTLIENDIVPMATLYHWDLPYALHEKYGGWLDYHSQFDFANYAEFCFERFGDRVKNWVTINEPWVNCVGGYKNGPGKAPYRCTGEAPRKLANDTTGLDLEGGCSYEIGPSQYYKGAKVLSANRPPQRLEDVWCSHNILLGHAQAVKVYREKFQKKQKGLIGITVDGEAEIPWEEPNMSEEELENNKKYAKLGTEFRIGWYSDPKIFGDIAGSVKQRMGKEMPVFSDEEKAILKGSSSDFLGWNTYTSHWAAQVKNEDGTYIQPPTDEKASYENSKRDMWDDNCKGRGEGWTCIPPTLGSQAGSSWEYLYGPTILVGLNWLYDRYKSVLKNGIVITENGCAQPNYKVSRANDQVTLDYFKSIGKEEFVDTYDESIIEDEKNIEGSILHDTYRINWYKQYLENLRLAYVEDKFDVRGYMAWSLIDNFEWENGYETRFGMTYIDFYNDKELTRVPKDSLTFLGQWYLDNVEQKN

SEQ ID NO: 3626 - protein, 451 aa, Zea mays
  misc_feature (231)..(231): Xaa can be any naturally occurring amino acid
MAGAGAGGWKKRVGRYEVGRTIGRGTFAKVKFAVDADTGAAFAIKVLDKETIFTHRMLHQIKREISIMKIVRHPNIVRLNEVLAGKTKIYIVLELVTGGELFDRIVRHGKLRENEARKYFQQLIDAIDYCHNKGVYHRDLKPQNLLLDSRGNLKLSDFGLSTLSQNGVGLVHTTCGTPNYVAPEVLSSNGYDGSAADIWSCGVILYVLMAGYLPFEENDLPHLYEKITAAXYSCPYWFSPGAKSLIQRILDPNPRARITIEEIREDPWFKKNYVTIRCGEDENVSLDDVQAIFDNIEDKYVSDEVTHKDGGPLMMNAFEMIALSQGLDLSALFDRQQEFVKRQTRFVSRKPAKTVVATIEVVAESMGLKVHSRNYKVRLEGPASNRASQFAVVLEVFEVAPSLFMVDVRKVAGDTPEYHRFYENLCSKLGSIIWRPTEVSAKSTPLRTTTC

SEQ ID NO: 3627 - protein, 547 aa, Actinobacillus actinomycetemcomitans
MAAKDVKFGNDARVKMLNGVNILADAVKVTLGPKGRNVVLDKSFGAPTITKDGVSVAREIELEDKFENMGAQMVKEVASKANDAAGDGTTTATVLAQAIVNEGLKAVAAGMNPMDLKRGIDKAVNSVVAELKNLSKPCETSKEIEQVGTISANSDSIVGQLIAQAMEKVGKEGVITVEDGTGLEDELDVVEGMQFDRGYLSPYFINKPETATVELDNPFILLVDKKISNIRELLPVLEGVAKAGKPLLIIAEDVEGEALATLVVNTMRGIVKVAAVKAPGFGDRRKAMLQDIAILTAGTVISEEIGMELEKATLEDLGQAKRIVINKDNTTIIDGIGDEAQIQGRVAQIRQQIEESTSDYDKEKLQERVAKLAGGVAVIKVGAATEVEMKEKKARVEDALHATRAAVEEGIVAGGGVALIRAAGRVVGLQGENEEQNVGIKLALRAMEAPLRQIVANAGEEASVIASAVKNGEGNFGYNAGTEQYGDMIAMGILDPTKVTRSALQFAASVAGLMITTECMVTELPKDDKADLGAAGMGGMGGMGGMM

SEQ ID NO: 3628 - protein, 485 aa, Glycine max
MALGNNSHQLLSKIATNDKHGENSPYFDGWKAYDSNPFHPTKNPQGVIQMGLAENQLCFDMIQEWIRNNPKASICTAEGVNQFKYIANFQDYHGLPEFRNAVANFMSKVRGGRVRFDPDRILMSGGATGANELIMFCLADAGDAFLVPSPYYPAFVRDLCWRTRAQLIPVECHSSNNFKITREALEESYRKAKEGNINVKGLIITNPSNPLGTTIDKETLKSIVGFINEKNIHLVCDEIYAATVFRAPSFVSVSEVMQDMEHCKKDLIHIIYSLSKDLGLPGFRVGIVYSYNDEVVNSGRKMSSFGLVSSQTQHFLAALLSDDEFVERFLAESARRLAARHSHFTKGLEKVNITCLPSNAGLFFWMNLKGLLKEKTFEGEMMLWRVIINEVKLNVSPGSAFNCPEPGWYRVCFANMDDETVDVALMRIRAFVGKETGKPPKELKRWKSNLRLSFSNSRRFDENLMSPHMMSPHSPMPHSPLVRAT

SEQ ID NO: 3629 - protein, 160 aa, Xylella fastidiosa
MNVVRYTPWPGQAALQNEIKQVFDRFFEHNGDTDESAVVTAQWVPRVDIKEEPNQFVLYADLPGIDPADIEVQMDKGILSIKGERKTESSSQTEHFSRIERRYGSFHRRFALPDSADADGITASGSHGVLRILIPKQAATTPRRIQVGNAVSSDVALQSM

SEQ ID NO: 3630 - protein, 836 aa, Solanum tuberosum
ILAEKSSYNSEFRPSTVAASGKVLVPGTQSDSSSSSTNQFEFTETSPENSPASTDVDSSTMEHASQIKTENDDVEPSSDLTGSVEELDFASSLQLQEGGKLEESKTLNTSEETIIDESDRIRERGIPPPGLGQKIYEIDPLLTNYRQHLDYRYSQYKKLREAIDKYEGGLEAFSRGYEKMGFTRSATGITYREWAPGAQSAALIGDFNNWDANADIMTRNEFGVWEIFLPNNVDGSPAIPHGSRVKIRMDTPSGVKDSIPAWINYSLQLPDEIPYNGIYYDPPEEERYIFQHPRPKKPKSLRIYESHIGMSSPEPKINSYVNFRDEVLPRIKKLGYNALQIMAIQEHSYYASFGYHVTNFFAPSSRFGTPDDLKSLIDKAHELGIVVLMDIVHSHASNNTLDGLNMFDGTDSCYFHSGARGYHWMWDSRLFNYGNWEVLRYLLSNARWWLDEFKFDGFRFDGVTSMMYTHHGLSVGFTGNYEEYFGLATDVDAVVYLMLVNDLIHGLFPDAITIGEDVSGMPTFCIPVQDGGVGFDYRLHMAIADKWIELLKKRDEDWRVGDIVHTLTNRRWSEKCVSYAESHDQALVGDKTIAFWLMDKDMYDFMALDRPSTSLIDRGIALHKMIRLVTMGLGGEGYLNFMGNEFGHPEWIDFPRAEQHLSDDSVIPGNQFSYDKCRRRFDLGDAEYLRYRGLQEFDRAMQYLEDKYEFMTSEHQFISRKDEGDRMIVFEKGNLVFVFNFHWTKSYSDYRIGCLKPGKYKVALDSDDPLFGGFGRIDHNAEYFTFEGWYDDRPRSIMVYAPCRTAVVYALVDKEEEEEEEEEEVAVVEEVVVEEE

SEQ ID NO: 3631 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 3632 - protein, 1021 aa, Burkholderia vietnamiensis
MQNSTLQFIRRYQSISMFGGGIVVTILILIACGLGISSIVYGYLDAERRNFLNGVDETAEELQVAETAFVNDVMNAQLIWSETAPAPADVVDTFFTHGQELAVTPYQSLVVGVPGQTAQRDEVARYLALSFMLPHLCATSADNRACTVEGYHYSTRTGVFGIVPRPARDHPALATARTRAQLLAALHVDFDGPMPAQSDGRPSVRWLPPYVDPVTGRSRIRIAAQARAGGGAFAVLVTEYAPEYLLSWLPDRGLAGRFFVASADNRLIAIDPAVEHTGALNARLLALDVARGDESLGEPLFRSGSIVFRSRLATTGWTVAYVLSWGDVVLGVGVQAAVLAAATLVTIAVMWLLLVRFHRRVLAPVYARSARVFDSEALCRSVIAMAPVGIGLVSLSDRRVMLASDALVQMLLPHGGDHHALSARVLERYDAFVADGGRGRTLVTELAVDAHGDAPLHLEIIAHAARYQGEDVLIAVFTDTTAQRRLVQQLEEAVRAADSANAAKSSFLAATSHEIRTPLNVILGNLELLERTALDASQQSRVRTLRASAEGLLAIVSDILDFSKIEAGAMSVESIEFELIAVIEQQLAAFAPIAKAKGLPLFVEIDASVEQRMRGDPTRLAQVLGNLLSNAIKFTSEGHIAARVAVWPDARGVPEVELSVEDTGIGIEPTQRARLFKPFSQVDASITRRYGGTGLGLALCDRLVTAMGGTLSVESTPQVGSVFSVHLPLQADIAPTRPLDASRGHVVLVVSQDEAWRKFASAHLRAWGFDVAVHASPVGIAAELVARARALVLVGDADRWRRDELDRAGHDTPIVLATPDGPLQPDVAGRTIRVSSYSVNGLRMALERTLRAGGESPHAPIADPHAAATAPAESLPRVLVADDAAINGSIFLEQLAVLGSPFDCVSSGAAALDMLARGDWDVLLIAAELPDMLARELVEAVHARALPCDVIVVASHLGPDDARLYAAVKVDCVLTKPVMLADLRRSLTRIARRRGIGVLVGAMNERCVVGKARATADMSGR

SEQ ID NO: 3633 - protein, 448 aa, Bacillus sp.
MASIQFPKDFVWGTATASYQIEGAYNEDGRGMSIWDTFSRTPGKVVNGDTGDIACDSYHRYEEDIALLKNLGVKAYRFSIAWPRIYPDGDGELNQKGLDYYAKVIDGLLAAGIEPCVTLYHWDLPQALQDKGGWDNRDTIRAFVRYAETAFKAFGGKVKQWITFNETWCVSFLSNYIGAHAPGNTDLQLAVNVAHNCMVAHGEAVKAFRALGISGEIGTTHNLYWFEPYTTKPEDVAAAHRNRAYNNEWFMDPTFKGQYPQFMVDWFKGKGVEVPIQPGDMETIAQPIDFIGVNFYSGGFGRYKEGEGLFDCEEVQVGFDKTFMDWNVYAEGLYKVLSWVHEEYGDVPIYITENGACYEDELTQEGRVHDAKRADYFKKHFIQCHRLIESGVPLKGYFAWSLLDNFEWAEGYVKRFGIVYTDYKTLKRYPKDSYRFIQSVIENDGFEA

SEQ ID NO: 3634 - protein, 882 aa, Solanum tuberosum
MVYTLSGVRFPTVPSVYKSNGFSSNGDRRNANVSVFLKKHSLSRKILAEKSSYNSEFRPSTVAASGKVLVPGTQSDSSSSSTDQFEFTETSPENSPASTDVDSSTMEHASQIKTENDDVEPSSDLTGSVEELDFASSLQLQEGGKLEESKTLNTSEETIIDESDRIRERGIPPPGLGQKIYEIDPLLTNYRQHLDYRYSQYKKLREAIDKYEGGLEAFSRGYEKMGFTRSATGITYREWALGAQSAALIGDFNNWDANADIMTRNEFGVWEIFLPNNVDGSPAIPHGSRVKIRMDTPSGVKDSIPAWINYSLQLPDEIPYNGIHYDPPEEERYIFQHPRPKKPKSLRIYESHIGMSSPEPKINSYVNFRDEVLPRIKKLGYNALQIMAIQEHSYYASFGYHVTNFFAPSSRFGTPDDLKSLIDKAHELGIVVLMDIVHSHASNNTLDGLNMFDCTDSCYFHSGARGYHWMWDSRLFNYGNWEVLRYLLSNARWWLDAFKFDGFRFDGVTSMMYIHHGLSVGFTGNYEEYFGLATDVDAVVYLMLVNDLIHGLFPDAITIGEDVSGMPTFCIPVQEGGVGFDYRLHMAIADKRIELLKKRDEDWRVGDIVHTLTNRRWSEKCVSYAESHDQALVGDKTIAFWLMDKDMYDFMALDRPSTSLIDRGIALHKMIRLVTMGLGGEGYLNFMGNEFGHPEWIDFPRAEQHLSDGSVIPGNQFSYDKCRRRFDLGDAEYLRYRGLQEFDRPMQYLEDKYEFMTSEHQFISRKDEGDRMIVFEKGNLVFVFNFHWTKSYSDYRIACLKPGKYKVALDSDDPLFGGFGRIDHNAEYFTFEGWYDDRPRSIMVYAPCKTAVVYALVDKEEEEEEEEEEEVAAVEEVVVEEE

SEQ ID NO: 3635 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEDRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 3636 - protein, 1129 aa, Burkholderia vietnamiensis
MPAELKRIASQVANAGRKPFEPGRARRYQQLLLYGGGFAVTLFILMCALLVTRLDVQDYRAQARLTFLYRKAQFSRTLEMADMVLATYGGRIEQLWNQGARPSADALAQFSAAGGVLGASNGDGSETLLALARLTPDRPAPSYARYLGALFGLVRQDDRSGHVLPPALVSGGEPLGGYLIGLDAPFLAVLGTELVPRAHTLEPGTDLHTLIDGLMPTGIARQKTLMQSRPFVFDRRLDPLSGRVVMRFARRLDDAAGRPFGWLVINGLHRVDDVMAPRSDDEDVAIVDARHDIVFGRERDRSMIERALHDARAPLGDHVAVRRVGARFVVYDRLPGTGLVMMTSFSWRSMVREMRVGLGITFGAALLGIVLLWSAIVLFDRRALRPAHRRAIRLIESEAFNRTLARHAPAGLLLLSAADGETMVHNDAVRAYDGGAGGQRLGKRIWDAYRERAAAGDGRLDVMQHELAVEQADHGKVYLALQVVRTMFHGVDVLLCTLTDVTARKLTEDKLKEARTAAEDANKAKSTFLATMSHEIRTPLNAIVGNLELMARAQLPLAERRRLQTVMSSSDALLHTINDVLDLSKAESNQMALEAVPFDLRAVLHEVAAIFRALADAKHLRLECVIAAGLGDGYVGDPARVRQIVSNLVSNAIKFTEHGRVTVEALPAAVPGRGVEIVVRDTGIGIEPDSMPTLFDVYVQTDASIYRRFGGTGLGLPLCRRLARLMGGDVTVESRPGAGAVFTASLPLADAPLRGRAAVDARASGAKGAGARRAEVAGAEATEAEVTGADAARVDGTGADGTGATGTEAEAADAKATGTEAPGASGTEAKRTGADAMAAATRAAATPTNATSRPAATPKPIETHARTSALSPVQPPAPACSADGETPLRVLVAEDHPASRALLRDQLDALHCDATLVSNGIEAMRAFFAQPFDVVLTDLGMPELDGFALANCLREQGAKVPVIAMTAHATDEDRRRCAQAGAVEVVLKPLSIDALDAVLTRHARHAAAARSSTADSTDSADSDDRPIPPMTDEIRENLRTATLLSLALIDDALPRGDVERIRVELHSMRGGFALAGDTVAGAACAHAERIFSQGRTAALRAAWPACRAAIERSAERLRAAGSGAGSEPA

SEQ ID NO: 3637 - protein, 433 aa, Solanum tuberosum
MVYTLSGVRFPTVPSVYKSNGFSSNGDRRNANVSVFLKKHSLSRKILAEKSSYDSESRPSTVAASGKVLVPGIQSDSSSSSTDQFEFTETAPENSPASTDVDSSTMEHASQIKTENDDVEPSSDLTGSVEELDFASSLQLQEGGKLEESKTLNTSEETIIDESDRIRERGIPPPGLGQKIYEIDPLLTNYRQHLDYRYSQYKKLREAIDKYEGGLEAFSRGYEKMGFTRSATGITYREWAPGAQSAALIGDFNNWDANADIMTRNEFGVWEIFLPNNVDGSPAIPHGSRVKIRMDTSSGVKDSIPAWINYSLQLPDEIPYNGIYYDPPEEERYVFQHPRPKKPKSLRIYESHIGMSSPEPKINSYVNFRDEVLPRIKNLGYNAVQIMAIQEHSYYASFGYHVTNFFAPSSRFGTPDDLKSLIDKAHELGIVVL

SEQ ID NO: 3638 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAESEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 3639 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVDVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 3640 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREILTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 3641 - protein, 246 aa, Unknown
  Petunia x hybrida
MGRGRVELKRIENKINRQVTFAKRRNGLLKKAYELSVLCDAEVALIIFSNRGKLYEFCSSNNMFKSLERYQKCSYGTLEVNQSSKDNEQNNYREYLKLKAKYESLQRYQRHLLGEDLGPLNIDDLENLEVQLDTSLKHIRSTRTQLMLDQLSDLQTKEKLWVEANKVLERKLEEIYAENSLQQSWGGGEQSVTYGHQHNAQSQGFFQPLECNSTLQIGYNPITTSRQITAVTNAQNVNGMVPGWML

SEQ ID NO: 3642 - protein, 238 aa, Unknown
  Petunia x hybrida
MGRGKIVIQRIDNTTSRQVTFSKRRSGLLKKAKELSILCDAQVGLIIFSSTGKLYEFASNSMRSVIERYYKMKEEHHLMSPMSEVKYWQREVASLRQQLHYLQENHRQLLGEKLSGLGIKDLTHLENKLEMSLKGVRKQKEQILTDEIKEITRKGNLIHQENIELYKKVNLIRQENTDLQKKVYEKGCGSEPNEGVQATFAISNGYDLHAPIYLQLRPPQTQKNQTSTSVMQFGLQLH

SEQ ID NO: 3643 - protein, 374 aa, Yarrowia lipolytica
MTTPNLFKPIKVGASQLSNRVVMAPLTRTRAEKHVPSDLAVEYYTQRASTAGTLIISEATYIHPSAGGHKGREGLVPGIWGDASIIAGWKKVIQGIHSKGSKIYIQLWDIGRVANYDVLQQTGHDLVGPSAIAQAGDEDGAKHVRALTIPEIKQKVQLYVDAAKNALEAGADGVEIHSANGYLPDQFIHWNSNNRTDEYGGSIENRSRFSLEIIDAVSAAIGADRVGVRFSPWTTFQDMEVNEEKSLPQFKYLFEQLEKRAKENEKNRLSYIHVIEPRADGISDAIPKQWQSNDPFRNIWTGDLIRAGGYNRETAIETAQEDDRTLIGFGRYFIANPDLVYRLENDLPLTHWDRPSFYTPGPHGYTDYPFHKKE

SEQ ID NO: 3644 - protein, 282 aa, Tropheryma whipplei
MVFVLTYVPSVLLGDGVSIPQFGLGTYELPPNETSSVVQSAIELGYRHIDTASLYANEREVGRAIASSGIKREEFFVTTKLWNSDQPKPREAFERSLDLLSLDYVDLYLIHWPCPPSELYINVWEVLLELKESGRAKSVGVSNFLSEHINKIKEAGFPLPSVNQIELHPWLQQRELVLSCRNYGIQIESWGPFARFSKDLDAFPELTRPAKEYGKTPAQVILRWHIQKGYVVFPKTVHAERLRQNIDIFDFDLTPDEISGIDSLDAGFRTGPDPSSFRAGLD

SEQ ID NO: 3645 - protein, 665 aa, Unknown
  Piromyces sp. E2
MKSLTIFTTLLAISAAKKCVVRNPVDNTKNDLAPVFNEDTPSDDETPVNVDDNTPVEKEDDSAIENSDIEDSENKSKGKLPADFKWGAATAAYQVGGAWNEDGRGESVWDHFTPLYPKNVESGDRTNPDSTNGNVACDSYHKFDEDIKMMKIMNANHYRFSMSWSRLFPDGQAKKVDGKWNVNEKGAEYYDMMINTLIENDIVPMATLYHWDLPYALHEKYGGWLDYHSQFDFAKYAEFCFERFGDRVKNWITINEPWVNCVGGYKNGPGKAPNRCTGEAPRKLANDTTGLDLEGGCSYEIGPSSYYKGAKVLPANRPPQRLEDVWCSHNILLGHAQAVKVYREKFQKKQKGLIGITVDGEAEIPWEEPNMSEEELENNKKYANLGTEFRIGWYSDPTIFGDFPRSVKQRMGKEMPVFSDEEKAILKGSSSDFLGWNTYTSHWAAQVKNEDGSYVQPPTDEEASYENSKRDMWDDNCKGRGEGWTCIPPTLGSQAGSSWNTLYGPTIRVGLNWLYDRYKTVLKNGIVITENGCAQPNYKVSRANDQVTLDYFKSIGKEEFADTYDESIIEDEKNIEGSILHDTYRINWYKQYLENLRLAYVEDKVDVRGYMAWSLIDNFEWENGYETRFGMTYIDFYNDKELTRVPKDSLTFLGQWYLDNVEQKN

SEQ ID NO: 3646 - protein, 670 aa, Actinobacillus pleuropneumoniae
MKINQLSRLIAICFGTIVSSAFAVEPQIQESALVTPKPTEQHSLSTKRVTARLTQSHYHKFKLDDEFADKIFNRYMDWLDGAHNTFLQSDIDEMRAKYAAKLDDELYEGKLDSAFEIYDLMTKRRYGRYKYALSLLDKEPNLKGSDQIENDREKAAFPATVKEANQLWEQRVKNDVINLYLKDKKWPEIKKTLIKRYNLAIKRLTQIKADDVLQTYLNAFAREIDPHTSYLSPRAAKAFQESMNLSLEGIGATLAMEDDVTTIKSLVPGAPAARSKKLVVGDKIVGVGQDNDEIEDVIGWRLDDVVDKIKGKKGTKVRLEIEPEKGGKTKVITLVRDKVRLEDSAAKLTVDKINGKNVAVIKISTFYIGLTNDVRKLLDEMKTKKVDGLIIDLRENGGGSLTEVVELTGLFIKDGPVVQVRDAFNRIKVHEDPEADKSLYDGKIMVMINRHSASASEIFAAAMQDYNRAIIVGQQTFGKGTVQQSRSLNFVYDLDQEPLGFIQYTIQKFYRIDGGSTQLKGVEADIKFPEIINAEKTGESFEDNALPWDKIPAASYQEAGHARDAVSALTAKHEERIAKEPEFITLNEDIAIRKERDARKYSSLNLEERLKEDRADEAKRLKDLNARFAREGKKAIKNIDALPKDYEAPDFFLKEAEKMMVDWLEIDKKS

SEQ ID NO: 3647 - protein, 591 aa, Helianthus annuus
MCGILAVLGCSDDSQAKRVRVLELSRRLKHRGPDWSGLYQHGDNYLSHQRLAIIDPASGDQPLFNEDQTIVVTVNGEIYNHEELRKRLTAAGHKFRTGSDCDVIAHLYEEHGEDFVDMLDGMFSFVLLDTRNNTYIAARDAIGITSLYIGWGLDGSVWISSELKGLNDDCEHFEVFPPGHLYSSKTGGFKRWYNPLWFAETIPSTPYDPLVLRCAFENAVIKRLMTDVPFGVLLSGGLDSSLVASITARYLAGTKAAKQWGAQLHSFCVGLEGSPDLKAAREVADYLGTVHHEFHFTVQDGIDAIEDVIYHIETYDVTTIRASTPMFLMSRKIKSLGVKMVISGEGSDEIFGGYLYFHKALNREEFHQETCRKIKALHQYDCLRANKSTSAWGLEARVPFLDKEFINVAMSIDPEAKMINMDQKRIEKWVLRRAFEDEEHPYLPKHILYRQKEQFSDGVGYSWIDGLKAHAELHVTDKMMLHAEHIFPHNTPVTKEAYYYRMIFERLFPQNSAKLTVPGGASIACSTAKAIEWDASWSNNLDPSGRAALGAHNAAYKKNMGPVGQVKLGPNIIDNVPRMMDISASELVIQG

SEQ ID NO: 3648 - protein, 558 aa, Helianthus annuus
MCGILAVFGCVDCSQAKRARILELSSRLRHRGPDWSGLHSEEDCYLAHQRLAIVDPASGDQPLYNEDKSIIVTVNGEIYNHKEFREQLKSHKFNTGSDCEVIAHLYEEHGEDFVHMLDGMFSFVLLDTRNKSYIAARDAIGITPLYIGWGLDGSVWFASEMKALSDDCEQFMSFLPGHIYSSKNGGLRRWYNPPWWSELVPSTPYDPLVLRNAFEKAVIKRLMTDVPFGVLLSGGLDSSLVAAVASRHLVDSEAYCQWGSQLHTFCIGLKGSPDLVAAREVADYLGTRHHEFYFTVQEGIDALEEVIYHIETYDVTTIRASTPMFLMSRKIKSLGVKMVLSGEGSDEIFGGYLYFHKAPNKEEFHEETCRKIKALHLYDCLRANKSTSAWGLEARVPFLDKEFINVAMSIDPKWKMIDRDNGRIEKWVLRNAFDDDEKPYLPKHILYRQKEQFSDGVGYSWIDGLRDHANKQVTDSMLANANFVYPENTPATKEAYYYRKIFEKFFPKNAARLTVPGGPSVACSTAKAVEWDASWSKNLDPSGRAALGVHAAAYEDAK

SEQ ID NO: 3649 - protein, 297 aa, Zea mays
MDATPPSSRDLSPQPRRPASSAGPAKRVGLLLGRYELGRLLGHGTFAKVYHARHADDTGETVAIKVLDKEKALRNGLVPHIKREIAILRRVRHPNIVRLFEVMATKSKIYFVMEFVRGGELFARVAKGRLKEDTARRYFQQLISAVGFCHARGVFHRDLKPENLLVDERGDLKVSDFGLSAVADQFHPDGLLHTFCGTPSYVAPEVLARRGYDGAKADIWSCGVILFVLMAGYLPFHDQNLMAMYRKIYRGEFRCPRWFSKDLSAGMIPQVDKAFYVAATDKRVPFSNHVNIFLSGK

SEQ ID NO: 3650 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDCEKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 3651 - protein, 548 aa, Lawsonia intracellularis
MASKEILFDAKAREKLSRGVDKLANAVKVTLGPKGRNVVIEKSFGSPVITKDGVSVAKEIELEDKFENMGAQMVKEVAPKTSDIAGDGTTTATVLAQAIYREGVKLVAAGRNPMAIKRGIDKAVVAVTKELSDITKPTRDQKEIAQVGTISANSDTTIGNIIAEAMAKVGKGGVITVEEAKGLETTLDVVEGMKFDRGYLSPYFVTNPEKMVCELDNPYILCNEKKITSMKDMLPILEQVAKVNRPLLIIAEDVEGEALATLVVNKLRGALQVVAVKAPGFGERRKAMLEDIAILTGGEAIFEDRGIKLENVSLSSLGTAKRVVIDKENTTIVDGAGKSEDIKARVKQIRAQIEETSSDYDREKLQERLAKLVGGVAVIHVGAATETEMKEKKDRVEDALNATRAAVEEGIVPGGGTAFVRSIKVLDDIKPADDDELAGLNIIRRSLEEPLRQIAANAGYEGSIVVEKVREPKDGFGFNAASGEYEDLIKAGVIDPKKVTRIALQNAASVASLLLTTECAIAEKPEPKKDMPMPGGGMGGMGGMDGMY

SEQ ID NO: 3652 - protein, 945 aa, Candida albicans
MKTHLLVVPSKKTEEVNWVKPLNNYLLSIYGNTLQYQDDINSLNKLRQDIRGVNADDTGLKLYYSYYSKLELIDLRIPFHDLNKSKKLQFEWFDSFSSLPYTQNSLAFEKANVLYNIGAILSKFAQFKYNESQQLNGPEGETAFKQSISMLQQSSGIYQFINENFLHAPSQDLAQSTIKFLSKLMMAQSQEIFTLKVISGDLNQSKNSLIAKLCKSTSVLYEDCYNMINKNKKEGFKITNESYDGNDYEDDLDDDDCDDLEGFLERPEDTEDSDNRYVAAELDSSWISIIYFKYEYYKSLAYYFNGLHLDANRKYGDAIAYLTKSQEVLNGVHSSTLKQVSKGSGDVYELLDNYKYQKDAVTIRLNDLNKDNDLIYHDIVPNLVTLPEIKPMDSTKIIKLGDNAMFHEINEKNYNNFLVNVVPVNIHELSSYYSEEKSQYLRNEIDHFEVSNEEVSSVLEYLKLPKALVSIKESLRGTSSKGSTGNIDELLSQSVIDKVNEISSQYSNDIQRKSTIENSRKEIYQLIKFLTENNCQDDAIQLKKILYDASVSDTKLFALVDETYHQTLGKGIQSTEFKSLFKTVDNKSSNQDSEISLLDIIDDDDDDNTNQDKQIKNIEDYLNDLNNIKQAKFKLIEKLKKEIHNDDISDILVLNMKLKSTNEIKSIIFPEELKKFNPFTNELDKLITNEKSIIEQLKSRWNQLISNPQIKNLQTETNSKNRLIISQSEKIDQFYGNWLKYHNGLIAGEKFYNQLLDQFKNFRNNIDNQLNQGMRSLNIGQQFPTQPMLNRTQSSGLQSNYTGQSSISHSGSLSGQPSGGYNQPQPQQQQLQQQQQQQQQAQFSGAYNQQYSQPHGGYTQFQGYGQGQGQSQTGYQRQPPPPPPQLPPKQSMGSYNFATTLQQQQLPPQQQQQPQQQRTPQNESNLIYDNPSTYNPNMYNFFSSK

SEQ ID NO: 3653 - protein, 446 aa, Lycopersicon esculentum
MKKVKRKLGKYEVGRTIGEGTFAKVKFARNTETGENVAIKVLAKSTILKHRMVEQIKREISIMKIVRHPCIVRLHEVLASQTKIYIVQEFVTGGELFDKIVHLGRLSEDEARRYFQELIDAIAHCHSKGVYHRDLKPENLLLDFQGNLKISDFGLSALPQQGVELLYTTCGTPNYVAPEVLGNRGYDGAAADVWSCGIILYVLMAGYLPFDETDLPTLYTKIKAAEFSCPFWFSPGATSLIQKIIDPNPQTRIKIDGIKRDPWFRKNYRAVKAKADEVVNLDDIHAVFDDIEDAFVSEKSEDSESGPLVMNAFEMITLSQGLNLSALFDRRQDYVKRQTRFISRQPAKVVIETIEAAAESLGLKVHTRDYKTRIEGVTANRAGQFAVVLEVFQVAPSLFMVDVRKAAGDTLEYHKFYKTFCTKIDDVIWKPKEGMSNAVLLRTRTR

SEQ ID NO: 3654 - protein, 727 aa, Xanthomonas axonopodis
MTAVSNRWDSGVVRALAEARHGDAFAVLGAHPSDKGRLLRTYLPGADRVGAVLDDGQVVALDAGPEPGLFAGELPAHGGYRLRIGWPGGEQETADPYAFGPQLSDFDLHLISEGHHLQLADALGANVVEVEGVRGTRFAVWAPNASRVAVVGDFNSWDARRHPMRLRHQSGVWELFVPDVGPGAHYKYQLRGPHGHELPAKADPVARRAELAPGTASIVADPTPHQWSDDGWMATRARRQAHDAPMSIYEIHAGSWLREAGVDLDWDGLADRLIPYVADMGFTHVELMPVSEHPFGGSWGYQPLGLFAPTARFGTPDGFARFVDRCHREGIGVIVDWVPAHFPTDAHGLAHFDGTALYEHADPREGFHRDWNTLIYNHGRREVSGFLIASAMEFLQRYHVDGLRVDAVASMLYRDYSRNAGEWIPNIHGGRENYETIAFLRRLNEVVREHTPGAVMIAEESTAFPGVTAEVAHGGLGFHYKWNMGWMHDTLHYAGLDPIYRRYHHGELTFSMVYAYSERFVLPISHDEVVHGKGSLLGRMPGDDWQRFANLRAYLGFMFTHPGRKLLFMGCEFGQPTEWNHDAGLPWHLLDDPRHRGVQTLVRDLNRLYVQYPALHAHDDDPSGFAWVVGDDAGNSVVAFLRKGKRGDAPVLVVINFTPVVQHAYRIGVPQGGQWREVFNSDAGIYGGSNLGNGGSVTAEQQSMHGHAQSLPLLLPPLGAIVLTPYG

SEQ ID NO: 3655 - protein, 469 aa, Yarrowia lipolytica
MVESDILPKSQREEIFKKLSSLQANKTCFDCPANNATWSSVTFGVFICYDCSSVHRNLGVHVSFVRSTTMDEWSYKQLRNMKCGGNQNAREYFAKHGGSQYLENAGRAQEKYTSKTAKAYLTHLAQKCAKDAAQFPDEIVVETADDDAASIKSASTDDFFANWDKPLVKKPTPTSSRSSTPALGASTASLPGIRNGNNGSTSSLNNPTKKVTPTATRTKITSKAGGAAGKKSILSSKKTKPKKAPAESFDFEEAERLAKEEEKNKEALGLGNDDDAEDDVFGKSTVVSEPTHTAAPSGSFGGPADYPPTYSNEPIKLVPTNTKEVEQKFQKLGFGMVAGENKLESTKKKSTYVPPDKETAETLNKFKTSKGISSDQFFGRSDYDPAAQKEAKERLQTYSGSKAISSSSYFGRDEEEEQAMVNHSSDLERMAADLAERVKNVAGEDFGGLKDAFEQGGKKVGDFMREYMR

SEQ ID NO: 3656 - protein, 773 aa, Alkaliphilus metalliredigenes
MDDMKKEEVNTNYKNVLEDLMDIILIVDKNGKIVYGNKRAVETYGYTYEELVNLSVFDLRNQDIEEPVQEQLKQALLRGIEFKTYHYKKNGTKFPVEVRSRYSGEQSKGNVVSIIRDISHIDKIAKDAEMFSVSLDILDDAIVTFTKDLKVSLWSKAAEEKLGYTKEEIVGQNIKILVPNEKIKEFENEIFEVRKGNVVERLETIRLHKNGNAIDVSISVSPFYDPDGVLIGVLGVYKDISQRKELAKQLKRNEERWRYALEGGRFGIWDWDIENNKIFSADLWKEILGYNEGELNDTYEDWMSKVHPEDFPYVKDKLNKHSRGEKYIDEFRMKCKDNTYKYLRAKGQIIEWREDGNPLRMMGTLEDITDRKIIEEELKEKYKQLELLKEEAENANKAKSQFLANMSHEIRTPMNGIFGVVQLLESTDVGAEQNKYINMLKESTHTLAGIINDILDISKIESGTFKLNNEPFNLTEMISSIYHGLLVDGNAKGLEVGYYLDPNINPQVIGDELKLKQILTNLISNAVKYTEQGFVSFRVNRISFDEHTEKIQFNVKDSGIGIKDGFKEKIFEDFSQEDSSTRKKYQGTGLGLAISKNLALLMQGDISFESKLGEGSIFTFTCELQKSRTEDVNTKNHDIVKEKVEYSNQNSNKVILCVEDNIMNQEVMESIVTKKGYQYLAAYNAKEALDILENKKVHLILMDIQLPDLNGFEITKSIRMAKGPMKDVPIIAVTAYVDHKIENKCIQAGINDYMPKPLDLEKLYEMLESYLEG

SEQ ID NO: 3657 - protein, 271 aa, Glycine max
MFSKLQPQHQQQHQPFQFSRECQTSEDDDSRSSGGPNTAVAQKSVLGGGGCSDGATIEVVRRPRGRPPGSKNRPKPPLIITREPEPAMSPFILEIPGGSDVVEALARFSRRKNTGLCVLTGSGTVANVTLRQPSFSPAGATVATVTFHGRFDILSMSATFLHHASPAAIPNAFAVSLSGPQGQIVGGFVAGRLLAAGTVFVIAASFNNPSYHRLSSEEEAQNNSGGGAGDAQSPPVSGGGVESGHVPAESFMYSCHLPSDVIWAPTPRPPF

SEQ ID NO: 3658 - protein, 206 aa, Arabidopsis thaliana
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFENLNNRREEFLIQASPSDPENFPFVLIGNKVDVDDGNSRVVSEKKAKAWCASKGNIPYFETSAKVGTNVEEAFQCIAKDALKSGEEEELYLPDTIDVGTSNQQRSTGCEC

SEQ ID NO: 3659 - protein, 401 aa, Xanthomonas axonopodis
MLSDPIIDVLTSGVAGLGVWGMLAVLLVFTQLTIFAVTLYLHRSQAHRGVDFHPVIAHFFRFWTWLTTSMITREWVAIHRKHHAKVETEEDPHSPQTKGIAQVFWRGVELYREARTQRADIEQYGKGAPSDWIERHLYTPHANAGPIALLVINAVLFGLPGIALWAIQMAWIPFWAAGVVNGLGHWWGYRNFESADTSTNLTPWALWIGGEELHNNHHAFPSSARFSMRRWELDIGWVAIRGLQALGLAKVLRVAPSLDIRPNIAVPDADTLKALLSHRFQAMTDYQRNVFKPALREEAAATGAKLRELLPRRLRKGLVDDGRWLKPDARAQLQAWVAQRPRMRTLVEYRARLTALLEARSHDASERLRQLQQWCHEAEASGNAALQAYAARLKGYALSGA

SEQ ID NO: 3660 - protein, 1145 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 3661 - protein, 372 aa, Xanthomonas oryzae
MSAVDAALSQLFSPITFGPLALANRIVIAPMCQYSAQDGCATDWHRIHLGTLSQSGAGLLILEAAAVVPEGRISYADLGLYDDATEQALAEVLQSVRRWSPMPIGIQLAHAGRKASTDLPWKGSEAIAPDHAHGWQTVSASAMPFRAGQPAPQALDQAGIDAVVDAFVASAQRAERLGLELIELHAAHGYLMHQFLSPLSNQRSDAYGGSLENRMRLTLRIFDAVRAAVSEKIAIGVRISATDWVEGGWDVQQSIALSQALDARGAHYIHVSSGGLDPRQQIPLQAGYQIPFAQEIRAQVSRPVIGVGLITEPAQAEAIVQEGQADAIALARGILYDPRWPWHAAAALGASVTPAPQYLRCEPRDARGVFAN

SEQ ID NO: 3662 - protein, 431 aa, Anabaena variabilis
MIGGAIATTATISVFGPAWTRSVRAALQDSPKAVIDQVWQLVNNEYVDGKFNQQDWLAVRKSLLSKDYSSKEEAYVAIREALQRLNDPYTRFMDPKQFEVLTSQTSGEVSGIGIRMELNEITKRLTVLEAIENSPALKAGIKAGDEILAIDGKPTQQMKVDDASKLIRGKEGTAITLRLGRTGNSAFDLKLTRAKIEVPTVSYNLKQEGSRRVGYIRLREFSAHAAEQMARAIRNLNGQKVDSYVLDLRGNPGGLLQASIEIARMWLDDGGIVRTVNRQGFNEDTKANRTALTKLPLAVLVDGNSASASEILTGALKDNKRAVVIGGQTFGKALVQSVHELPDGSGLAVTIAHYYTPNGTDINHKGITPDIKLELTDAQERQLANNPKLIATQNDPQYARAIAVLSGNTFARPPLNQTNQPMSLGANELKF

SEQ ID NO: 3663 - protein, 423 aa, Corynebacterium diphtheriae
MNNKKETPQAAPAQRKRTRRIFDQSDKLKNVLYEIRGPVTAEAEAMELDGHRILKLNTGNPAIFGFEAPDVIMRDMIASLPTSQGYSTSKGIIPARRAIVTRYEVIPGFPAFDVDDVYIGNGVSELITMTTQALLNNGDEVLIPMPDYPLWTAATSLAGGKPVHYLCDEEDDWNPSIEDIKSKITERTKAIVVINPNNPTGAVYSKEVLQKIVDVAREHDLLILADEIYDRILYDGAVHTNIAALAPDLLCITFNGLSKAYRVAGYRAGWMIVTGPKNNARGFIEGLDLLSGTRLCANVPGQHAIQVALGGRQSIYDLTGQGGRLLEQRNVTWEKLNAIPGVSCVKPMGALYAFPKLDLEYYDIKDDAQLMLDLLRQEKILMVQGTGFNWDKPDHFRVVTLPWASQLSEAMDRLGNFLASYKQ

SEQ ID NO: 3664 - protein, 286 aa, Oryza sativa
  misc_feature (155)..(155): Xaa can be any naturally occurring amino acid
MMSMMTDLSCGPSSMTELTAAAAPAGSGSSAAVAAGSSEKMGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSLTRLAXNISSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGQQPAFN

SEQ ID NO: 3665 - protein, 139 aa, Prosthecochloris aestuarii
MAIKLYGRDPLKMFENVFNDTVSPFVSSMVAHSFKVDVSEDEMAIYIDADMPGMKKEDVKISMDDDVMTICAERTHEEEEKKKDYHRIERTYGSMSRSFSVGDNVDVDKIEASYDNGVLHIVVPKKEPVEKKSKDISIK

SEQ ID NO: 3666 - protein, 888 aa, Candida glabrata
MKPSVIGLKCKDTDKVDWKRGLSSYLKRIYGSRQWKEFYDEQLCVEMDHVRNNANGELGAVTLVEQNYKYYAYLEQLYLRLGNNIGQFKLEFTWYDAEYGLVSSPTKHTQKTLVFEKSCTLYNLGVALTEVANEKINEDFKTAMVHMAKAMECFRYLSENFFNSPSADLQTENTKFLSDLSHAEAQEMFLINAINNGTSEKQASLISKLAYSGSNLYENCWEFLRTEEGGLTPYGEARWNSIVSGKHHFFRSLAAYYNALALEQNNKYGEAIAFLKLATQCLSSSLPYKYALNDNFDFDGFGETIKDKTKQLIKDNDYIFHDSIPQSVSLSSIKALDAIKAPKWEEQLKPFMEAIAHKCEKLYRGIVPMEVFEKESIYSEKKASMLRQCINDSETADMEYSSFIEFTHLPNLLSDLKRRYKSQNFSGTTDPQGDMMRDQIQSWIKSISQSKYKDPDEQLKLISSKKQEILTLLAGLPSEQKENVVKLKMALVEAAASDEKLFSLVQPYAAQLRLLKQPDELWKIFNMFSIDESNKQSLLDIDDSKNQEILAKISDIEQMAEDLRLLKEERGRTLKELKSQTNDDDITNTLLVNSKAESEELEVIFKKELDKFKPLTTRIEATIFKQESVVNEVKNELDNVFSLSGLENKTSEEEEKQKKRKEFFMQIEEAATKFLIFNNDLPKGLEFYDSLLKMSKDLAVSVKVQNNASGSDNNSNNGYVSGNVIPPSLPPQPRNVGSSIDSQFQSMNLGSVPTPQRFPQPPAPNSRPIVSMENYTSQFSVPPAHGDLPPAYNQVPLVPTRNYDQPHGSGNYPGNVSSQHPVSSSPIPGAYDQVPMVPPKQPPAEGRSQISRQEQMEREERELQRDPTAFYKKSSVFDESLYSRYSGK

SEQ ID NO: 3667 - protein, 451 aa, Ashbya gossypii
MSEDAGEVYVDKAVSDEIFSKLNSKPENRTCFDCGNKNPTWTSVPFGIMLCIQCSGEHRKLGVHITFVKSSNLDKWTINNLRRFKMGGNHRAREFFLKNNGKQLLDYKADKQVKYTSAVAKNYRARLDKLAAKDREQHPAELVLATDEEQGSSGSSGASSKNNSVDDFFASWEKKSASTPPPKILTPNPTGSSAGAARSSILSAPGRRRTPLAGGGSTGKKHSILSSKRTARPAAKKADADLFDEFEKEAQREQEESAAAVSTETVRTSSNAYVQQKPIKMHAASSSDDDLADNPYNDGTRFDQVRPAPTVEDVQPKLAKLGFGMVNNNASSLMEEARQSKLAAAAPKYTGDVVAKFGAQKAISSDQMFGRGSYDEDSSREARDKLKSDFHNATAISSSSYFGEPEPPALPQPAPFRMDLLGSEEDFELAKQALERSAQKLGNYLRDYIRK

SEQ ID NO: 3668 - protein, 298 aa, Glycine max
NSAPKIKKREMATETKVAVLGGITEVQGAANSVEINNLARFAVEEQNKRENSVLEFVRVISAKQQVVAGVNYYITLEAKDGEIKNEYKAKVWERESQELLEFKPTLGAGGIIDVPGAANSIEIDHLARFAVEEQNKRENSVLELVRVISAKKQVVAGMNYYITLEAKDGVIKKEYEAKIWVRGWLNSKELLEFKPVNVSSTQMGGITDVTANSLEIDILARFAVDQHNKKENANLEFVGVIRAKQQVVEGFIYYITLEAKDGETKNVYETKVWVRSWLNSKEVLEFKPISINPLSVSV

SEQ ID NO: 3669 - protein, 187 aa, Arabidopsis thaliana
  misc_feature (39)..(39): Xaa can be any naturally occurring amino acid
  misc_feature (64)..(64): Xaa can be any naturally occurring amino acid
  misc_feature (116)..(116): Xaa can be any naturally occurring amino acid
  misc_feature (123)..(123): Xaa can be any naturally occurring amino acid
  misc_feature (136)..(136): Xaa can be any naturally occurring amino acid
LPFNRSVITAFYYNTFNENFNKSQKTIRCELYLRASELXKEGKKIILTNVMNPNTLRHNPLTFXRQLVALCQTPILLDHPNVVMLFTDDAIARAKHYLSLTSSGLCAYSDSRCLPXLENRLLXFIQRHDGYPSHPXTIFLTDGASKSVMQILNCVIRGNGYGILVPRPQYPLYSATISLLADTLVTY

SEQ ID NO: 3670 - protein, 466 aa, Arabidopsis thaliana
YFDGWKAYEENPFHPIDRPDGVIQMGLAENQLCGDLMRKWVLKHPEASICTSEGVNQFSDIAIFQDYHGLPEFRQAVAKFMEKTRNNKVKFDPDRIVMSGGATGAHETVAFCLANPGDGFLVPTPYYPGFDRDLRWRTGVNLVPVTCHSSNGFKITVEALEAAYENARKSNIPVKGLLVTNPSNPLGTTLDRECLKSLVNFTNDKGIHLIADEIYAATTFGQSEFISVAEVIEEIEDCNRDLIHIVYSLSKDMGLPGLRVGIVYSYNDRVVQIARKMSSFGLVSSQTQHLIAKMLSDEEFVDEFIRESKLRLAARHAEITTGLDGLGIGWLKAKAGLFLWMDLRNLLKTATFDSETELWRVIVHQVKLNVSPGGSFHCHEPGWFRVCFANMDHKTMETALERIKVFTSQLEEETKPMAATTMMAKKKKKCWQSNLRLSFSDTRRFDDGFFSPHSPVPPSPLVRAQT

SEQ ID NO: 3671 - protein, 1544 aa, Rhodospirillum rubrum
MGAVLAGIGLSGFAVWWVTQRNAELAETAASLELTRLSDAIAERITLYQYGLRGARGVIVTFGERGITREVFRGYSKTRDIGAEFPGARGFGFIRRVPADREERFLAEARADGWPDFAIAQFTPHEGERFVIQYIEPAQRNLKAVGLDIASEKNRREAALAAIDTGQVRLTGPITLVQASGDKSQSFLILLPIYRTLSTPETLAERRAQAFGWSYAPLNMPEVLSGLVPNQDRLALTLRDVTNPAEAETVFTSNTDCAAAECVTKTLTRSIFGRVWEISVTVSPAYGHAVQRIAPWVVVSLGIGASILAAGFAAVIGLNQARRREIAQAQARLSTIVENSGDAIIGEALDGTIVGWNRAAEALFGYKAPEVIGKALAPLLIPADRMAENQSIVLSALSGEAVMAFDTQRIHADGHLFDVSMTACPVHDRLGHVVGVANLIRDIRKRKAAEQSLLEFNAQLEKQVASRTAELEKARRALQTVLDSVPSMIGYWDRDLHCHIANRAYCSWFNVDPSGLIGKSMRSLLGEALFTANRPFIEAVLRGQPQTFERMIPRPNGQGVRHSLAHYIPDVVDGEVLGFYALVHDVSELVEGRQKLDAALRENEALLRTIDEQLLCSITDRNGNIISINDNFCKLMGYTKDELLGLDHRIMNSGLHDKTFWADVWATISAGGSWRGEVCNKAKDGALYWLDSVLTPFFGEDGSIDRYVALRIDITDRKKAEAERNRSNTLLRSVLASAREFSIIATDPDGVITIFNSGAEKLLGYSAEEMVGKQTPALIHLADQVAERGRSLSDEFGVPIEGFRVFVHRSERDGVEAQEWTYVRKDGGHLEVLLVVTAIREDDGRIAGYLGVAQDVSRRKEFERALVLAKQAAEEASVVKGQFLANMSHEIRTPMNAILGMLTLVQRTALTPHQADYVCKAHSAAGSLLGLLNDILDFSKIEAGKLHLEPHPFRLETVLRDLAVVLSGSYGDKGVEVLFDIAPHLPDSFIGDDLRLRQVLLNLAGNALKFTDQGQVIVSVGVLAREDDRLTMRMAVSDTGIGIAADQLASIFGAFEQAETSTTRRFGGSGLGLTITRHLVERMGGVLRVESQPGRGSRFWFDITLPVSGEGSESAESGRPLRVLVVEDNPVAGGILAQTVQGLGYDCDLVQESAETKARIVAADAAGRPYDAVLLDWRMPEVDGLTTARILREMGVTLCPQSIIMVTAYGRDVLSLAEQTGDAPFDAVLTKPVTPGQLRDALLRRDRATSEGEATALAPRGLPTPLAGRRLLVVEDNAINRQVAAELLAGAGAEIDLAEGGERGVMMVLRGEIAYDAVLMDIQMPDIDGFEATRRIRADARFKALPIVAMTANASRADREACLAAGMTEHVGKPIDITATIDVLVSLMTEGMTEGEPIAPPSPMGGTGREVPSDEPLLEDLDSIAERLGGQVDLLRRLLPTFAERTGELLDEIEDLIGRGDWSALSMAFHTIKGSAASMGAVALASHAALWEERLREDGPGTLDALRRDQALCDQMRALLAASLEALSSHLDAMAGPYAKEPAG

SEQ ID NO: 3672 - protein, 475 aa, Oryza sativa
MAGSGRPPAAQKKILQSLRPPLPFAASSRSPFAAPNDYHRFPAGGAAAAAASGSGGIGAGGAGGGGDIEEGLVIRTPQKRKAPEESDVAESSDCMITSPGFAVSPMLTPVSGKAVKTSKSKTKNNKAGPQTPTSNVGSPLNPPTPVGTCRYDSSLGLLTKKFINLLKQAPDGILDLNNAAETLEVQKRRIYDITNVLEGIGLIEKTLKNRIRWKGLDDSGVELDNGLSALQAEVENLSLKEQALDERISDMREKLRGLTEDENNQRWLYVTEDDIKGLPCFQNETLIAIKAPHGTTLEVPDPDEAGDYLQRRYRIVLRSTMGPIDVYLVSQFDEKFEDLGGGATPSGHANVPKHQPTEVFNTTNAGVGQCSNSVAVDNNIQHSQTIPQDPSASHDFGGMTRIIPSDIDTDADYWLISEGDVSITDMWKTAPDVQWDESLDTDVFLSEDVRTPSSHNQQPSAVGGPQMQVSDMHKP

SEQ ID NO: 3673 - protein, 348 aa, Unknown
  Vibrio sp. Ex25
MPWYAYHFGLGWEHLVWGVMAFSFTNLSITAGYHRLWSHKTYEAHPILRAIFAIGGAFSLQNSALHWSSDHRVHHKHVDNNDKDPYSAKRGFWYSHIGWMLRDYNKSQENEYTNCRDLKRDKIVMWQHKYYVPLALLTNIGFPVALGIIYGDIWGMLLVVGAARLFMSHHTTFFINSLAHVWGKQTFTDKNTARDNGVLAFFTFGEGYHNFHHIFENDYRNGVYWWHYDPTKWLIKSCSWLGLTSKLRTTPTFRIEKARATQLLKKAKEKLGAKPNTQTILDQLQHEFDSLVHHMQEYYEMRKEVLGAKTASVVKKYECSVTKIKYQQIKAEFERQQRSWNLMVRRYA

SEQ ID NO: 3674 - protein, 440 aa, Glycine max
  misc_feature (53)..(53): Xaa can be any naturally occurring amino acid
  misc_feature (200)..(200): Xaa can be any naturally occurring amino acid
MEQKGGVLMQRYELGRLLGQGTFAKVYHARNIITGMSVAIKITDKDKILKVGXVMRLIRHPHVVELYEVMASKTKIYFVMEYVKGGELFNKVSKGKLKQDDARRYFQQLISAVDYCHSRGVCHRDLKPENLLLDENGNLKVTDFGLSTLAETKHQDGLLHTTCGTPAYVAPEVINRRGYDGAKADIWSCGVILYVLLAGXEFKFPNWIAPDLRRLLSKILDPNPKTRISMAKIMESSWFKRGLEKPTITRNEDQELAPLDADGVFGACENGDPIEPAKDSKRCNNLNAFDIISYSSGFDLSGLFEETNRKKEARFTSDKPASIIISKLEEICIRLGLKVKKKDGGLFKLEGSKEGRKGSLGIDAEIFEITPVFHLVELKKSSGDTLEYQKLLKQEVRPALKDIVWNWQGEQPQQLQHGVVQKEEQPSYPGISDVAPPQTA

SEQ ID NO: 3675 - protein, 430 aa, Arabidopsis thaliana
MSKAWKLKLLLLLQLLLLSQHDVDSASVISYLPGFEGLLPFHLETGYIGVGEGEKVQLFYYFIKSENNPEEDPLIIWLTGGPACTALSALAFEIGPLTFKTEGYNGGLPSLVSTSYSWTKVASIIFLDQPVGTGYSYSTTPLSYKPSDTGEAKQTYEFLQKWLVENPQFVSNPIYVGGDSYAGIVVPAIVQQISIGNEHGYKPQINLKGYILGNPSTDLDSDHNSKIPYAHRMGLISDELYESLKRTCQGNYVKVDPTNTKCLKLMEDYGKTLVQSDLSLPTPDCYMYRYLLASHWANDEDVRRELHVVKGSIGKWMRCNWDLPYEKDIKSSVPYHRNNSIIGDYRSLVYSSDHDMMVPYIGTEAWIKSLNYSITDDWRPWFVNNQVIGYTRTYANNMTFATIKGGGHTAEYKPEESFMMFQRWISGRPL

SEQ ID NO: 3676 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVIAGDIMSYHLEEYDILHQRSLFNEARIAVTLIRGNHYFKASKTMNQQGEPYKVFTSFYRKWRPYLRHRDVYHYDLKSFEDFVIASPDDLVFDDIAFGSSQVIEQNKWQHFLDQDIQNYESGRDYLPEVLTSQLSVALAYGLLDIIEIFNDLLARYDEDEANHEAFIRELIFREFYYVLMTQYPETSYQAFKPKYRQIKWSQNEANFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDAKALYIKTYLPIFNQIDAKYLHDTQRNESNLFEQGIELGSHYPRQMVDHQEKRTQVLATFKALD

SEQ ID NO: 3677 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVTAGDIMSYHLEEYDILHQRSLFNEARIAVTLIRGNHYFKASKTMNQQGEPYKVFTSFYKKWRPYLRHRDVYHYDLKSFEDFVIASPDDLVFDDIAFGSSQIIEQNKWQHFLDQDIQNYESGRDYLPEVLTSQLSVALAYGLLDIIEIFNDLLARYDEDEANYEAFIRELIFREFYYVLMTQYPETSYQAFKPKYRQIKWSQNEADFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDAKALYIKTYLPIFNQIDAKYLHDTQRNESNLFEQGIELGSHYPRQMVDHQEKRTQVLATFKALD

SEQ ID NO: 3678 - protein, 439 aa, Oryza sativa
MESRGKILMERYELGRLLGKGTFGKVHYARNLESNQSVAIKMMDKQQVLKVGLSEQIRREITTMRLVAHKNIVQLHEVMATRNKIYFVMEYVKGGELFEKVAKRGKLTEVVAHKYFQQLISAVDYCHSRGVYHRDLKPENLLLDENENLKVSDFGLSALSESKRQDGLLHTTCGTPAYVAPEVISKIGYDGAKSDIWSCGVILFVLVGGYLPFQGPNLMEMYRKIQHGEFRCPGWFSRKLQNLLYKIMDPNPSTRISIQKIKESTWFRKGPEENRILKERTLNENTTKNVALVLGVRRKKNAHEDVKPMSVTNLNAFEIISFSKGFDLSGMFIVKEWRNEARFTSDKSASTIISKLEDVAKALNLRVRKKDNGVVKMQGRKEGRNGVLQFDIEIFEVTTSYHIIEMKQTSGDSLEYRQLLEEGIRPALKDIVLAWHGDE

SEQ ID NO: 3679 - protein, 278 aa, Staphylococcus epidermidis
METVQFYNGRTMPKIGLGTYRVKDGDECRESVKYAIEQGYRSIDTAMIYGNEETVGQGIKEGLESTGLSREDLFITSKLWLTDFGRQNVEDAYRQSVAKLGLDYLDLYLMHWPGTNEAVMIDTWRGMEDLYKQNQVKNIGVSNFTPEHFEALLAQVSIKPVINQVEFHPYLTQNELRKYLEAQNIIMESWSPLMNSQILHDEVINEVANEVGKTPAQVVIRWNIQHDVVVIPKSVTPHRIEENLDVWNFELSDNQMERIDQLNQDKRIGPNPLEFNGK

SEQ ID NO: 3680 - protein, 495 aa, Cucurbita pepo
MGFHQIDERNQALLSKIAIDDGHGENSAYFDGWKAYDNNPFHPENNPLGVIQMGLAENQLSFGMIVDWIRKHPEASICTPEGLEKFKSIANFQDYHGLQEFRKAMASFMGKVRGGRVKFDPSRIVMGGGATGASETVIFCLADPGDAFLVPSPYYAAFDRDLKWRTRAQIIPVHCNSSNNFQVTEAALEIAYKKAQEANMKVKGVIITNPSNPLGTTYDRDTLKTLVTFVNQHDIHLICDEIYSATVFKAPTFTSIAEIVEQMEHCKKELIHILYSLSKDMGLPGFRVGIIYSYNDVVVRRARQMSSFGLVSSQTQHLLAAMLSDEDFVDKFLAENSKRLGERHASRFTKELDKMGITCLNSNAGVFVWMDLRRLLKDQTFKAEMELWRVIINEVKLNVSPGSSFHVTEPGWFRVCFANMDDNTVDVALNRIHSFVENIDKKEDNTVAMPSKTRHRDNKLRLSFSFSGRRYDKGNVLNSPHTMSPHSPLVRARTY

SEQ ID NO: 3681 - protein, 359 aa, Arabidopsis thaliana
MDHSSNRFGNNGVESILPNYKLGKTLGIGSFGKVKIAEHVVTGHKVAIKILNRRKIKNMEMEEKVRREIKILRLFMHPHIIRQYEVIETTSDIYVVMEYVKSGELFDYIVEKGRLQEDEARNFFQQIISGVEYCHRNMVVHRDLKPENLLLDSRCNIKIADFGLSNVMRDGHFLKTSCGSPNYAAPEVISGKLYAGPEVDVWSCGVILYALLCGTLPFDDENIPNLFKKIKGGIYTLPSHLSSEARDLIPRMLIVDPVKRITIPEIRQHRWFQTHLPRYLAVSPPDTVEQAKKINEEIVQEVVNMGFDRNQVLESLRNRTQNDATVTYYLLLDNRFRVPSGYLESEFQETTWFQSYAHT

SEQ ID NO: 3682 - protein, 590 aa, Pseudomonas fluorescens
MCGLAGELRFDHQPADLAAVERITHHLAPRGPDAWGFHSQGPIALGHRRLKIMDLSDGSAQPMVDNQLGLSLAFNGAIYNFPELRAELEAKGYAFYSGGDTEVLLKGYHAWGADLLPKLNGMFAFAIWERDAQRLFIARDRLGVKPLYLSRTGQRLRFASALPALLKGGDINPLLDPVALNHYLNFHAVVPAPRTLLAGIEKLPPATWMRIEADGRTEQQTWWTLPYGPRADETNLTLEDWRDRVLDSTREAVAIRQRAAVDVGVLLSGGVDSSLLVGLLREVGVDNLSTFSIGFEDAGGERGDEFQYSDLIARHYGTRHHQLRIDEREIIEQLPAAFRAMSEPMVSHDCIAFYLLSREVAKHCKVVQSGQGADELFAGYHWYPQVDGASDPYAAYRAAFFDRSYDDYAATVQPQWLTANDAAGDFVREHFAQPGADAAVDKALRLDSTVMLVDDPVKRVDNMTMAWGLEARTPFLDYRLVELSARVPARFKLPDGGKQVLKEAARLVIPSEVIDRKKGYFPVPGLKHLQGATLDWVRELLLDPSQDRGLFKPAMLDRLLTDPQGQLTPLRGSKLWQLAALNLWLSEQGI

SEQ ID NO: 3683 - protein, 727 aa, Xanthomonas axonopodis
MTTEGISEMSQTLQALADGLPADAFAVLGPKLLADGRRQVRVLAPGAEAMGLIDPRGKLLARMQASAIDGVFEGTLAVDGPYRLRIVWPDRVQEVEDPYAFAATLDESLLLQIAAGDGQALRRALGAQHLHCGDVPGVRFALWAPHAQRVAVVGDFNGWDVRRHPMRQRIGGFWELFLPRVDAGARYKYAVTAADGRVLLKADPVARQTELPPATASVVPSAATFAWTDAAWMANRDPAAVPGPLSIYEVHAASWRRDGHNQPLDWPTLAEQLIPYVQQLGFTHIELLPITEHPFGGSWGYQPLGLYAPTARHGSPDGFAQFVDACHRAGIGVILDWVSAHFPDDAHGLAQFDGAALYEHADPREGMHRDWNTLIYNYGRPEVTAYLLGSALEWIEHYHLDGLRVDAVASMLYRDYGRAEGEWVPNAHGGRENLEAVAFLRQLNRDIATQFPGVLTIAEESTAWPGVTAAISDGGLGFTHKWNMGWMHDTLGYMQRDPAERAHHHSQLTFGLVYAFDERFVLPLSHDEVVHGTGGLLGQMPGDDWRRFANLRAYLALMWAHPGDKLLFMGAEFGQWADWNHDQSLDWHLLDGARHRGMQQLVGDLNAALRRTPALYRGTHRAEGFDWSVADDARNSVLAFVRHDPDGGAPLLAVSNLTPQPHHDYHVGVPRAGLWREILNTDSAHYGGSNLGNSGRLATEPVGMHGHAQRLRLTLPPLATIYLQAEK

SEQ ID NO: 3684 - protein, 277 aa, Yersinia pseudotuberculosis
MTMQPLIKLHDGRLMPQLGLGVWQASIQETELAVSKALEVGYRSIDTAAIYKNEEGVGKALKAAAVARDELFITTKLWNDDQHNPQQALETSLQKLQLDYIDLYLIHWPDPKQDHYVSAWRELVTLKEQGLIRSIGVCNFHIPHLQRLIDETGIAPTVNQIELHPLLQQRQLHAWNATHHIATESWSPLAQGGKGVFDQEIIRKLAQQYNKTPAQIVIRWHLDSGLIVIPKSVTPARIRENFEVFDFKLQKEELLAITKLDCGKRLGPDPEVFGSDR

SEQ ID NO: 3685 - protein, 516 aa, Arabidopsis thaliana
MMNKDMLLHQHQQPQQDENMSNLTSASGDQASVSSGNITEASGSNYFPHHQQQQEQQQQQRQQLVVPDSQTQKKRRNQPGNPDPESEVIALSPKTLMATNRFVCEICNKGFQRDQNLQLHRRGHNLPWKLKQRSNKEVIRKKVYVCPEASCVHHDPSRALGDLTGIKKHFCRKHGEKKWKCDKCSKKYAVQSDCKAHSKTCGTKEYRCDCGTLFSRRDSFITHRAFCEALAEETAREVVIPQNQNNNQPNPLLIHQSASHPHHHHQTQPTINVSSSSSSSHNHNIINSLHFDTNNGNTNNSNNSNNHLHTFPMKKEQQSNDHIMNYHHSIIPPWLAPQPHALTSSNPNPSNGGGGGGSLFSLASPAMSATALLQKAAQMGSTKTPPLPPTTAYERSTHNNNLTTTMAAMMTSPSGFISSNNNNHVLFQDYNASGFDNHGREEAFDDTFGGFLRTNEVTAAAGSEKSTKSGGGEGLTRDFLGLRPLMSHNEILSFAGLGSCINSSASDQLHPKPWQG

SEQ ID NO: 3686 - protein, 786 aa, Pseudomonas aeruginosa
MLGGRTSPRLIPAPMDIALTHRLSFKQASLTVLVAFILGTLLSLIQVGVDYASQDASINREVRALLDVSHNPAARIAYNIDAELAQELVLGLLRSPAVVRAEIIDTSGLPLASASREPAESRLRPLSDFLFGHKRVYEDPLHVDHAPGEALGVLHLEIDTFVFGNDFLRRAGITLLSGFVRSLLLSLILLVLFYTLLTKPLVSLIQALSGHDPRSPARMRLPCPKGHERDEIGVLVEVINRQLGRISVEIEQRREAENRLTQYLEELESIVAARTAELKAANARLTLSNQELEEARQTALDMAQARASFLANMSHEIRTPLNGLLGMLSLSLDGPLTPEQRQQLSIAHDSGKVLVELLNDVLDLSKFEAGQLVLEQIPFDLGVLVEDTASLLSQNAAAGVELTCLVDPALPAQVSGDPTRIRQIVSNLLSNALKFTRLGRVDVRVEATAEGVRISVRDTGIGIAQEALDRIFQPFTQADAGITRQYGGTGLGLALTRKLCEAMQGELTVESTVGLGSLFSVGLPLAPVSPPLQALPLRGRVIAQCSANSGLAQLLQTWLPRWGLEYKRLETDDSLLGHSLDVLISDCPDCLMGLRPSIGTPILLVTAYGSFLEPELARRLSPLRQLARPLSRNQLYQALKHVLEHTAIAPSSASDTTGEQRNTRVLLVEDNPVNQLVAKGLLHKLGCQVWIAEHGLNALKMLEEHPIDLVLMDCNMPVMDGYEATRQIRDSGRWGGLPIIALTANALPDERERCRAAGMDDYLAKPFHRDELKAILDRWCPLTASD

SEQ ID NO: 3687 - protein, 258 aa, Arabidopsis thaliana
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKLEDSDAALTQSFWGSSAAEQQQQHQQQQQGMSSYQSNPPIQEAGFFKPLQGNVALQMSSHYNHNPANATNSATTSQNVNGFFPGWMV

SEQ ID NO: 3688 - protein, 658 aa, Pseudomonas syringae
MCGITGFFGVKNKNLDETTVIKNMLSMIEHRGPDQAGYYVNNSMGLGTMRLSIIDLAAGIQPLSDGTGQYWISYNGELYNYIELRRRLQVLGHHFSTESDTEVVLRSWMEWGDEALEKFNGAFAFAIYDTVKDEVFIARDRFGKRPLFYTQTDGGYLFASEMKCFFGFPGFEFKFDEMSLSSILAHWTPLPSQTPFQGIRQLPPGSIMTLRGAQCEIRPYYALDFRAVDFDGTENEAKEEIRNTLEQAVKLRLRSDVPMGLYLSGGVDSSVLTSIAARIIKQKPLRTFSVEFEDKNLDESSDQQLVSALFSTKHERLIINHKDIVDNFSATVFHAEMPLFRTAPVPMYMLSKHVRSTGIKAILSGEGADEVFLGYNIFKETLLRSQWDTTDHDEKKRLLAKLYPYMKSFSEDNDSNLMGFYNAYAKEKIPGLFSHEIRFQNGRFASRLLKTKNDPFAGIQAWVAKDPVYSALSPTQKAQWLEFNTLLSGYLLSSQGERMGLAHGIENRCPFLDINVQKLASSINLRFDDGFTEKYMLRMAYDGILPGRIIHKAKTPYRAPDSGPFVEHALDYLNHLCESNALDAIELINPVFAKALIKKVVERTLAGGEDITVRDNQAFVYLMSLIELDKWFVKRQGAAYINPCRVDKLLVQAVDARH

SEQ ID NO: 3689 - protein, 57 aa, Pisum sativum
MASMISSSAVTTVSRASRGQSAAVAPFGGLKSMTGFPVKKVNTDITSITSNGGRVKC

SEQ ID NO: 3690 - protein, 545 aa, Campylobacter upsaliensis
MAKEIIFSDEARNKLYEGVKKLNDAVKVTMGPRGRNVLIQKSFGAPSITKDGVSVAKEVELKENLENMGASLVREVASKTADQAGDGTTTATVLAHAIFKEGLRNITAGANPIEVKRGMDKACEAIVDELKKLSREVKDKKEIAQVATISANSDEKIGALIADAMERVGKDGVITVEEAKSINDELSVVEGMQFDRGYLSPYFITNADKMIVELSNPYILLFDKKITSLKDLLPILEQIQKTGKPLLIIAEDIEGEALATLVVNKLRGVLNISAVKAPGFGDRRKAMLEDIAILTGGEVIAEELGRTLESATLEDLGQASSVIIDKDNTTIVNGAGDKANIDARVNQIKAQIAETTSDYDREKLQERLAKLSGGVALIKVGAATETEMKEKKDRVDDALSATKAAVEEGIVIGGGAALIKAKSKIKLKLEGDEAIGAAIVERALRAPLRQIAENAGFDAGVVVNSVENSSEENAGFDAAKGEYVDMFKAGIIDPVKVERIALLNAVSVASMLLTTEATISEIKEDKPAMPDMSAMGGMGGMGGMM

SEQ ID NO: 3691 - protein, 272 aa, Anabaena variabilis
MTIATSTKPQINWVNTLFFLGLHIGALFAFVPGNFSWAAVGVALLLYWITGGLGITLGFHRLVTHRSFQTPKWLEYFLVLCGTLACQGGPIEWVGTHRIHHLHSDTDPDPHDSNKGFWWSHIGWLIYHSPSHADVPRFTKDIAEDPVYQFLQKYFIFIQIALGLLLLYLGGWSFVVWGIFFRIVWVYHCTWLVNSATHKFGYRTYDAGDKSTNCWWVAVLVFGEGWHNNHHAFQYSARHGLEWWEVDLTWMTVQLLQVLGLATNVKLADKKQ

SEQ ID NO: 3692 - protein, 306 aa, Lycopersicon esculentum
MPSHADVDRQIEQLMECKPLSEAEVKTLCEQARAILVEEWNVQPVKCPVTVCGDIHGQFYDLIELFRIGGNVLITNYLFMGDYVDRGYYSVETVSLLVALKVRYRDRITILRGNHESRQITQVYGFYDECLRKYGNANVWKYFTDLFDYLPLTALIESQIFCLHGGLSPSLDTLDNIRALDRIQEVPHEGPMCDLLWSDPDDRCGWGISPRGAGYTFGQDIASQFNHTNGLSLISRAHQLVMEGFNWCQDKNVVTVFSAPNYCYRCGNMAAILEISENMEQNFLQFDPAPRQIEPDTTRKTPDYFL

SEQ ID NO: 3693 - protein, 306 aa, Lycopersicon esculentum
MPSHADLDRQIEQLMECKPLSEADVKTLCDQARAILVEEWNVQPVKCPVTVCGDIHGQFYDLIELFRIGGNAPDTNYLFMGDYVDRGYYSVETVTLLVALKVRYRDRITILRGNHESRQITQVYGFYDECLRKYGNANVWKYFTDLFDYLPLTALIESQIFCLHGGLSPSLDTLDNIRALDRIQEVPHEGPMCDLLWSDPDDRCGWGISPRGAGYTFGQDIASQFNHTNGLTLISRAHQLVMEGFNWCQDKNVVTVFSAPNYCYRCGNMAAILEIGENMEQNFLQFDPAPRQIEPDTTRKTPDYFL

SEQ ID NO: 3694 - protein, 365 aa, Unknown
  Bradyrhizobium sp. BTAi1
MSTSKLFEPYKLGPITLANRAVMAPLTRNRAVEGLAAGPLTATYYAQRASAGLLISEASQVSQQGQGYQDTPGIYSKEQIAGWRKVTDAVHAKGGRIFIQLWHVGRISHVSLQPHGGAPVAPSAIAAKTKTFVGGAFTDVSAPRALELAEIPGIVQAFKQAALNAIEAGFDGVEIHGANGYLLDQFAKDGANKRTDAYGGSIENRARLMLEVAKAVSEAIGADKTGIRLSPVTPANDISDSNPQALFDYIVDQLNALKLVYIHVIEGATGGPRDVAPFDYASLRKRFKGTYIANNGYDLALANKQLDANAADLIAFGRPFIANPDLVERLKQNAPLNELDRATLYGGGAKGYTDYPTLQASQAAE

SEQ ID NO: 3695 - protein, 240 aa, Zea mays
TRVEFCKNEGLVLLADEVYQENIYVEDKPFHSFKKIARSLGYTDDDLPLVSFQSVSRGYYGECGKRGGYMEITGFSPEVREQIYKVASVNLCSNVSGQILASLVMNPPKAGDESFESFMSEKDGILSSLARRAKALEEAFNSLEGITCNKAEGAMYLFPRLHLPQKAIGAAQAVGTAPDAYYAKRLLEATGIVVVPGSGFGQVPGTWHFRCTILPQEDKIPAIVSKLKEFHEKFMDEFRD

SEQ ID NO: 3696 - protein, 615 aa, Bacillus halodurans
MCGITGWVDWRRNLQNETETIKQMAETQTHRGPDDLNVWTEKHAALGHSRLIVVDPEGGCQPMMRERNGKRYTIVYNGELYNTEDLRKELIVKGYQFQGHSDTEVLLVSYIEWGYQCVEKFNGIFAFAIWNDKDQSLFMARDRLGVKPLFYTVRHGFLLFATEIKALLAHPEIEPVLTEEGLSEVLGLGPSRSPGNGVFDDIQELRPAHLLTYDRNGAKVSRYWRLKSMAHSEDAMETAAHLRDLLEDTVERQLFADVPVGMFLSGGVDSSALTAIAALIYEREGKGLIRTYSIDYDENDKYFKANDFQPNADGPWVEKVSTTFRTNHHNAVISIEELANQLKRAVELRDLPGMADVDSSLYWFCKQIKKDVTVGLSGECADEIFGGYPWFHKPEVMNFNGFPWMRSADERQELLHERWRQKLNLPKYVHDRYKETIAETPRFEEDTPEEARRREISYLNMVWFMTTLLDRKDRMSMGASLEVRVPFSDHRIVEYAWNIPWEIKQFGGREKGILRKALEGILPDEVLYRKKSPYPKTHHPKYTKMVQQEMERILGQSDSPLFDVVNRKKLKELTETGGKALTTPYFGQLMTGPQLLAHFIQMEHWLKHYNIKLIG

SEQ ID NO: 3697 - protein, 271 aa, Zea mays
MRNSTAAQPSTPSSAPAMSGSGPAYVAPASSTPVGGGYTYPAPASSGGSAGYARIPTYPAPPSAYPATNPPTPQVSTNAPVQDPTAPPSPLAKAGELVARLREQGQALIAARRPWAEVFRAAAFSRPPSLGEALARTRRNAAYFRANYALAVLAAVAASLLWHPGTLLALVLLCAAWFFLYFARGNQPLRVLGTEFDDGTVLAALCGVTVVALLFTSVGWNVVGSVMVGGALVGAHAALRTTDDLFLTEQEAAGDGLVAAGPILPTYVRIV

SEQ ID NO: 3698 - protein, 445 aa, Vibrio parahaemolyticus
MKKKIGLYWFTFDLRLHDNSLLVDASSFLDELVCLYCRPSVTPFLHHFAQEVTLGRARQKFIDASLCELNDALGQLGQRLWTLDLPPYQALKYAIQYLSVTHLYSDAMAGSDEQSILHKLQDEYPHLVIVQHSVRSLFDESKLPFTLPDLPETFTQFRKCVEGIDIAHPIDAPSRLPPMPKGAQLPTLSSFYFDESALFSGGEWSGLAHCRRYFFSGLASSYKETRNGLDGMAYSTKFSPWLALGCVSPRMIHAMLKQYEQTQGANDSTYWIYFELLWREYFYWYARCYQQRLFRFGGIRNQPPLTSFYAHRFQQWKNGTTPYPIVNACMHQLNHTGYMSNRGRQLVASCLVHELGLDWRYGAAYFETQLIDYDVGSNWGNWQYLAGVGADPRGSRQFNLEKQTQMYDPNHEFIERWQGRDSRAQQDVVDMVGWPITTQQENGDK

SEQ ID NO: 3699 - protein, 464 aa, Listeria innocua
MTYKFPDNFWWGSAASGPQTEGAANVDGRKPSIWDHWYKIEPGRFFNDVGPTNTSNFYYQYKEDIALMKQTGHNSFRTSIQWSRLIPDGIGEVNPKAVDFYNRVIDEMLANNVEPFMNLYHFDMPMSMQEKGGFESREVVDAYATFAKTCFELFGDRVKHWFTFNEPIVPVEAGYLYDMHYPNVVDFKRATQVGYHTTLAHALAVKEFHALEIPEGQIGIILNLTPSYPRSQNPADLKAAHIADLIFNRSFLDPVTKGEFPADLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGSNCHGYHLWTFMDCWSWANAYKNRYGLVEVDLDNDFKRTVKASGHWYKELSENNGFED

SEQ ID NO: 3700 - protein, 206 aa, Chlamydomonas reinhardtii
MSTKKRRLLKVIILGDSGVGKTSLMNQYVQKKFTKEYKATIGADFLTKEIEVDDKKVTMQIWDTAGQERFQSLGSAFYRGADCCVLVFDVNNAKSFDDLDNWRDEFIIQAGPPDPDNFPFMVLGNKIDENGGSSRQVSEKKAKAWCASKGSIPYFETSAKEDINVEAAFTCITRNALRNEKEEELFMPDAVDMNTTATQRKRAGCC

SEQ ID NO: 3701 - protein, 201 aa, Phytophthora infestans
MNPEYDYLFKLLLIGDSGVGKSCLLLRFADDTYTESYISTIGVDFKIRTIELDGKTIKLQIWDTAGQERFRTITSSYYRGAHGIIVVYDVTDQESFNNVKQWLHEIDRYACENVNKLLVGNKSDLTAKRVVSTDAAKEFAESLGIEFLETSAKNAANVEKAFMMMAAQIKKRMANAPVAPKAGVKLTPGQQVPSNGGSKCC

SEQ ID NO: 3702 - protein, 278 aa, Bacteroides thetaiotaomicron
METVRLNNGVEMPILGYGVYQVTPEECERCVLDAISVGYRSIDTAQAYYNEEGVGNAVRKCGVPREELFITTKVWISNGGYEKAKASIDESLRKLQSDYVDLLLIHQPFNDYYGTYRAMEEAYKAGKARAIGVSNFYPDRFIDLAEFCEIKPAVNQVETHVFNQQVKPQEIMKKYDTKVMSWGPFAEGRNNFFSNEVLKAIGEQYGKSVAQVALRFLIQRDIIVIPKSTRKERMIENFDVFDFTLSVKDMEEIAGLDKKESLFFSHYDPEMVNFLINL

SEQ ID NO: 3703 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQEGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKESYYWYRNVVSNNWLETRR

SEQ ID NO: 3704 - protein, 484 aa, Nicotiana tabacum
MVFISGNVQKQQLLSKIATNDGHGENSAYFDGWKAYENDPFHLSNNPNGVIQMGLAENQLCFDLIQEWVVNNPKASICTTEGAEDFKDIAIFQDYHGLPEFRQAVARFMEKVRGDRVTFDPNRIVMSGGATGAHETLAFCLANPGDAFLVPTPYYPGFDRDLRWRTGVQLFPVVCDSSNDFKVTKKALEAAYEKAQESNINIKGLLINNPSNPLGTLLDSDTLRDIVTFINSKNIHLICDEIYAATVFDQPKFFSVSEIVEEHVGCNKDLIHIVYSLSKDLGFPGFRVGIVYSYNDTVVNIARKMSSFGLVSTQTQHLIASMLSDEIFIEKFIAESSERLGKRHGMFTKGLAQVGISTLKSNAGLFFWMDLRRLLKEPTLESELELWRIIINEVKLNVSPGCSFHCSEPGWFRVCFANMDDETMRTALRRIRNFVLQTKGLNNKAAVKKQCSRSKLQISLSFRRMDDFMNSPVHSPMNSPLVRT

SEQ ID NO: 3705 - protein, 175 aa, Xylella fastidiosa
MHPKNFQHQLKTIPQPPEETRDFVFNHTMLRVKDINASLDFYARILGFRLIDQRDFPEAQFSLYFLALLPQTVHISDNDTERRLWMSGIPGVLELTHNYGTETQEGQIYHNGNSEPRGFGHICISVPDLYSACARFDTLQVPYQKRLTDGRMKNIAFIKDPDGYWVEIISNTPLP

SEQ ID NO: 3706 - protein, 279 aa, Staphylococcus aureus
MLNEIQILNNGYPMPSVGLGVYKISDEDMTKVVNAAIDAGYRAFDTAYFYDNEASLGRALKDNGVDREDLFITTKLWNDYQGYEKTFEYFNKSIENLQTDYLDLFLIHWPCEADGLFLETYKAMEELYEQGKVKAIGVCNFNVHHLEKLMAQSSIKPMVNQIEVHPYFNQQELQEFCDRHDIKVTAWMPLMRNRGLLDNPVIVKIAEKYHKTPAQVVLRWHLAHNRIIIPKSQTPKRIQENIDILDFNLELTEVAEIDALDRNARQGKNPDDVKIGDLK

SEQ ID NO: 3707 - protein, 279 aa, Staphylococcus aureus
MLNEIQILNNGYPMPSVGLGVYKISDEDMTKVVNAAIDAGYRAFDTAYFYDNEASLGRALKDNGVDREDLFITTKLWNDYQGYEKTFEYFNKSIENLQTDYLDLFLIHWPCEADGLFLETYKAMEELYEQGKVKAIGVCNFNVHHLEKLMAQSSIKPMVNQIEVHPYFNQQELQEFCDRHDIKVTAWMPLMRNRGLLDNPVIVKIAEKYHKTPAQVVLRWHLAHNRIIIPKSQTPKRIQENIDILDFNLELTEVAEIDALNRNARQGKNPDDVKIGDLK

SEQ ID NO: 3708 - protein, 235 aa, Arabidopsis thaliana
MSSYSIASAISRISPLIRFVKPYSTGFSFITCACNSTRRPKRFDQLCVFSMASEARESPANNPGLSTNRDEATKGYIMQQTMFRIKDPKASLDFYSRVLGMSLLKRLDFSEMKFSLYFLGYEDTTTAPTDPTERTVWTFGQPATIELTHNWGTESDPEFKGYHNGNSEPRGFGHIGVTVDDVHKACERFEELGVEFAKKPNDGKMKNIAFIKDPDGYWIEIFDLKTIGTTTVNAA

SEQ ID NO: 3709 - protein, 369 aa, Unknown
  Burkholderia sp. 383
MSALFEPFKLKDVTLRNRIAVPPMCQYVAEDGVVNDWHHVHLAGIARGGAGLVIAEATAVSPEGRITPGCAGLWNDAQAEAFAPSVAAIKAAGAVPGIQIAHAGRKASANRPWEGDDHIADGDPRGWQTIAPSAVPFGAHLPKTPRAMTRDDIARVQADFVASAKRARDLGFEWLELHFAHGYLGQSFFSVHANQRDDEYGGSAENRGRFLVETLAAVRKVWPEHLPLTARFGVIEYDGRDEETLAESIALTQRLKQEGLDMLSVSVGFSTPDAQIPWGPAFLAPIAERVRREAGLPVSSAWGIDTPQLANRVVAEEQLDLVMVGRAHLADPHWPYYAAKQLGVERPSWTLPAPYAHWLERYRTADKVA

SEQ ID NO: 3710 - protein, 363 aa, Oryza sativa
MSFCERDMNKESMYQERDDMAGIRFATPPLPQQQQQQQLVECFSDEVDSRGSGGEMKDAVGSGSGQLVVVGGGDGASIEVAKKRRGRPPGSKNKPKPPVVITREAEPAAAMRPHVIEIPGGRDVAEALARFSSRRNLGICVLAGTGAVANVSLRHPSPGVPGSAPAAIVFHGRYEILSLSATFLPPAMSSVAPQAAVAAAGLSISLAGPHGQIVGGAVAGPLYAATTVVVVAAAFTNPTFHRLPADDDASVSVSVSLSGSGDADEHRGHQHKPEPQEPRQLRRPPPHLSAAAAVSAAQPVEPCGAPMYACHPQPQEVMWPPPARTPHPPPPPPWGEQEKGGEGDERGRDGVVEGRVAAAGDVE

SEQ ID NO: 3711 - protein, 158 aa, Triticum aestivum
MAAISSTSYFSSQPQLPASGGGSNGRQPRRRRMGGSCVMLEAAAASGSGGGGVVVGRTRSLTEEDLEELKGCLDLGFGFSYHQIPGLCGTLPGLELCYSMTRRFLDEQRTVVGQLEPVAAAAPIPDWKISGPGDSPEEVKARLKYWAQTVACTVKLCS

SEQ ID NO: 3712 - protein, 158 aa, Glycine max
MAIRLMDLDSPFFNTLHRIMDLTEDAEKNLNAPTRTYVRDAKAMAATPADVKEYPNSYVFVIDMPGLKSGDIKVQVEDDNVLLISGERKREEEKEKEGGKYLRMERRLGKLMRKFTLPENANTDAISAVCQDGVLTVTVNKLPPPQPKKPKTIEVNIA

SEQ ID NO: 3713 - protein, 284 aa, Zea mays
  misc_feature (258)..(258): Xaa can be any naturally occurring amino acid
LLTRSILLFLQTDLSCGPSSKAKGGQPAATTGSGGDRQGRGKIEIKRIENTTNRQVTFCKRRNGLLKKAYELSVLCDAEVALVVFSSRGRLYEYANNSVKSTIERYKKANSDTSNSGTVAEVNAQHYQQESSKLRQAIDSLQNANRTIVGDSIHTMGLRELKQMEGKLEKAINKIRARKNELLYAEVEYMQRRMDLQTDNMYLRSKIAENNNETGQPAMNMIGVPSTSEYDHMASFVDSRNFLQVNMQQQQPQHYSHXAATNDPPTRMMKLRIFGQQSMHASTQ

SEQ ID NO: 3714 - protein, 128 aa, Zea mays
  misc_feature (72)..(72): Xaa can be any naturally occurring amino acid
  misc_feature (104)..(104): Xaa can be any naturally occurring amino acid
MVLSHGVGGSDESVHSTFASRYVRTSLPRYRMPEQSIHVDAASGGFIAPFLYPELEWDFRLPLVKSINVSGXKYGLVYAGIGWCIWRTKEDLPGELIFHINYLXADQPTFTLNFSKGASLGSLFFLGL

SEQ ID NO: 3715 - protein, 445 aa, Pseudomonas syringae
MLHLSRLTSLALAIAIVIGAPLAQAAEKTAPATPAAVSPAKPNANAKPPLPLDELRTFAEVMDRVKAAYVEPVDDKTLLENAIKGMLSNLDPHSAYLGPEDFQELQESTSGEFGGLGIEVGVEDGFVKVVSPIDDTPASKAGIEAGDLIVKINGTPTQGQNMQEAVDKMRGKIGEKITLTLVRDGGTPFDVTLARATIQVKSVKAQMLENGYGYIRITQFQVKTGDEVGKALAKFRKDNGKKMSGLILDLRNNPGGVLQSAVQVADHFLTKGLIVYTKGRIANSELRFSADPADASEGVPLVVLINGGSASASEIVAGALQDQKRGILMGTDTFGKGSVQTVLPLNNDRALKITTALYYTPNGRSIQAQGINPDIVVRRAKVTSEADGENYKEADLMGHLGNGNGGADKPTVKGGAAAKARPQDDDFQLSQALSLLKGLSITRGN

SEQ ID NO: 3716 - protein, 482 aa, Pseudomonas syringae
MQLIWLRSDLRAQDNTALTAAMERGPTLAVYLLSPAQWRSHDDADCKVDFWLRNLVELEKALGELNVPLLIREADTWDQAPEVLATLCTQFKVEGLHLNQEYGINETRRDQAVQKAMGKAGVHFNSYLDQLLFKPGSILTKTGNYFQVFTQFKKVCYTRLHEAMPHPVRTPQAQAAQSIKSDAVPKQVKGFATPSKALRDLWPAGEAEARRRMDAFAAEQISYYKTERDFPAKPGTSQLSAYLAAGVISPRQCLHAALASNQGEFETGDVGTVTWINELLWREFYKHTLVGYPRVSRHRAFRPETEALKWRDAPEELRAWQEARTGLPIIDAAMRQLLETGWMHNRLRMVVAMFLTKNLLIDWREGERFFMRHLIDGDLASNNGGWQWSSSTGTDSAPYFRIFNPLSQSERFDPEGVFIKRWLPELADMNKKQIHDPSLIGDLFGAADYPKPIVDLSKSRARALAAFKALPARQPAAGVEHG

SEQ ID NO: 3717 - protein, 548 aa, Escherichia coli
  misc_feature (160)..(160): Xaa can be any naturally occurring amino acid
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGXLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 3718 - protein, 507 aa, Ashbya gossypii
MAGNNDKTNSAEVREDRVVTNSVGNPINEPFATQRVGQHGPLLLQDYNLLDLLAHFNRERVPERNPHAHGSGAFGYFEVTDDITDVCGSAMFGEVGKRTRALVRFSTVGGEKGSADTVRDPRGFAVKFYTEEGNLDWVYNNTPVFFIRDPSKFPHFIHTQKRNPRTNLKDANMFWDFLTTPENQVAIHQVMILFSDRGIPASYRHMNGYSGHTYKWSNKQGDWRYVQVHIKTDQGIKNLTAEEGAKLAGEDPDFCQQDLVQALERGEYPSWTVYIQTMTEEQAQKLPFSVFDLTKVWPHKDFPLRRVGRLVLNEVPTNFFAQIEQAAFSPATTVPYQEPSADPVLQARLFSYADAHRYRIGPNYHQVPVNCPYASKFFNPAIRDGPMNVDGNLGSEPNYLATNNNYRFLGADRPIQQHQETWQGPAQPVHWATTGDIDFAQATALYHVLGRTPGQQRNLAHNVAIHVASADPPIQERVFQMFSRVDKGLGEAIRSEATALSQKKPKL

SEQ ID NO: 3719 - protein, 474 aa, Synechococcus elongatus
AAPILFWHRRDLRLSDNIGLAAARAQSAQLIGLFCLDPQILQSADMAPARVAYLQGCLQELQQRYQQAGSRLLLLQGDPQHLIPQLAQQLQAEAVYWNQDIEPYGRDRDGQVAAALKTAGIRAVQLWDQLLHSPDQILSGSGNPYSVYGPFWKNWQAQPKPTPVATPTELVDLSPEQLTAIAPLLLSELPTLKQLGFDWDGGFPVEPGETAAIARLQEFCDRAIADYDPQRNFPAEAGTSGLSPALKFGAIGIRQAWQAASAAHALSRSDEARNSIRVWQQELAWREFYQHALYHFPSLADGPYRSLWQQFPWENREALFTAWTQAQTGYPIVDAAMRQLTETGWMHNRCRMIVASFLTKDLIIDWRRGEQFFMQHLVDGDLAANNGGWQWSASSGMDPKPLRIFNPASQAKKFDATATYIKRWLPELRHVHPKDLISGEITPIERRGYPAPIVNHNLRQKQFKALYNQLKAAI

SEQ ID NO: 3720 - protein, 446 aa, Oryza sativa
MAARGALRRVGKYEVGRTIGEGTFAKVKFAQNTESGESVAMKVVDRSSILKHKMADQIKREISIMKLVRHPNVVRLHEVLASRKKIFIILEFITGGELFDKIIRHGRLNEADARRYFQQLIDGVDFCHSKGVYHRDLKPENLLLDSQGNLKISDFGLSAWPAQGGALLRTTCGTPNYVAPEVLSHKGYDGALADTWSCGVILYVLLAGYLPFDEVDLTTLYGKIESAEYSFPAWFPNGAKSLIHRILDPNPDKRIRIEEIRNDEWFKKNYEPTREIESEEVNLDDVNAAFDDPEEDADHTLDDEAGPLTLNAFDLIILSQGLNLAALFDRRQDYDKLQNRFLSRKPAKVIMSSMEVVAQSMGYKTHIRNYKMRVEGLNANKTSHLAVMLEIFEVAPSIFMIELQRAAGDTSDYNKFINNYCSKLDDIIWNFPIEKSKSRISRLSKR

SEQ ID NO: 3721 - protein, 411 aa, Unknown
  Frankia sp. CcI3
MSRESELQSAIAASAAVSGSTDSVIIKSTVTTSGTATTSGTAKSIPTTTLGSGTLGSGTLGSAAARVAASRPGDYDGCPPGRSRPDPTLPSGPPLPARATGPRRSTRPDVADQSKTLGEQVLLAFFIVVPLLALLAAVPLAWGWGLGWHDLVIGAVMYLITGFGVTVGYHRLFTHGSFRTGRPLRIILAVAGSLAIEMGVTDWVAAHRRHHKYSDQAADPHSPWRFGHHGRGLAKGFLHAHVGWLFHPERTAPETFCPDLLADRDIAAISARFPWLVAASVLLPPLVGGLWSMSWAGAATALFWGALVRIALLHHVTFSINSICHTIGTRPFAARDRSSNVWWLAIPSLGESWHNLHHADPTSARHGVLPGQIDPSAALIRLFEKLGWAHDVRWPTAKRIAARRVDAGAGR

SEQ ID NO: 3722 - protein, 256 aa, Schizosaccharomyces pombe
MSFHITPIWMWKGTGNNYAYLLTCDKTKITAIVDPAEPESVIPVIKEKTAKKEIDLQYILTTHHHYDHAGGNEDILSYFPSLKVYGGKNASGVTYTPKDKEIFKVGEVQVEALHTPCHTQDSICYYVSSPSKRAVFTGDTLFTSGCGRFFEGDAKQMDYALNHVLAALPDDTVTYPGHEYTKSNAKFSSTIFSTPELTKLVDFCKNHESTTGHFTIGDEKKFNPFMCLGLESVQKAVGSSDPITVMKKLRDMKNAA

SEQ ID NO: 3723 - protein, 366 aa, Unknown
  Halobacterium sp. NRC-1
MADSFSPLELRDTTIRNRFAMSPMCQYSCEDRDGLATDWHRVHLGSRAVGGAGVVMTEATAVEERGRISPEDLGIWSDEHGEALAPVAEFISDQGATPAIQLAHAGRKAGTARIWGDDSGPVPLDEGGWDPVAPSADPYPYEDDERDTRKLSTADIEDVVEAFRDAARRANEAGFEVAEIHAAHGYLIHQFLSPVSNHRDDEYGGSFENRTRLAREVTSAVREEWPDDKPVFVRISATDWIDDRDSWTVEESVQLADDLHALGADLIDVSTAGIHPDQDIQSGGPNYQLQFAERINADTERDVAVGTVGGIQSAEQADAIVRNDRADLAIVGREFLRDPYFPLHAARELGREDAADVPPQYRRGFQ

SEQ ID NO: 3724 - protein, 209 aa, Triticum aestivum
  misc_feature (194)..(194): Xaa can be any naturally occurring amino acid
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGINVEEAFQCIVKNALKNEPEEELYMPDTVDVXGGNRGQDPQGAVRPE

SEQ ID NO: 3725 - protein, 141 aa, Arabidopsis thaliana
MMSFEMNDRKKIGLGLTGFGVFFSFLGIVFVFDKGLLAMGNILFISGVSLTIGFKSTMQFFMKRQNYKGTISFGVGFFFVIIGWPILGMMLETYGFFVLFSGFWPTLAVFAQKIPVLGWIIQQPYIRSVCVQLQTTIANFA

SEQ ID NO: 3726 - protein, 146 aa, Unknown
  Magnetococcus sp. MC-1
MAALMEYDPFRNVRTLQNEINRLFDHNWEEPNGQMAKWPMRVDIREDENQIMIKADLPGMTQQDISVDVDNGTLTISGERKFDDEQNRDGYHRIERAYGRFSRSFQLPNTTDTGNIAAKYQNGVLEVTLPKLDEAKPRSIQVEVLN

SEQ ID NO: 3727 - protein, 491 aa, Unknown
  Synechococcus sp. WH 8102
MSSLQIVWFKRDLRVDDHRPLLEAAARGPVLPLYVVEPELWQQPDASERQWLFCRESLLELRQALAELGQPLVVRSGDVVQVLERARRQFGVDGLWSHEETGNGWTYQRDKRVGAWARAHGIQWGEIRQFGVTRRMRSRNGWAKRWEEQMAEPITPAPAGVPALEEIDPGVIPERPCPELLPDDCSQRQTGGRSIGLGELRDFLQHRAPCYQRAMSSPKSAFTGCSRLSAYLAWGCLSMREVLQTSRHHSGRGVSSFESRLHWHCHFIQKLEDQPEIEFSDFHPYMRGIRETNAERLAAWTEGRTGVPFVDACMRALKAHGWINFRMRAMLMSFASYNLWLPWRDSGLHLARQFVDYEPGIHWSQCQMQSGSTSINTIRIYNPIKQGMDHDPQGVFIRQWCPELKDVSTIHIHEPWMLGGGRSAPIVDVTTSMQLAKDRIWEIRRSAGFDRHADAIQRMHGSRKAGLKPTASRRRQKRSNDNGVRQLSLEL

SEQ ID NO: 3728 - protein, 256 aa, Glycine max
HGVIDPIEELGHLASSFGICFHVDLCLGGFVLPFARELGYHIPPFDFSVKGVSSISVDVHKYGLAPKGTSVVLYRNHEIRKHQFVAVTEWSGGLYVSPTIAGSRPGSLIAGAWAAMISLGKEGYLKNTKEIMEGSRRIQKGIEEIAELFIVGKPDMTIVAFGSAVLDIFEVNDVMSSKGWHLNALQRPNSIHICVTLQHVPIVEDFLNDLKESVKTVKANPGPISGGLAPIYGAAGKMPDRGMVQELLVDYMDGTC

SEQ ID NO: 3729 - protein, 319 aa, Arabidopsis thaliana
MKLDVYNGTLPSLVSTTYSWTKTSSIIFLDQPVGTGFSYSRTQQFNKPSDSGEAKRIHEFLQRWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKASLSFF

SEQ ID NO: 3730 - protein, 219 aa, Glycine max
MEAEHHHQTSNAGGIIGGLYVKVMTDDQMELLRQQISVYATICQQLVEMHKAVTIQQDLAGLRLGNLYCDPLMACSGHKITARQRWTPTPLQLQVLERIFDEGNGTPSKQKIKDITIELGQHGQISETNVYNWFQNRRARSKRKQLTPALNVVEPEVETEVEVESPKEKKTRAEGFQVQPYEKSSPHRIKDMYIQSPDIGFDQLMSKIEVAGCYSSYFL

SEQ ID NO: 3731 - protein, 471 aa, Listeria monocytogenes
MHTNTGFPADFLWGGAAAANQFEGAYNVDGKGLSVQDVTPKGGFGHITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSHPDDIIAVMEAERKNYFFSDVHVRGTYPGYMKRYFRENNIELDVTEEDLEILKNTVDFISFSYYMSTTETADESKRKAGAGNILGGVQNPYLEASEWGWQIDPQGLRVVLNEFWDRYQKPLFIVENGLGAIDQLEQDENGNYTVNDDYRINYLSAHLSQVKEAIKDGVDLMGYTSWGCIDLVSASTAEMKKRYGFIYVDRNNDGTGTLNRYKKKSFDWYKNVIATNGEDL

SEQ ID NO: 3732 - protein, 544 aa, Thiomicrospira crunogena
MAKDVRLGLDAREKMVEGINVLADAVKVTLGPKGRNVVLEKSFGAPTVTKDGVSVAREIELEDKFMNMGAQMVKEVSSQTNDVAGDGTTTATVLAQSIVREGMKSVAAGMNPMDLNRGIHKAVEAVVKEIQKMSVPCTTTESIAQVGTISANSDSAVGKMIAEAMEKVSTEGVITVEEGSSLHDELVVVEGMEFDRGYLSPYFVTNQEKMVAELDNPYILLHDKKISNIRDLLPTLEAVSKAGRPLLIIAEDVDGEALATLVINNMRGIVKATAIKAPGFGERRKAMLQDMAVLTGGTVISEEVGLTLENVTLDMLGETKSAVVGKDSTKLIDGAGAKADIEARCAQIRSQAENTTSEYDSEKLQERLAKLAGGVAVIKLGAATEVEMKEKKDRVDDALHATRAAVQEGIVAGGGVALVRARSKVKVKGDNDEQQLGIEIALRAMEEPMRQIAANCGLEGSVIVNKVMESKDNMGFDAASETYVDMIKAGIIDPAKVTRSALQNAASVAGLVLTTGAAIADLPSKDGASADAAAGGMGGMGGMM

SEQ ID NO: 3733 - protein, 257 aa, Anabaena variabilis
MQVIRLAALSDNYIFLLHDSQKNIAAVVDPAEAEPVLKQLAQLNAELVAIFNTHHHNDHVGGNQQLIQNFPQLKVYGGAEDKGRIPGQQVFLQPGDRVQFTDRVAEVIFVPGHTRAHIAYYFPPQTADTPGELFCGDTLFAGGCGRLFEGTPAQMVESLTKLRSLPENTRVWCAHEYTLKNLQFALSVDSENTELQKRFDEVKTKRSQGIATVPSLLGVEKLTNPFLRWEQPSLQSAVNSNDPVQTFARIRGLKDKF

SEQ ID NO: 3734 - protein, 548 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVTCSDSKAITQVGTISANADEKVGSLIAEAMEKVGNDGVITVEEGTGLQDELEVVKGMQFDRGYLSPYFINKSETGIVELENPYILMADKKISNIREMLPILESVAKSGKPLLIISEDLEGEALATLVVNSMRGIVKVAAVKAPGFGDCRKAMLQDISILTNGTVISEELAMELEKSTLEDLGQAKRVVISKDTTTIIGGVGEKHAIQARINQIRQEIQDASSDYDKEKLNERLAKLAGGVAVLKVGAATEVEMKEKKARVEDALHATRAAVEEGVVAGGGVALVRVAGKLSNLRGQNEDQNVGIRVALRAMEAPLRQIVSNSGEEPSAVTNNVKDGKGNYGYNAATDEYGDMIDFGILDPTKVTRSALQYAGSVAGLMITTECMVTDLPKEDKSSDLGSAPAGGMGGMGGMM

SEQ ID NO: 3735 - protein, 547 aa, Buchnera aphidicola
MAAKDVKFGNEARVKMLRGVNVLADAVKVTLGPKGRNVVLDKSFGAPSITKDGVSVAREIELEDKFENMGAQMVKEVASKANDVAGDGTTTATLLAQAIVNEGLKAVAAGMNPMDLKRGIDKAVINAVSELKQLSVPCLDSKAITQVGTISANADETVGTLISEAMEKVGNDGVITVEEGTGLEDELEVVKGMQFDRGYLSPYFINKPETGIVELENPYILMVDKKISNIRELLPILEAVAKSSKPLLIISEDLEGEALATLVVKSMRGIVKVAAVKAPGFGDRRKAMLQDISILTAGTLISEELAMDLEKSTLEDLGQSKRVVITKDTTTIIDGSGSKKDIKNRISQIKQQIQESTSDYDKEKLNERLAKLSGGVAVLKVGAATEVEMKEKKARVEDALHATRAAVEEGVVPGGGVALVRVAQKISKILGQNEDQNVGIRVALRAMEAPLRQIVSNSGEEPSVVTNNVKDGIGNYGYNAATDEYGDMIKFGILDPTKVTRSALQYAGSVAGLMITTECMVTDLPKEEKSDLSVPPQGGMGGMGGMM

SEQ ID NO: 3736 - protein, 469 aa, Bacillus cereus
MVVAFLIGAGGMFAGMSLFGVNPAEVTQTISSGNASTAQGNLAKINEAYALIDSRYVEDVKDEKLVEGAIQGMLSTLKDPYSTYMDKETAKQFSESLDPELEGIGAEVNKTDGKLIIVSPIKGSPAEKIGIKPNDQILSVDGNSVKDLSREEAVLKIRGKKGTTVAIEIKRAGVADPIVFKIKREKIPIFTVFSSVKQESGKDIGYMQITSFAENTAKEFKDQLKELEKKNIKGLVIDVRGNPGGYLNSVEEILGEIMTDKKPMLQVEQRNGEKKKFSTELKERKPYPISVLIDNGSASASEILAGALKEGEGYDLIGEKTFGKGTVQQAVPFKDGSNIKLTMFKWLTPDGNWIHKKGIAPTVEVKQPDYYHATPIQIEKTLSYNSNDVQVKHAQEMLKSLGYVTGREDGYFSKETESALKAFQNANKMEATGQLDKKTAEAIQTKIIEKIRSGENDLQLQSALKLMAK

SEQ ID NO: 3737 - protein, 550 aa, Buchnera aphidicola
MAAKDVKFGNDARVKMLRGVNVLADAVKVTLGPKGRNVVLDKSFGAPAITKDGVTVAREIELEDKFENMGAQMVKEVASKANDAAGDGTTTATVLAQSIVTEGLKAVAAGMNPMDLKRGVDKAVIAAVEELKCLSVPCSDFKAIAQVGTISANSDETVGKLIAEAMEKVGKEGVITVEEGTGLQDELDVVEGMQFDRGYLSPYFINKPDTGSIELDNPFILLADKKISNNREMLPPLESVAKAGNLLIIAEDVEGEALATLVVNTMRGIVKVAAVKAPGFGDRRKAMLQDIATLTGSTVISEEIGLELEKTTIEDLGHAKRVVINKDTTTIIDGIGNESAIKGRVVQIRQQIEEATSDYDREKLQERVAKLAGGVAVIKVGAATEVEMKEKKARVEDALHATRAAVEEGVVAGGGVALIRVAGKISSLTGENEDQNVGIKVAIRAMESPLRQIVINAGEEASVIANNVKAGKGNYGYNAYSEQYGDMIKMGILDPTKVTRSALQYAASVAGLMITTECMITDLPKSDSSDLSNAGNGGMGGGMGGMGGMM

SEQ ID NO: 3738 - protein, 553 aa, Buchnera aphidicola
MAAKEVKFGNDARAKMLRGVNVLADAVKVTLGPKGRNVVLDKSFGAPTITKDGVSVAREIELEDKFENMGTQMVKEVASKANDAAGDGTTTATVLAQSIITEGLKAVAAGMNPMDLKRGIDKAVIAAVEELRKLSVPCSDSKAIAQVGTISANSDLTVGKLIAEAMGKVGKEGVITVEEGTGLQDELDVVEGMQFDRGYLSPYFINKPESGAVELENPFILLADKKISNIRELLPILEAVAKAGKSLLIIAEDVEGEALATLIVNTMRGIVKVAAVKAPGFGDRRKAMLQDIATLTGGTVISEEIGLELEKTILDDLGQAKRVVINKDTTIIIDGIGNEINIKGRIAQIHQQIEEATSDYVKEKLQERVAKLADGVAVIKVGAATEVELKEKKGRVEDALHATRAAVEEGVVAGGGVALIRVAGKISNLTGDNEDQNVGIKVALRAMESPLRQIVINAGEEASVIANNVKACEGSYGYNAYTEEYGDMISMGILDPTKVTRSALQYAASVAGLMITTECMITDLPKGETPDLNNSGGMGGGMGGGMGGMGGMM

SEQ ID NO: 3739 - protein, 149 aa, Xanthomonas oryzae
MPGHTRTHIAFVTDRHLFSGDTLFSLGCGRMFEGTAPQMFDSLQRLACLPGETLVCCGHEYTLANAAFALHVDSTNAALQRRQQEAQAMRHAARPTLPISLKSELATNPFLRTNRPEIRAVVAARAAGALSSEVDVFAELRRWKDEFCL

SEQ ID NO: 3740 - protein, 316 aa, Yarrowia lipolytica
MSFKLASGKSMPKVGFGLWKVPRDKTADTVYGAIKNGYRLFDGAFDYQNEREAGEGIRRAIKDGLVKREDIFITTKLWNTFHSKEHALQIAKEQNEWWGLDYIDLYLIHFPIPMQYIPISEKEWAGWTNATDSGPNPLAKIPTRETWEALEELVDTGIAKSIGVSNFTAQNIYDVQTYNKHPISALQIEHHPYLVQPQLTQLAKDNNIQVTAYSSFGPASFVEIGMDQKVPPLFENETITKIAKAHNKTPSQVLLRWATQRGIAVIPKSNNVERQTQNLESLDFDLTEAEIKEISNLNKNLRFNDPGVYANLPIFA

SEQ ID NO: 3741 - protein, 488 aa, Listeria seeligeri
MTDRRNLTTNQGVPMGDNQNSMTAGLKGPTLLEDYVLIEKLAHFDRERVPERVVHARGAGAHGKFVTKKSMKKYTKAQFLQEEGTETEVFARFSTVIHGQHSPETLRDPRGFSVKFYTEEGNYDFVGNNLPVFFIRDAIKFPDVIHSLKPDPHTNIQDGNRYWDFFSLTPEATTMITYLFSDEGTPASYREIRGSSVHAFKWINEEGKTVYVKLRWVPKAGIVNLSTDQAAQIQAKEFNHASRDLYEAIENGDYPEWDLYVQVLDPKDLDNYDFNPLDATKDWFEDVFPYEHVGTMTLNRNPDNIFAETESVGFNPGVLVPGMLPSEDRLLQGRLFSYSDTQRHRVGPNYLQLPINSPKTPVANNQRDGQMPFKQQTSSINYEPNSYDTEPKENPAYIEPEQEIRGDISGRLAAEKPNNFGHAKEVWNRYSDAERAALVKNIVDDWQGVREDIKVRNLRNFYQVEPEFAERVAAGTGINLAEHVIDLK

SEQ ID NO: 3742 - protein, 467 aa, Listeria innocua
MTSVMWFRRDLRVNDNKALYHACKEEDLILLFQVNPEQFIKGSPSHQAFFASVAHFQQELNKNTHLQIMFGEPIELLKQLKEKIPTWDKVFFNRDETGYGASRDEAARAFFADKEITVHSYHDSYLHSAEEVKKSATEYYKIFTPYYKKWREEIKEMPLKVTLKPEKIRKESLFPNYEEQFRELIQDLPAFDSGEKAANTRLANFVKEDLADYDKARDVPALDKTSHLSRYLRTGEISIRTVWQALQKEEATEGRATFEKELCWRDFYNMIYVSFPKQKNEPIQENYRFIEWENNREFFKKWQDGQTGFPLVDAAMRQLKETGWMHNRLRMITASFLTKDLLIDWRFGEKYFQQMLIDYDPASNIGGWQWAASTGTDAVPYFRIFNPTTQSEKFDPDGTFIRKYVKELRDLPDKFIHQPEKMSETEQKEHGLILGKDYPLPIIDHKERRKLAIARYEFSKEHSRGNI

SEQ ID NO: 3743 - protein, 365 aa, Escherichia coli
MSSEKLYSPLKVGAITAANRIFMAPLTRLRSIEPGDIPTPLMAEYYRQRASAGLIISEATQISAQAKGYAGAPGIHSPEQIAAWKKITAGVHAENGHMAVQLWHTGRISHASLQPGGQAPVAPSALSAGTRTSLRDENGQAIRVETSMPRALELEEIPSIVNDFRQAIANAREAGFDLVELHSAHGYLLHQFLSPSSNHRTDQYGGSVENRARLVLEVVDAGIEEWGADRIGIRVSPIGTFQNTDNGPNEEADALYLIEQLGKRGIAYLHMSEPDWAGGEPYTDAFREKVRARFHGPIIGAGAYTVEKAETLIGKGLIDAVAFGRDWIANPDLVARLQRKAELNPQRAESFYGGGAEGYTDYPTL

SEQ ID NO: 3744 - protein, 468 aa, Thermotoga maritima
MGSSHHHHHHSSGLVPRGSHMASNVKKFPEGFLWGVATASYQIEGSPLADGAGMSIWHTFSHTPGNVKNGDTGDVACDHYNRWKEDIEIIEKLGVKAYRFSISWPRILPEGTGRVNQKGLDFYNRIIDTLLEKGITPFVTIYHWDLPFALQLKGGWANREIADWFAEYSRVLFENFGDRVKNWITLNEPWVVAIVGHLYGVHAPGMRDIYVAFRAVHNLLRAHARAVKVFRETVKDGKIGIVFNNGYFEPASEKEEDIRAVRFMHQFNNYPLFLNPIYRGDYPELVLEFAREYLPENYKDDMSEIQEKIDFVGLNYYSGHLVKFDPDAPAKVSFVERDLPKTAMGWEIVPEGIYWILKKVKEEYNPPEVYITENGAAFDDVVSEDGRVHDQNRIDYLKAHIGQAWKAIQEGVPLKGYFVWSLLDNFEWAEGYSKRFGIVYVDYSTQKRIVKDSGYWYSNVVKNNGLED

SEQ ID NO: 3745 - protein, 696 aa, Ipomoea batatas
PPGLGQRIYEIDPLLKNFRDHLDYRFSHYRKIREAINQYEGGLEVFSRGYEKLGFTRSATGITYREWAPGATWATLIGDFNNWNPNADVMTRNEFGVWEISLPNNADGSPAIPHGSRVKIRMDTPSGIKDSIPAWINFSVQAPGAIPYDGIYYDPPEEERYKFQHPRPKRPKSLRIYECHIGMSSPEPKINTYAEFRDDVLPRIKKLGYNALQIMAIQEHSYYASFGYHVTNFFAPSSRFGTPDDLKSLIDRAHELGLVVLMDIVHSHASNNTLDGLNMFDGTDSCYFHSGTRGYHWMWDSRLFNYGNWEVLRYLLSNARWWLDEYKFDGFRFDGVTSMMYTHHGLSVGFTGNYSEYFGYATDVDAVVYLMLVNDLIHGLFPEAITIGEDVSGMPAFCIPVRDGGVGFDYRLHMAIPDKWIEILKRRDEDWQMGEIVHTLTNRRWLEKCVSYAESHDQALVGDKTIAFWLMDKDMYDFMALDRPATPVIDRGIALHKMIRLITMGLGGEGYLNFMGNEFGHPEWIDFPRGEQRLPDGSVLPGNNFSYDKCRRRFDLGDADYLRYRGMQEFDQAMHHLEEKYGFMTAEHQYISRQDEGDRVIIFERGDLVFVFNFHWTNSYSDYRVGCLKPGKYKVALDSDSPLFGGFGRVQPDAEFFTFEGYHDDRPRSFMVYAPSRTAVVYALAKEEDEAKPVEE

SEQ ID NO: 3746 - protein, 558 aa, Bacteroides fragilis
MCGIAGIFNIKIQSRELRNKALRMARKIRHRGPDWSGMYCGGSAILAHERLSIVDPQSGGQPLYSSDRKQVLAVNGEIYNHRDIRAQYAGRYEFRTGSDCEVILALYRDKGIHFLEELNGIFAFALYDEEKDEYLIARDPIGVIPLYIGKDAEGHVYFGSELKALEGFCDEYEPFLPGHYYHSKERTMKRWYTRDWMEYKEENDKQADSRSPTRQIQDALENAVHRQLMSDVPYGVLLSGGLDSSVISAIAKKYAAKRIETDGASDAWWPQLHSFAIGLKGAPDLIKAREVAEYIGTVHHEINYTLQEGLDAIRDVIYFIETYDVTTVRASTPMYLLARVIKSMGIKMVLSGEGADEIFGGYLYFHKAPDARAFHEETVRKLSKLHLYDCLRANKSLAAWGVEGRVPFLDKEFLDVAMQLDPEIKMAPGKVIEKKVLREAFADMLPSGIAWRQKEQFSDGVGYSWIDTLKEITATAVSDEQMAHAAERFPIHTPMNKEEYYYRSIFEEHFPSESAARSVPSIPSVACSTAEALAWDTTFKNLNDPSGRAVKGVHEEAY

SEQ ID NO: 3747 - protein, 192 aa, Chara globularis
MGRAKIEIKRIDNATSRQVTFSKRRNGLLKKAYELSVLCDADIAVIMFSPTGKLFEYANSSMKEILDRYHSCPPEQREKRKFDNTDYLSKEAKRLRHEVELAKQENRHLSGEDLNAVQMPELDGLELKLEDALRKIRFRKREVMQMEIDRLQQKVWTSSPQFLLAWRSCHPAVVQIIIFCSHPAFVPKFILQ

SEQ ID NO: 3748 - protein, 435 aa, Arabidopsis thaliana
MANNNVYSVLKSLLLLLHLVFLSKQHVDSASIVKFLPGFEGPLPFELETGYIGVGEEEEVQLFYYFIKSERNPKEDPLLLWLTGGPGCSAISGLLYQNGPLAMKLDVYNGTLPSLVSTTYSWTKTSSMIFLDQPVGTGFSYSRTQLFNKPSDTGEAKRIHEFLQKWLGKHQEFSSNPFYVGGDSYSGLVVPATVQEISKGNCQCCNRPINLQGYVLGNPLTDCVYDCNYRVPFAHKMALISDELYESLKRTCRGEYVNVHPHDTECLKFVEEFNKLTNRVCERHILHSCCETETPSCYSYRFMLTTYWANDETVRKALQINKEDLRLQESIGEWTRCYRGIPYNHDIKSSVPYHMNNSIDGYRSLIYSGDHDIQVPFLGTQAWIRSLNYSIIDDWRPWMIKDQIAGYIRGGGHTAEFTPKETFMMFQRWINGQPL

SEQ ID NO: 3749 - protein, 289 aa, Salmonella typhimurium
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYEAGKLKAIGVSNFYAHVLANFCETVRITPMVNQVELHPYFAQPAALETMKHYNVQPEAWAPLGGGRHKPYENVMLQGIADAHQKTIAQVVLRWNVQRGVTVIPKSTRQERIEENFAIWDFSLTDNEMAQINALDLGYVGEAVKHFNPEFVRGCLGVKIHD

SEQ ID NO: 3750 - protein, 953 aa, Bacteroides fragilis
MKYLTFPFLLLLLPLIGFGCSSEEKETDSLILSSDSEIFFEQGIDFAATSGTRNLSFSSGRPWRISLTTDTDTRRAADWCTVSPSSGTAGDASVTISIQENADYDSRSVKLTLVAGGIEKSFTVSQKQKDALTLTASRFEVGKEGGTVQVEVKANITFEVEIPEVDRSWISQANTRGLVVTNLAFTVAPNEGVAGREGEIVIRSGSLSEKIRITQEGRCDDGLSFRPETPDADRQLTLYFKATKTSPLYGYAGDVYVHTGVVSEGTWMYVPAEWNTNVDKCKMVRVADNIWSITLAPSIRQWFGSNETPVRQLGVVIRSADGSKKGTDGDSFVSVTDHLYKPFEPAAVRYASMPSGLQEGINLIDASTVTLVLYDKDKKGGHKDFAHVVGDFNDWKLSNESNSQMNRDDAAGCWWITLTGLQPTREYAFQYYVGTRAGEILRLADAYSRKILDPDNDKYIPSSTYPDAKEYPTGAVGIASVFKIQGDSYDWKVKNFRIPDKNNLMIYELLLRDFTATGDLNGAMEKIGYLKSLGFNAVELMPVQEFDGNDSWGYNPCFYFALDKAYGTDHMYKAFIDKCHEAGMAVLFDVVYNHASGSHPFARLYWDTKNNRTAADNPWFNVKEPHPYGVFHDFNHDSPLVRAFVKRNLKFLLEEYRIDGFRFDMTKGFTQNSSTEATAGSYDASRIAILKDYNETVREVNPEAVVILEHFCDEKEESELAEEGMQLWRNLNHAYCQSAMGYPSNSDFTPLVTFGTTMPYGGWVGFMESHDEERTAFKQIAYGEGPLKSDINVRMKQLAANASFFFTAPGPKMVWQFGEMGYDVSIEEGGRTGRKPLHWEYLDNEARKGLCNTYAKLLKLRREHSELFNPGSTFSWLVKTANWTGGRFLTLAATNGKRLVVVGNFTAKPIEAITSFPVTGVWTNYLDGTKLHVTSIPTGLTIPAHECRVYINF

SEQ ID NO: 3751 - protein, 488 aa, Rhodobacter sphaeroides
MTRMTTTAGAPIADNQNTLTAGPRGPVLLEDYQLIEKLAHQNRERIPERVVHAKGWGAFGTFTVTNDITRYSCAKVFSEVGKQTDLAVRFSTVAGELGAADHERDVRGFSVKMYTEEGNWDLAGNNTPVFFVRDPMKFPDFIHTQKRHPRTNLRSATAMWDFWSLSPESLHQVTILMSDRGLPVDPMHMNGYGSHTYSLWNAQGERFWVKFHWKTLQGHAHYTNAEAAEIVGRTREGYQEALFGAIEEGRFPKWRLMVQVMPEAEAETTPYNPFDLTKVWPHSDYPLIEVGVMELNRNADNYFAQIEQLAFSPSNKVPGIGYSPDKMLQARVFSYADAHRYRLGTHYEALPVNAPRCPVHHYHKDGQMNFFGHRTGAVDAYYEPNSVPGAAVEDPAVAEPPLRISGDAARYNHREGNDDYSQPRALHDKVMTDEQRARLYANIAEAMAGIPEEIANRAIAQFDRVSPAYGEGIRAARARLAGALQAAE

SEQ ID NO: 3752 - protein, 492 aa, Prunus persica
MGSSSATSNRLLLSKIATSEGHGENSPYFDGWKAYDRNPFHPTKNPEGVIQMGLAENQLSFDLIEDWIKKNPKASICTPEGVEEFKNVAIFQDYHGFPEFRKAVAMFMSKARGGRVTFDPNRVVMSGGATGANELVMFCLADPGDAFLVPSPYYPAFYRDLGWRTGVQIVPVDCDSSNNFQITKEALAAAYEKAQKNNINVKGLIITNPSNPLGTTLDRDTLESLVEFINQKNIHLVCDEIYAATVFSSPTFTCISEVIQNMNCNPNLIHIVYSLSKDMGLPGLRVGIVYSYNDDVVNIGRKMSSFGLVSSQTQHMLASMLLDEEFVARFLETSSKRLARRHGVFTKGLEEVGINCLKSNAGLFCWMDLRRLLKDRTFDGEMVLWRVIVNEVGLNVSPGSSFKCVEPGWFRVCFANMDDETVEVALKRIRTFVRQGKKAQDQAVQVKSPKRWKSNLRLSFSSSSTRRFDQDSVNVLSPHMMSPHSPLVRAKT

SEQ ID NO: 3753 - protein, 336 aa, Coleochaete scutata
MGRGKIEIRRIENATSRQVTFSKRRNGLLKKAYELSVLCDVDIAVIVFSPTGKLFQYASSSMKEILERYEQVPPEQKEKGSQRLDNMDYLNREVAKLRNEVEHKYHEARQLEGEDLDRLGVYELEQLEQKLSNSMRRIRGRKDELMKAELEGLRKQVADMETALVGAASFDGRPLSGSSNYLLQSIPGIRTMPPSSLGGMNPASTSLQLGSDRLFGNRGVELHDRSASDESPVMTNRMSVDFAQAPREMSGVDLSGSPVPPWKSQAAAAAQQEWKNQASSPTDWKVTNTEHLDSWPKAPAPTPEWKSTSVQPEWKNQSSPSSEWKPLDWMYHGPQD

SEQ ID NO: 3754 - protein, 34 aa, Glycine max
LHFGVNSAATRFAIERQAVNEATFRCPDEMGWKP

SEQ ID NO: 3755 - protein, 630 aa, Mesorhizobium loti
MCGIFGIVLKNEGTPVCAAAVERCADALAHRGPDASGLYINQSVAFAHRRLSIVDAHSRANQPYRDANTGVVVTYNGEIFNYREIKAELRDMGFSFSTVSDTEVLILSYIAWGKSFLNRLDGIFAFALFDPRKSLVLIARDRLGVKPLYYTICDVGLLFASQPNALIRWPGVMHGPDMIGALSFLSYRAVVGARTLFAGISKLEPGHLLEIRNGRHTSERWWNLSARISRSKPDYSDIRRLFGSAVERQLVADVPVAALLSGGLDSSILAYEASARSQIRPVCYTGKVETPDYDETAYAMEVAAEFGLTHRVVPIGEPSDINAVAELVRLRGHPLGMHNETAMFTLAKAISKEHKVVLTGEGADEIFAGYSRLFRTPYDYNRSKIITALPPALAQIARRRLGLGVHCSQLQFFLERYSYFPADEIRSLAIDGQMRTEHEMELFDHFSTQFAEAGGDFFSKISYVLVSTHLPALLEMVDNTTMAAGLEARVPYTDHQLVTAAMAMPGSQRLRWRSPIASAQALWHPVASFSERLDVSKYPLRREYRSVLPKSVLSRKKMGFPLPLGQWAVGEGATEYRRLLFDKDSPLGDLFDPAALRRWFKAGRRNPSDSFGRKFWLLANLGIFFKEVFS

SEQ ID NO: 3756 - protein, 216 aa, Phaseolus coccineus
MESGGFHGYRKLPNTTSPGLKLSVSDMNNVNTSRQVAGDNNHTADESNECTVREQDRFMPIANVIRIMRKILPPHAKISGDAKETIQECVSEYISFITGEANERCQREQRKTITAEDVLWAMSKLGFDDYMEPLTMYLHRYRELEGDRTSMRGESLGKRTIEYAPMGVGVATAFVPPQFHPNGYYGPAMGAYVAPPNAASSHHHGMPNTEPNARSM

SEQ ID NO: 3757 - protein, 551 aa, Buchnera aphidicola
MAAKDVKFGSEARAKMLRGVNILADAVKVTLGPKGRNVVLDKSFGAPSITKDGVSVAREIELEDKFENMGAQMVKEVASKANDVAGDGTTTATLLAQSIVNEGLKAVAAGMNPMDLKRGIDQAVIKAVKELKKLSVPCSDSKAITQVGTISANADETVGSLISEAMDKVGNDGVITVEEGTGLEDELDVVKGMQFDRGYLSPYFINKPETGNIELENPYILMVDKKISNIRDILSLLESVAKSGKPLLIIAEDLEGEALATLVVNSMRGIVKIAAVKAPGFGDRRKAMLQDISILTFLYNSDVISEELAMDLDKTTLEDLGQAKGVVITKDHTIIVGSGKKEIFKQILIRQQLIESTSDYDKEKLNERLAKLSGGVAVLKVGAATEVEMKEKKARVEDALHATRAAVEEGVVAGGGVALVRVAEKISRLKGQNEDQNVGIRVAVRSMEAPLRQIVANSGEEPSVVTNNVKDGVGNYGYNAATDQYGDMIKFGILDPTKVTRSALQYAASVAGLMITTECMVTDSPKEDKSSDMPSPSAGGMGGMGGMGGMM

SEQ ID NO: 3758 - protein, 488 aa, Listeria seeligeri
MTDRRNLTTNQGVLIGDNQNSMTAGLKGPTLLEDYVLIEKLAHFDRERVPERVVHARGAGAHGKFVTKKSMKKYTKAQFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMITYLFSDEGTPASYREIRGSSVHAFKWINEEGTTVYVKLRWVPKAGIVNLSTDQAAQIQAKEFNHASRDLYEAIENGDYPEWDLYVQVLDPKDLDNFDFNPLDATKDWFEDVFPYEHVGTMTLNRNPDNIFAETESVGFNPGVLVPGMLPSEDRLLQGRLFSYSDTQRHRVGPNYLQLPINSPKTPVANNQRDGQMPFKQQTSSINYEPNSYDTEPKENPAYIEPEQEIRGDISGRLAAEKPNNFGHAKEVWNRYSDAERAALVKNIVDDWQGVREDIKVRNLRNFYQVEPEFAERVAAGTGINLAEHVTDLK

SEQ ID NO: 3759 - protein, 308 aa, Neurospora crassa
MADHTEVDLDSIIDRLLEVRGSRPGKQVQLLEAEIRYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTECFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKFGRR

SEQ ID NO: 3760 - protein, 547 aa, Actinobacillus pleuropneumoniae
MAAKDVKFGNDARVKMLKGVNVLADAVKVTLGPKGRNVVLDKAYGAPTITKDGVSVAREIELEDKFENMGAQMVKEVASKANDAAGDGTTTATVLAQAIVNEGLKAVAAGMNPMDLKRGIDKAVVAVVEELKAISKPCETSKEIEQVGTISANSDETVGKLIAQAMEKVGKEGVITVEDGTGLDDALDVVEGMQFDRGYLSPYFINKPEAGTVELENPYIILVDKKISNIREILPVLEAVAKAGKPLLIVAEDIEGEALATLVVNTMRGIVKVAAVKAPGFGDRRKAMLQDIAILTAGTVISEEIGMELEKATLEELGQAKRVVITKDNTTIIDGIGDEAQIKARVAQIRQQIEDSTSDYDKEKLQERVAKLACGVAVIKVGAATEVAMKEKKDRVDDALHATRAAVEEGIVPGGGVALVRAASKVAATLTGDNEEQNVGIKLALRAMEAPLRQIVTNAGEEASVVARNVKDGNGNYGYNAGTEQYGDMLEMGILDPTKVTRSALQFAASIAGLMITTECMITDLPKEEKLDPAAAMGGMGGMGGMI

SEQ ID NO: 3761 - protein, 488 aa, Listeria seeligeri
MTDRRNLTTNQGVPIGDNQNSMTAGLKGPTLLEDYVLIEKLAHFDRERVPERVVHARGAGAHGKFVTKKSMKKYTKAQFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMITYLFSDEGTPASYREIRGSSVHAFKWINAEDKTVYVKLRWVPKAGIVNLSTDQAAQIQAKEFNHASRDLYEAIENGDYPEWDLYVQVLDPKDLDNFDFNPLDATKDWFEDVFPYEHVGTMTLNRNPDNIFAETESVGFNPGVLVPGMLPSEDRLLQGRLFSYSDTQRHRVGPNYLQLPINSPKTPVANNQRDGQMPFKQQTSSINYEPNSYDTEPKENPAYIEPEQEIRGDISGRLVAEKPNNFGHAKEVWNRYSDAERAALVKNIVDDWEGVREDIKVRNLRNFYQVEPEFAERVAAGTGINLAEHVTDLK

SEQ ID NO: 3762 - protein, 299 aa, Arabidopsis thaliana
MGDKNKDDSSSQSKAVRKEKRAFLFRKWTRVDVMRVSAVGAVHLLCLLAPFNYTWEAFRFAAMVGISTNLSITFSYHRNLTHRSFKLPKWLEYPFAYSALFALQGHPIDWVSTHRFHHQFTDSDRDPHSPIEGFWFSHVFWIFDTSYIREKCGGRDNVMDLKQQWFYRFLQNTIGLHILTFWILVYLWGGLPYLTWSVGVGGAIGYHATWLINSACHIWGSRAWNTKDTSRNIWWLGPFTMGESWHNNHHAFEASARHGLEWYQVDLTWYLIWFFQVLGLATDVKLPTDAQKRKMSLAR

SEQ ID NO: 3763 - protein, 365 aa, Cryptococcus neoformans
MQPGPSKDILRFTGHRHLRQRILLSILSGKSMRIDGIRSDDVHVGLRDYEVNLLRLVEKVTNGSTIEISVTGTSFILHPGLLPGGSFNHSCHIGRSIGYYLEVLLPLAPFCKKPFNITLYGVTGEEGRDMTVDMIRTVTLPHLHLFGISDGLELQIKKRGSAPLGGGQIFFKCPVVRQLNTLHFVDKGKIKKIRGVSYSTRVSPQFANRMVESARSVLNRYVPDVYLYTDVYKGDDSGKSPGYGLTLVTQSTTSAVHAAESLSVAGEVTTPEDVALFASRLLLEELSRGGCIDSKHQWLVALLMALGKEDVSKCLFGSLTPYTVQFFRDMFTFFGTKYKISEESSGEVLVSCIGIGYSNVNKSMA

SEQ ID NO: 3764 - protein, 234 aa, Hyacinthus orientalis
MGRGKIEIKRIENTTNRQVTFCKRRNGLLKKAYELSVLCDAEVALIVFSTRGRLYEYSNNSIKSTIERDKKACADSSSSSAVIEVNTQRYYQQEASKLRQQIQILQNANRHLMGESLDPLNVKELKQLETRLERGITRVRSKKHELLFAELEYMQKREVELQTDNMYLRAKIGENERAHQASVVQAGTEFDALPTFDSRNYYQVHMLQAASHYSHHQDQTALHLGYETKADPSA

SEQ ID NO: 3765 - protein, 495 aa, Ustilago maydis
MTARRYTQGVRCSTGDAVDGRVRGRDKKGKAKQMSAEDAVGLQGQMRRPVSSMSGLAWRPTGVVRTASMWSKRRCLVDARWTGWLLSHGVHTFTGAMNAARTSSARSSSVSSTGPSTSPTAPVAPASSSPYSPATPASLAGLGTTQLSPDIMLRCTIFDSTGSATSTSGVFKKSRLCSDHGLEPRDLRKIDSRVPNLVPTILVRRGGILVNILHIRAMIKKDKVLLFDSYGSTDSQLHSAFVYNLQHNLRPPHQNAHQHTSTSSSPGALAYEFRALESILVSVLDALRIELGVVRGWTSEVLEQLDDDVDRDKLRTLLQVSRKLNAFLSRSKAVKNAVVEVLENDEDMQLMHLSSIPPSASTDKGCASSNDAHTSSANTSSSCDATASNDGSQAMDELELLLESFDKQVEEVVAETTQLHSDMTNTQEVVELILDNNRNKLLALDLKTSIATMGISAGTLWAGLFGMNLKSHMEELDWAFAGTRKVAQGGLGHEG

SEQ ID NO: 3766 - protein, 745 aa, Unknown
  Shewanella sp. MR-7
MMTQAQTYFYDGSDVALLNGQYTDVFSLLGMHCINEGKALVVRCFLRNAQKVDVISLKDGRKVASLERVNEAGLFAGTLGRRVKPFLYALRVVYPLCELDIIDPYQFGSLLDSQDLYLFGEGGSEQAYRFLGANWRQVDSVEGVHFCVWAPNAKRVSVVGDFNHWDDTRHVMRQHMANGLWEIFLPDVAEGAHYKFDLVYQNGERHAKSDPMATQMECAPNNASIVPKKHQHPWADTQWMDKRATTAWHRAAMSIYEVQLGSWRRKGEFGEQYFDYQDLIEQLIPYVKEQGFTHIELMPVSEYPFDGSWGYQPVGLYAPTHRFGDANGLKAFIDACHQAEIGVLLDWVAAHFPKDPHGLVRFDGTCLYEHEDPRKGTHPDWDTLIYNYDRGEVRSFLLSNACYWLREFHLDGLRLDAVSSMLYLDYSREPGQWLPNAYGGRENLEAIHFLQMLNQRLYQAFPGICMIAEESTAFAGVTKPTDCGGLGFGFKWNMGWMNDSLSYLGRDPIYRQYHHNQLTFSLMYAYSEQFMLSISHDEVVHGKGSLLHKIPGDDWQKFATLRAYYGFMWGHPGKKLLFMGSEFAQRDEWNHNHSLDWHLLAFEPHQGVQRWLRDLNQLYRQFPALSVLDYESQGFRWLDCDNGRDSIFSFVRYGEGSDVPLVFVVNMTPTLHQGFRIGLPQGGDFCEYLNSDSHLYGGSNQGNAGKVIAEDLPWQGMASSALITVPPLGCLILGPATDAPRDTSL

SEQ ID NO: 3767 - protein, 464 aa, Lycopersicon pennellii
MARVTLFLLLLLVYGVVSEHFIVETLPGFHGKLPFTLETGYISVGEEEKVQLFYFFVQSERDPRNDPLMIWLTGGPGCSGLSSFVYEIGPLTFDYANSSGNFPKLELNSYSWTKVANIIFIDQPAGTGYSYANTSEAYNCNDTLSVTLTYDFLRKWLMDHPEYLNNPLYVGGDSYSGIFVALLTRKIYDGIEVGDRPRVNIKGYIQGNALTDRSIDFNGRVKYANHMGLISDKIYQSAKANCNGNYIDVDPNNILCLNDLQKVTRCLKNIRRAQILEPYCDLPYLMGILQETPTNGQSVFPIAGPWCREKNYIYSYVWANDKAVQKALNVREGTTLEWVRCNESMHYRGKERTESYVYDVPSVIDDHQHLTSKSCRALIYSGDHDMVVPHLSTEEWIETLKLPIADDWEPWFVDDQVAGYKVKYLQNDYEMTYATVKGAGHTAPEYKPEQCLPMVDRWFSGDPL

SEQ ID NO: 3768 - protein, 578 aa, Photobacterium profundum
MYPNDVKIEEDHNAALKVKSDGNDEFTVFTSKLNQLLEDRHFSQANIIKAKEEAEKANAAKSSFLANMSHEIRTPLNGIIGMSGILSDTELNPSQAEYLQTIETSSQTLLLLINDILDLSKIESGNLVLSPHESNLAEVVYDTITIVQAKASEQGLNLQIQLDPELPTSVMLDEHRLRQVLMNLMSNAVKFTLQGSVTLSITYTDIGDKKASLLFSIKDTGIGIEKDKQQQVFAPFTQEDGSITRQFGGTGLGLAICRQLVELLGGSIELKSEKGVGSDFYFSLDVDVVKYQPKIISNFENKKCLLLSNQSSNAELIEIECKKWGLNVTISDIETAAVSGISQQYDLILYCQKTLNRTIKDIELFNRIQERPALVICSQLQDEQFDFGHTIDGLTILPLLGQRFVKAINSAFTNVLKNSEIQTKSALNPDSRLIDIKPVSINTTPVITESQDVILIVEDNIVNQKVASLLLKKAGYQIVVANNGQEAVDLITQKEPTLFKAILMDCMMPIMDGFAATEAIRLWEKEQHTDRLPIIALTASVLDEDISKCYEAGMDDYVAKPFRKEHLLDKLERLNEVA

SEQ ID NO: 3769 - protein, 355 aa, Rhodospirillum rubrum
MLATDRTTLAQFLVEECRGRAGDDSELLGLLLDVAQACKTISKMTAMGSLAGVHGYNGDVNPQGENQARLDLMSNQAFVRATERTGHAAGLASEEMEEVLGFPESYARGTLLLVFDPLDGSSNIDINGTVGSIFSILPMPRPGEAPQTADFLQSGRQQVAAGYALYGPSTMFVLTIGSGVHGFTLDPLLGDFILTHPSMTVIPESGEFAINSSNSRFWEPPIRAYVDELLAGRSGPRSKDYNMRWIAALVADVHRILLRGGIYLYPRDTKTPDLAGRLRLLYEAAPVAFLMEQAGGRCTTGTRTMLDLVPGSLHERVPLIFGSAVEVERVETLYREPQRREFATPLFNQRGLFRD

SEQ ID NO: 3770 - protein, 134 aa, Zea mays
MRKHRIVSLVSALLILLALAVSSTRNAQEDSMANNTGTLVGGIQDVPGSENDLHLQELARFAVDEHNKKANALLGFEKLVKAKTQVVAGTMYYLTIEVKDGEVKKLYEAKVWEKPWENLKGLQEFKPVEEGASA

SEQ ID NO: 3771 - protein, 436 aa, Photorhabdus temperata
MHLQNTWREEYIKCQTLYARHPLFTKIKVRLSMLAVKKSSKLDNVCYDIRGPVLKEAKRLEEEGNKVLKLNIGNPAPFGFEAPDEILVDVIRNLPTAQGYSDSKGLYSARKAIMQHYQARNMLDVSVEDIYIGNGVSELIVQAMQALLNTGDEMLVPAPDYPLWTAAVSLSSGKAVHYMCDEGSDWFPDLDDIRNKITPRTRGIVIINPNNPTGAVYSKALLLEIVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHFRIVTLPRLDELEMAIQKFARFIGKYHQ

SEQ ID NO: 3772 - protein, 495 aa, Pyrus pyrifolia
MASSASENRLLLSKIATNEKHGENSPYFDGWNKYNQNPFHLTENPEGVIQMGLAENQLSFDLVEEWIRKNPKASICTAEGIEKFRNVANFQDYHGLPEFRQAIATFMSKARGGRVTFDPHRVVMSGGATGANELVMFCLADRGDAFLIPSPYYPAFYRDLGWRTGVQIVPVDCDSSNNFKITKEALEAAYEKAQNNNINVKGLIITNPSNPLGTTLDKDTLESLVTFINQKNIHLVCDEIYAATVFSSPKFTCITEVIQNMNCNPNLIHIVYSLSKDMGFPGLRVGIVYSYNDDVVNIGRKMSSFGLVSSQTQHMLASMLSDEDFVEKFLTTSAKRLAKRHGVFTDGLEEVGINCLKSNAGLFCWMDLRRLLKDQTFDGEMVLWRVIVNEVKLNVSPGSSFKCVEPGWFRVCFANMDDDTVEVALKRIRAFVGQGKKAQEQAQVKSPKKRWQSNLRLSFSSSSRRFEQEGVSVMSPRMMSPHSPMPHSPLLRATT

SEQ ID NO: 3773 - protein, 280 aa, Glycine max
MEGSTTSSELPPGFRFHPTDEELIVYYLCNQATSKPCPASIIPEVDLYKFDPWELPDKTEFGENEWYFFSPRDRKYPNGVRPNRATVSGYWKATGTDKAIYSGSKHVGVKKSLVFYKGRPPKGAKTDWIMHEYRLAESKIPSSRKIGSMRLDDWVLCRIYKKKSMVKALEHKEAQPKVQIANLAAANQDVEQKMMNLPRTWSLAYLLDMNYLGPILSDGSYCPTLDFQINNANIEFDPFVKSQPVEMNYNYEADSGKYQVKQSSTIDQPIYVKQMYDLLG

SEQ ID NO: 3774 - protein, 424 aa, Xylella fastidiosa
MSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVADKVVPLKSRSAAA

SEQ ID NO: 3775 - protein, 498 aa, Cryptococcus neoformans
MGQGQSSKKLGRISSKQLPPPDLADSFARTSIADRDPNPPPPDAAKRRSSARDPLPPAHASPPSHAPAHSSGPARQNTPPSPAAVPTTQNIIAAPSQPSKSFLASSPPPPSAMPVSPAGTTRARSSSPPPSSSPAAASHLSRDSASSLSPGFALTQTVSRGSLGAGGAGFQILDVDNMIQRLLEAGYSGKVTKSPPLKNAEITSVCAAAREVFLSQPTLIELSPPVKIVGDVHGQYADLLRMFEMCGFPPAANYLFLGDYVDRGKQSLETILLLLCYKIKYPENFFLLRGNHECANVTRVYGFYDECKRRTNIKIWKTFIDVFNTLPIASIVASKIFCVHGGLSPSLKSMDDIRRIQRPTDVPDYGLLNDLVWSDPSDTALDWEDNERGVSFCYGKSVINAFLATHDMDLICRAHMVVEDGYEFYNDRTLVTVFSAPNYCGEFDNFGAVMSVSEDLLCSFELLKPLDGAALKKEMTKSKRKSLQAHQSPPNNPMAQSF

SEQ ID NO: 3776 - protein, 492 aa, Ipomoea batatas
MDPSKYRPSSSFNTPFCTTNSGAPVWNNTCALTVGSRGPILLEDYHLVEKIQNFTRERIPERVVHARGASAKGFFEVTHDITHLTCADFLRAPGVQTPLIVRFSTVIHERGSPETIRDPRGFAVKMYTRGGNWDLVGNNFPVFFIRDGTQFPDVIHAFKPNPKSHIQENWRILDYLSHLPESLNTFAWFYDDVGIPTDYRHMEGFGVHTFTMINKEGKANYVKFHWKPTCGVKCLLEEEAIRIGGENHSHATQDLYESIAAGNYPEWKLYIQVMDPDHEDRFDFDPLDTTKIWPEELIPLQPVGRMVLNKNIDNFFAENEMLAMDPAHIVPGIYFSDDKMLQARVFAYADTHRHRLGPNYMLLPVNAPKCAHHNNSYDGYMNFVHRDEEVDYFPSKFDNTRNAERFPTPLRIVTGQRDKCVIEKENNFKQPGDRYRSWAPDRQDRFINRWVKALSEPRVTHEIRSTWISYLTQADRSLGQKVASRLNIRPTM

SEQ ID NO: 3777 - protein, 149 aa, Clostridium thermocellum
MFGIVPFGRRGMGVSRRGRDLFDIDSFFDDFFDDRFFPAFYGGNQIKVDIRENDKEYILEADIPGVDKENITVEVNGDVLTISAKWDEQTEIKKENYLRRERRASSMSRSFTLENVDSDRITAKHENGVLTLILPKKEPRSRGRRINIS

SEQ ID NO: 3778 - protein, 139 aa, Brassica napus
  misc_feature (128)..(128): Xaa can be any naturally occurring amino acid
MTDAHTARTIVGIIGNVISFGLFCSPIPTMIKIWKMKSVSEFKPDPYLATVLNCMMWSFYGLPFVHPDSLLVVTINGTGLFMELVYVTIFFIFATSAIRRKITIAMVVEMIFMAVVIFCTLYFLHTTXQRSMLIGIMCI

SEQ ID NO: 3779 - protein, 134 aa, Candida albicans
MLEFGVSFTAGGIFFFVFGIMTFFDSALLALGNVLFIIGITLIIGPQRTIAFFSRPTKLRGTICFILGILLILLKYAFIGFILESFGILGLFGDFFGTIVQFLRSIPYIGDVLSHPLIAPTIDRLAGISNTLPV

SEQ ID NO: 3780 - protein, 532 aa, Enterococcus avium
MAKDIKFSEDARAAMLRGVDKLADTVKVTLGPKGRNVVLEKSYGSPLITNDGVTIAKDIELDDHFENMGAKLVSEVASKTNDIAGDGTTTATVLTQAIVREGLKNVTAGANPMGIRRGIELATKAAVEELHSISKVVDSKDAIAQVAAVSSGSEEVGKLIAEAMEKVGNDGVITIEESKGIDTELDVVEGMQFDRGYLSQYMVTDNDKMEAALENPYILITDKKISNIQDILPLLEQVLQQSRSLLIIADDVDGEALPTLVLNKIRGTVNVVAVKAPGFGDRRKAMLEDIAILTGATVITEDLGLDLKEATIENLGTAGKVVVDKDNTTIVEGSGDKAALNDRVEMIKRQIGETTSDFDREKLQERLAKLAGGVAVVKVGAATETELKELKLRIEDALNSTRAAVEEGIVSGGGTALVNVIKKVSELEAEGDAATGIKIVVRALEEPVRQIAENAGFEGSVVIDKLKNADQGTGFNAASGEYVNMIDAGIVDPTKVTRSALQNAASVSALLLTTEAVVADKPVEGGAAAAPA

SEQ ID NO: 3781 - protein, 209 aa, Bacillus cereus
MKWIQMPLGPLQTNAYILTNDQNECIIFDPGHEGEKLVTYLQEEQLKPLAVLLTHAHFDHIGAVDAVRDAFHIPVYVHKEEEDWLGDATVNGSQIFMMNRSITAKPADHIIDAEGTLAIGSFNFEVFETPGHSPGSISYYCKEASAVFSGDVLFQMSIGRTDLPGGSFAELIGSIEEKLFVLPDETAVLCGHGPETSIGFEKENNPFLQ

SEQ ID NO: 3782 - protein, 436 aa, Prochlorococcus marinus
MLSSVKSLTKPLQRLFAVLISFGILFQVFTQPAFALNDGQLLVIEAWNQVNAGYLDPKKFDEIQWKKLRQKALEKPINNSQQAYSAIEAMLLPLGDPYTRLLRPVDYEAMKKSNIGSEINGVGLQLGARKEDGDIVVISPLEGSPASDAGITSGTIIKKVNGQSPKQLGLEATAAKLRGQTGTQVIVELEQPDNEIKEISLERRSVDLRPVRTKRIRNESHTFGYLRITQFSEGVPEQVKEALEELSGKDIDGLILDLRNNSGGLVSSGLAVADDFLSDMPIVETKKRDSINDPISSGLETIYDGPMVTLVNEGTASASEILAGALQDNKRSELIGNKTFGKGLIQSLTNLSDGSGLAVTVASYLTPSGRDIQNLGIDPDRLLEMPEPLNPGSDEDRWLLDAELIMQATLDKEEVSEKLSKETLVKEEQLISQEIE

SEQ ID NO: 3783 - protein, 531 aa, Enterococcus casseliflavus
MAKEIKFAEDARAAMLRGVDKLADTVKVTLGPKGRNVVLEKSYGSPLITNDGVTIAKEIELEDHFENMGAKLVSEVASKTNDIAGDGTTTATLLTQAIVREGLKNVTAGANPLGIRRGIEMATKVAVEELHNISSIVDSKEAIAQVGAVSSGSEKVGQYIADAMEKVGNDGVITIEESKGIETELDVVEGMQFDRGYLSQYMVTDNDKMEAALENPYILITDKKISNIQDILPLLEQILQQSKPLLIIADDVDGEALPTLVLNKIRGTFNVVAVKAPGFGDRRKAMLEDIAILTGGTVITEDLGLELKDATIDNLGQASKVVVDKDNTTIVEGAGEKEAIDARVQLIKNQIADTTSDFDREKLQERLAKLAGGVAVIKVGAPTETELKELKLRIEDALNATRAAVEEGMVSGGGTALVNVINKVAEIETDGDAATGVKIVLRALEEPVRQIAENADYEGSVIIDKLKNADLGVGFNAATGEWVNMLEAGIVDPTKVTRSALQNAASVAALLLTTEAVVADKPEPAAPAAPA

SEQ ID NO: 3784 - protein, 917 aa, Pseudomonas syringae
MLTKLGIKGRVLLLTILPASLMAAMLGGYFTWMQLSELQSQLLQRGEMIAQDLAPLAANALGRKDKVLLSRIATQTLEQTDVRAVSFLDTDRTVLAHAGPTMISPSPIGSGSQLLSSTGTDATRYLLPVFGSQRHLTSPIIPAEADTLLGWVELEISHNGTLLRGYRSLFASLLLILTGLAFTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSRAPRVLCVDDNPANLLLVQTLLEDMGAEVVAVEGGYAAVNAVQQEAFDLVLMDVQMPGMDGRQATEAIRAWEAERNQSSLPIVALTAHAMANEKRSLLQSGMDDYLTKPISERQLAQVVLKWTGLALRNPAPERQNEALEVHVGPLVLDHEEGLRLAAGKADLAADMLAMLLASLDADREAIRVARANQDVHALIERIHRLHGATRYCGVPQLRSACQRAETLLKQNAPHTEEALNDLDKAIIRLEAEARVMA

SEQ ID NO: 3785 - protein, 552 aa, Mesorhizobium loti
MAAKDVKFSRDARERMLRGVNILADAVKVTLGPKGRNVVIDKSFGAPRITKDGVTVAKEIELEDKFENMGAQMVREVASKTNDIAGDGTTTATVLAQSIVQEGHKAVAAGMNPMDLKRGIDLAVSDVVWTLIKNATKIKTSEEVAQVGTIAGNGDESVGKMIAEAMQKVGNEGVITVEEAKTAETELEVVEGMQFDRGYLSPYFVTNADKMVADLEDAYILLHEKKLSNLQAMLPVLEAVVQTSKPLLIISEDVEGEALATLVVNKLRGGLKIAAVKAPGFGDRRKAMLEDIAILTGGQVISEDLGIKLENVGLDMLGRAKKVSISKENTTIVDGAGKKEEIQGRVAQIKQQIEETTSDYDKEKLQERLAKLAGGVAVIRVGGATEVEVKEKKDRVDDALNATRAAVEEGIVPGGGVALLRASLSINAVGANSDQTAGISIVRRALQAPARQIAANAGAEASIVAGKILENKGATFGFNAQTGEYGDMIAMGIVDPVKVVRTALQDAASVAGLLVTTEAMIAEAPKKESAGGGGMPGGMGGGGMGGMGGMDF

SEQ ID NO: 3786 - protein, 396 aa, Leuconostoc mesenteroides
MEKRKFLSRFKFDNGLVIKNHIVMSPMTTMTSFYNGMITTDELNYYAARAGGPGIIITGVANVSDNGKGFEGELSVAHDAMLPGLIKLAKVIHKDGTKAILQIFHAGRKANSAILRGERPVSASAIAASYPADSETPRALNDSEVHQIITEFGEATRRAIEAGFDGVELHGANTYLLQQFYSENSNQRSDEWGGSRGKRLKFPLAVIETVNKTVKKYSKKPFIVGYRISPEEIEEPGIRLEDSLFFVDQIKHKVDYIHLSMGSYKRTSLNNKANKETLISQFSQHTKNIVPLIGIGSVETPDDVNAVMSDGADLVAIGREFIREPQWVQKIERNDLESIRTLISPSDMAELAIPSVMQVYLRESFYSVMHFTDDIETQSDYQNALAPMEGLEKKLS

SEQ ID NO: 3787 - protein, 917 aa, Pseudomonas putida
MLDRLGIRSRVLLLALLPAGLMALVLGSYFTWLQQNDLRTQLLQRGKMIAEQLAPLAAPAMARLAPAQLERIAAQTLEQADVRAVAFLAPDRTRLAHAGPSMLNLPPSGGTGTQLLQRSGNDATRYLMPVFGHHRDLATDAVPAEAERLLGWVEIELSHDGTLLRGYRNLFTSLLLILACLALSGLLALRMSRTINDPIERIKHAVNQLKDGHLEERLPTMGSHELDELAHGINRMAETLQNAHEELQHSIDQATEDVRQNLETIEIQNIELDMARKEALEASRIKSEFLANMSHEIRTPLNGILGFTHLLQKSEMTPRQLDYLNTIEKSADNLLGIINEILDFSKIEAGKLVLDSIPFNLRDLIQDTLTILAPAAHAKQLELLSLIYRDTPASLVGDPLRLKQILTNLVSNAIKFTREGTIVVRAMLEDEHEDCAQLRISVQDTGIGLSPQDVRTLFQAFSQADNSLARQPGGTGLGLVISKRLIEQMGGEIGVDSTPGEGSQFWISLNLPKAHDDAEALPPQPLLGRRAAIVDGHELARQALEHQLEDCGLSVSLFASYDQLLQGVQAASQAGLPFEFAVLGANLGNLSPEQLGHYHQQLERYHCQCVVLCPTTEQALYHPYLPNGHGQLLSKPTCTRKLRRLLLELVQPRRPLAEGSNPNGQRRPKILCVDDNAANLLLVKTLLEDLGAEVLAVNNGYAAVQAVQEELFDLVLMDVQMPGMDGRACTEQIRLWENTQSGNPLPIVALTAHAMANEKRALLHSGMDDYLTKPISERQLAQVVMKWTGLSLGTPQQAQAELLTNGDELKVLDPEEGLRLAAGKADLAADMLSMLLASLDTDREAIRAARAADDRNGLIEQVHRLNGASRYCGVPQLRAACQRSETLLKQDNPQAQQALDELDSAISRLAAQARLSA

SEQ ID NO: 3788 - protein, 644 aa, Propionibacterium acnes
MAHDEFGGLTGWDLEGFHSGGDTEVWKRLGSHVVTIDDDERGPITGTRFAVWAPNAQAVEVISDFNWWTGDRMRLIPGSGVWGTFVEGVDEGTLYKFRIQDQWGTWHEKVDPMARYSEQAPQNASIVTETHYEWNDDEWIARREASRAHAEPMSVYEVHLGGWRHGLSYRELADQLVSYVTWQGYTHVEFMPLAEHPFAPSWGYQVTGYFSPTSRYGSPDDLRYLIDKLHQAGIGVIMDWVPGHFPKDDWALGRFDGTALYEHADPRQGEHKDWGTYIFNYGRNEVKSFLVSSALYWISEFHADGLRVDAVASMLYLDYSREEGQWVPNKYGGRENLEAIDFLRYVNSHLYSRHPGILMIAEESTSFPGVTKPVDDGGLGFGFKWNMGWMNDSLRYLELNPFHRQYHHGEMTFAMVYQYSENFILPISHDEVVHGKGSMITKIPGDDWQQFASLRAFYSYMWSFPGKQLVFMGQEFGQRHEFDESVSLEWFVADLWGHGGLKRLFRDLNKIYKENPALWQLDSDPRGFEWINADDAGNNLFSWLRRSDDGSTIACFTNFSPNPQTDYRIDLPMEGVWTEILNTDSLEYDGTGEFGNLGQIVAAPLPAPDRLRAVATVCVPPMGSVWLRHNPSATAALPGDPGVQ

SEQ ID NO: 3789 - protein, 500 aa, Unknown
  Petunia x hybrida
MVLSKTVSQSDVSIHSTFASRYVRTSLPRFKMPDNSIPKEAAYQIINDELMLDGNPRLNLASFVTTWMEPECDKLMMDSINKNYVDMDEYPVTTELQNRCVNMIAHLFNAPLEDGETAVGVGTVGSSEAIMLAGLAFKRKWQNKMKAQGKPCDKPNIVTGANVQVCWEKFARYFEVELKEVKLSEGYYVMDPEKAVEMVDENTICVAAILGSTLNGEFEDVKRLNDLLVEKNKETGWDTPIHVDAASGGFIAPFIYPELEWDFRLPLVKSINVSGHKYGLVYAGIGWVVWRNKDDLPDELIFHINYLGADQPTFTLNFSKGSSQVIAQYYQLIRLGYEGYKNVMENCQENASVLREGLEKTGRFNIISKEIGVPLVAFSLKDNRQHNEFEISETLRRFGWIVPAYTMPPNAQHITVLRVVIREDFSRTLAERLVRDIEKVLHELDTLPARVNAKLAVAEEQAAANGSEVHKKTDSEVQLEMITAWKKFVEEKKKKTNRVC

SEQ ID NO: 3790 - protein, 313 aa, Arabidopsis thaliana
MKQIGGQLCVWPGLRQLCLRKSLLYGVMWLLSMPLKTLRGARKTLKITHFCSISNMPSSLKIELVPCSKDNYAYLLHDEDTGTVGVVDPSEAAPVIEALSRKNWNLTYILNTHHHDDHIGGNAELKERYGAKVIGSAVDKDRIPGIDILLKDSDKWMFAGHEVRILDTPGHTQGHISFYFPGSATIFTGDLIYSLSCGTLSEGTPEQMLSSLQKIVSLPDDTNIYCGRENTAGNLKFALSVEPKNETLQSYATRVAHLRSQGLPSIPTTVKVEKACNPFLRISSKDIRKSLSIPDSATEAEALRRIQRARDRF

SEQ ID NO: 3791 - protein, 544 aa, Propionibacterium acnes
MAKLIEFNIEARRGLEAGMNTLADAVKVTLGPKGRNVVLEKSWGAPTITNDGVSIAKEIELDDPYEKIGAELVKEVAKKTDDVAGDGTTTATVLAQAMVREGLRNVTAGANPMGLKKGIEAAVQAVSARLSDMAIDIETKDQIASTASISAADPTVGEIIAEAMDKVGKEGVITVEESNTFGLELELTEGMRFDKGYISPYFVTDTERMEAVLEDPYILIVNSKISSLKDLLPVLEKVMQSGKPLFVIAEDVEGEALAGLIVNKIRGTFKSVAVKAPGFGDRRKAMLNDIAILTGGQVISEEVGLSLDAVTLDLLGRARQVVVTKDEATIVDGAGDSEQIAGRVSQIRKEIENSDSDYDREKLQERLAKLAGGVAVIKVGAATEVELKERKHRIEDAVRNAKAAVEEGIIPGGGVALLQASKAAEIEGLEGDELTGAQIVLAACTAPLKQIAINAGLEGGVVAEKVAGLPAGQGLNAANDEYVDMVEAGIIDPAKVTRSALQNAASIAALFLTTEAVIADKPEPVKAPAGGGDMDGMGGMGGMM

SEQ ID NO: 3792 - protein, 330 aa, Kluyveromyces lactis
MLHPLSTEIYFTFNNGNKVPAFGLGTAAQHERVAETKQAVKAAIKAGYRHIDTAWAYGVEEYVGEALQELFEERVVKREDLHITSKVWHTMWNDVDKSLNESLARLKVDYVDLFLQHWPLCTQKVPDPHGVDKIAKEPVDDQGNPLYDEKGDWIETYKQIEKIYLDKNDKRVRAIGVSNFPIEYLKRVLKECRTVPACNQVELHPHLPQRELCEFCSEHKILVTAYSPLGGNGAPLLELPILKGLCEKYNASPNDILTSYHLRQGTIVIPRSLNSTRIASNLEFVPLSEEDVNKLNEFGQKNKKRYINGAVSSVIPGFKEDFLKEQLQQS

SEQ ID NO: 3793 - protein, 633 aa, Diospyros kaki
MESCDCIETQWPTDELLVKYQYISDFFIAFAYFSIPLELIYFVQKSSFFPYRWVLMQFGAFIVLCGATHFINLWTFSMHSKTVAVVMTIAKIATAVVSCATALMLVHIIPDLLSVKTRELFLKNKAEELDREMGLIMSQEETGRHVRMLTHEIRSTLDRHTILRTTLVELGRTLDLEECALWMPTRRGQTLELSHTLKNLIPLGSSVAINLPIVNDVFKSAQAIRIPHTCPLARIRPPVGRYVPPEVVAVRVPLLHLSNFQINDWPDLSPKSYAVMVLILPMDGIRKWRDHELELVEVVADQVAVALSHAAILEDSMRARDQLMEQNVALDNARQEAETAIRARNDFLAVMNHEMRTPMHAIISLSTLLLETELTPEQRVMIETILKSSNLLATLINDVLDLSRLEDGSLELDTGIFNLHEVLKQAVGLIKPIASVKKLSMTLLLAPELPVYAVGDEKRLIQTILNIAGNAVKFTKEGYVSVVASTAKPESLRDWRPPEFYPMPSDGHFFLRVQVKDSGCGISPQDIPQIFTKFAQSQSGSNRNTSGAGLGLGLPICKRFINLMGGHIWIESEGLDKGTTVTFIVKLGICDGDGPTESRAQQAPLPSRENKGSADLIGHKPFAKELPRYQRTF

SEQ ID NO: 3794 - protein, 586 aa, Medicago sativa
MCGILAVLGCSDDSQAKRVRILELSRRLKHRGPDWSGLHQHGDNYLAHQRLAIVDPASGDQPLFNEDKSIIVTVNGEIYNHEDLRKQLPNHKFRTQCDCDVIAHLYEEYGENFVDMLDGIFSFVLLDTRDNSFIVARDAIGVTSLYIGWGLDGSVWIASELKGLNDECEHFEVFPPGHLYSSKDREFRRWYNPPWFNEAVIPTTPYDPLVLRNAFEKAVIKRLMTDVPFGVLLSGGLDSSLVAAVTARYLAGTKAAKQWGAKLHSFCVGLKGAPDLKAGREVADFLGTVHHEFQFTIQDGIDAIEDVIYHTETYDVTTIRAATPMFLMSRKIKSSGVKWVISGEGSDEIFGGYLYFHKAPNKEEFHQETCRKIKALHRYDCLRANKSTYAWGLEARVPFLDKDFIKVAMDIDPEYKMIKHEEGRIEKWILRKAFDDEENPYLPKHILYRQKEQFSDGVGYGWIDGIKDHAAKHVTDRMMLNASHIFPFNTPLTKEAYYYRMIFERFFPQNSARLTVPGGASVACSTEKAIEWDASWSSNLDPSGRAAFGVHNSAYENQVNSVAKTVEPEKIIPKMEISNLGVAIQS

SEQ ID NO: 3795 - protein, 464 aa, Thermoanaerobacter tengcongensis
MSKEYRFPEGFWWGSATSAVQIEGAADEDGKGMNVWDYWYQKEPNRFFNGIGSQVTSDFYHRYKEDIKLMKELGHNSFRFSISWSRLIPGGTGKVNEKAVEFYNNVINELLENGIEPFATLFHFDMPIEMQNIGGFENRKVVEYFAEYAKTCFELFGDRVKRWITFNEPIVPVLGGYLYNFHYPDIVDFKRAVQFGYGTVLASARAIEEFKKLKINDAKIGIVLNLSPVYPRSNHPADLKAAELADLFHNRSFLDPSVKGEYPKELVEVLKAYNHLPEYKEEDLELIKDNTVQYLGVNYYQPLRVKAKENMPNPYGVFTPNWFYDEYIMPGRRMNPYRGWEIYEKGIYDLLKRIKDEYGNIECFISENGMGVEGEERFIKDGIIQDDYRIEFIKEHLKWVHKAIEEGCNVKGYHVWTFMDNWSWLNAYKNRYGLVAIDLKTQKRTIKKSGYWFKEVAENNGFVD

SEQ ID NO: 3796 - protein, 468 aa, Corynebacterium glutamicum
MNDPQRSPTLLWFRDDLRLSDNAALKWAADHGPVIGLFIDETINRSIGAAARWWREQSLNALAQDLSFYGVPLLRRTGNPLEILPKIVSEMEVKAVTWNRRYHQPLCEVDATLKKNLRDKGIEVHSHPGFLLTEPWEVSTATGTPYKVFTPFSKAAWEVARVHAYETVKNNVPVPSHLTGPEDVELPILEMEQPFWSTTLVKECAPGEKNASEKLFDFLEHLQDYPQARDSLARSATSKLSAHLRFGEISIHRVWAETAAIDSEGTELFLKELLWRDFAWHRLYALPHMDTQNVRMQFNRFGWSWDPSEKDKLNTPSTPLIPTKADQFHEDLAAWRAGKTGIPLVDAGMRELWATGSMHNRVRMVVASFLTKNLQIHWRHGEEWFWETLVDADPASNAFNWQWAAGSGDDASPYFRIFNPVTQAKKFDPDETYIRRWVPEYGTPSYPDPIVDLKESRQIALDAYSAIK

SEQ ID NO: 3797 - protein, 171 aa, Triticum aestivum
ALAQAKLLEQEREIRQQLIEQNKALMTATKAAEDANRAKSDFLATMSHEIRTPMNAVIGMTGLLLDTHLNTQQQQFTETIRSSGEALLSLINDILDFSKIESGQFKLEIHPFEIQQCVEECLDLVAPQAFAKKLDLVYQIEPQVPMAILGDLTRVRQVLVNILANAVKFTT

SEQ ID NO: 3798 - protein, 438 aa, Oryza sativa
MSTTKVKRRVGKYELGRTIGEGTFAKVKFARDTETGDPVAIKILDKEKVLKHKMVEQIKREISTMKLIKHPNVVRIYEVMGSKTKIYIVLEYVTGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRVTIPEILEDEWFKKGYKRPEFDEKYDTTLDDVYAVFNDSEEHHVTEKKEEPEALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSRTLKDVVWKSDDLQNQLS

SEQ ID NO: 3799 - protein, 550 aa, Yersinia enterocolitica
  misc_feature (3)..(3): Xaa can be any naturally occurring amino acid
  misc_feature (377)..(377): Xaa can be any naturally occurring amino acid
  misc_feature (383)..(383): Xaa can be any naturally occurring amino acid
  misc_feature (510)..(510): Xaa can be any naturally occurring amino acid
  misc_feature (530)..(530): Xaa can be any naturally occurring amino acid
  misc_feature (543)..(543): Xaa can be any naturally occurring amino acid
MPXKDVKFGNDARIKMLRGVNILADAVKVTLGPKGRNVVLDKSFGSPTITKDGVSVAREIELEDKFENMGAQMVKEVASKANDAAGDGTTTATVLAQSIITEGLKAVAAGMNPMDLKRGIDKAVIAAVEELKKLSVPCSDSKAIAQVGTISANSDSTVGELIAQAMEKVGKEGVITVEEGSGLQDELDVVEGMQFDRGYLSPYFINKPETGSIELESPFILLADKKISNIREMLPVLEAVAKAGKPLLIIAEDVEGEALATLVVNTMRGIVKVAAVKAPGFGDRRKAMLQDIATLTAGTVISEEIGLELEKTTLEDLGQAKRVVINKDTTIIIDGVGDEAAIQGRVAQIRQQIEDATSDYDKEKLQERVAKLAGGVXVIKVGXATEVEMKEKKARVEDALHATRAAVEEGVVAGGGVALIRAASAITAAGLKGDNEDQNVGIKVALRAMESPLRQIVVNAGEEASVIANNVKAGSGSYGYNAYSEEYGDMIAMGILDPTKVTRSALQYAXSIAGLMITTECMITDLPRDXKGADMGAGGMGGXGGMGGMM

SEQ ID NO: 3800 - protein, 500 aa, Triticum aestivum
  misc_feature (442)..(442): Xaa can be any naturally occurring amino acid
  misc_feature (452)..(452): Xaa can be any naturally occurring amino acid
  misc_feature (468)..(468): Xaa can be any naturally occurring amino acid
MAAAVSTVGAINRAPLSLNGSGAGAASVPATTFLGKKVVTASRFAQNNKKSNGSFKVVAVKEDKQTDGDRWRGLAYDISDDQQDITRGKGMVDSVFQAPMGTGTHNAVLSSYEYLSQGLKQYNLDNMMDGLYIAPAFMDKLVVHITKNFLTLPNIKVPLILGVWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYNKEDNARVPIIVTGNDFSTLYAPLIRDGRMEKFYWAPTREDRIGVCKGIFRTDNIKDEDIVTLVDQFPGQSIDFFGALRARVYDDEVRKFVEGLGVEKISKRLVNSREGPPVFEQPEMTLEKLMEYGNMLVMEQDNVKRVQLADQYLNEAALGDANADAIGRGTFFGKSAQXVNLPVPEGCXTDPAAKNFDPTARSDXDGTCVFQLLSFLLLIIKSSVFFFFCFCVIVNW

SEQ ID NO: 3801 - protein, 660 aa, Rhodopirellula baltica
MQQKTSLRYGDCYLRAPTNAFMPEWPNWIHRLSSSSCGTRAEHVRSTRTHSPVSFPLGIESVAASGSHLCDPPINREPLGSKPPQENYIVAKQIVFDDDARGPLLAGVSKLARAVRSTLGPRGRNAVLDKGWGSPKVTKDGVTVAEDIELDDPFENLGAQLVKEAASKTNDVAGDGTTTATVLSEAIFREGLKMVATGADPMALSRGIQKAVDTAIAQIAKMATPINEKSKSDIKQVATIAGNNDPQIGDVLADAFTKVGKNGVITVEEGRSNETYVDVVEGMQFDRGFLSPHFVTNQDEVTVELDDCYILLFEEKISNNKKMIPLLEAISKAKKPLLIIAEDTEGEALATLVVNKMRGILSACAVKAPGYGDRRKAILGDIAALTGGKAIFKDLGIDLESVKVSDLGRAKQIRITSEATTIVGGAGKKADIEGRVAQIRREIEATDSDYDREKLQERLAKLAGGVAQINVGAATETEMKERKALIDDARAATQAALEEGIVPGGGTALLRCRAAVEKLEKATEGDQKLGVRIIRNVLDQPMRAIANNAGLDGAVVVNRVLQMKGKTEGYDANADKYCDLVAAGIVDPAKVVRTSLTNAASVAALLLTTESLVTEIPVEEEPAGGDHHDHGMGGGMPDMGGMGMGGMGGMGGMGGMGGMM

SEQ ID NO: 3802 - protein, 544 aa, Neisseria meningitidis
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFEKKISNIRDLLPVLEKVAKASRPLLIIAENVEGEALATLVVNNIRGILKTVAVKAPGFGDRRKAMLQDIAILTGGTVISEEVGLFLEKATLDNLGQAKRIEIGKENTTIIDGFGDAAQIEARFAEIRQQIETATSDYDKEKLQERVAKLAGGVAVIKVGAATEVEMKEKKDRLEDALHATRAAVEEGVVAGGGVALLRARAALENLHTGNADKDAGVQIVLRAVESSLRQIVANAGGEPSVVVNKVLEGKGNYGYNAGSGEYGDMIEMGVLDPAKVTRSALQHAASIAGLMLTTDCMIAEIPENKPAMPDMGGMGGMGGMM

SEQ ID NO: 3803 - protein, 354 aa, Arabidopsis thaliana
MSAESCFGSSGDQSSSKGVATHGGSYVQYNVYGNLFEVSRNAATNSETGEEVAIKKIGNAFDNIIDAKRTLREIKLLKHMDHENVIAVKDIIKPPQRENFNDVYIVYELMDTDLHQIIRSNQPLTDDHCRLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVRQLPQYPRQNFAARFPNMSAGAVDLLEKMLVFDPSRRITVDEALCHPYLAPLHDINEEPVCVRPFNFDFEQPTLTEENIKELIYRETVKFNPQDSV

SEQ ID NO: 3804 - protein, 531 aa, Enterococcus hirae
MAKELKFAEDARAAMLRGVDKLADTVKVTLGPKGRNVVLEKSYGSPLITNDGVTIAKEIELEDHFENMGAKLVSEVASKTNDIAGDGTTTATVLTQAIVREGLKNVTAGANPLGIRRGIELATKAAVEELHNISTVVDSKEAIAQVAAVSSGSEKVGHLIADAMEKVGNDGVITIEESKGIETELDVVEGMQFDRGYLSQYMVTDNDKMEAVLENPYILITDKKISNIQDILPLLEQILQQSRPLLIIADDVDGEALPTLVLNKIRGTFNVVAVKAPGFGDRRKAMLEDIAILTGGTVITDDLGLELKDATIENLGNASKVVVDKDNTTIVEGSGDKTAIEARVQLIKNQIAETTSDFDREKLQERLAKLAGGVAVVKVGAATETELKELKLRIEDALNATRAAVEEGMVSGGGTALVNVINKVSAVEAQGDVATGVKIVVGALEEPIRQIAENAGYEGSVIVDKLKNVELGTGFNAATGEWVNMVEAGIVDPTKVTRSALQNAASVSALLLTTEAVVADKPEPAAPAAPA

SEQ ID NO: 3805 - protein, 819 aa, Ustilago maydis
MPRNVLSIPLKRTPSVSSALSTAIRNYISNNYSDTHPDAFSNDLREFVRLRDQICSVEVHVSSVEPLLRYHAQLVFFSTKFPANINLSFPWSLSFPPSLPSWTNTISGAMEATKSAEAGPASGIAYATSDTVAHPDLAFERANLLFSLAALYSALGCAEPRAENESIKRATAWFQNAAGVLQNIVDHLVEPTRLLLPPSPDFNPRLLSCIRDLMLAQAQECFWQKAVMDRLKDATIAKLAAKVADYYASALQAVTEAPTQDGSSHSDPADTAKLTLPSGWENHLAVKRWHFAAAAQYRKACDDLGANRYGDELGRLQLAEQHVKSALDSAKKGVNSAITSDLESLQAIIKSNLARATRDNDLIYLEAVTPAAQLSPIQPAAMVKPVVPPEVAQPTAYLRDASAATGSKPGFGRPLFAELVPYGVHLAISIYDDRKDSLVRDSIASKRDELDAIATSTLQSLNLPGSLQALEQPMGLPPALLRKHEEVVAEGGLERLQRIAHDVARIAATDRDTLAEALALIEHEQREDESVRASFGTHSSWARQTSSEVNGDLKAQAAEYHGTLVKAAASDEIVRRKLEDWEDLIDVLGGDVAGLEAFVPSTNPNVSAVSSGARGSDEQVQAVRALREELEHLDDLLDSRSACVTEAKTLAASDDIRALVLREAASLASNVSGVAEVSGADFEELFDHELRKYARFTSDLDQSGSLQEALLQRIEQRNAAFVQARKSDATIQRREKALQNLDSAYIKYRELSSNLVEGLEFYNGLAKILSGYRDAVKEWARARQVDLHWLVHQMGRMRAEYAITTATAAAASVISSETD

SEQ ID NO: 3806 - protein, 323 aa, Unknown
  Acinetobacter sp. ADP1
MPKFFLRWIDSWSNLNHTQVSTQVYSSQPQRIQWLRIIPFIVLHIACLAVFWIGFSWFAIFFMLGFYVIRMFAITAFFHRYLSHKTFQTSRPVQFLFILIGTMSAQRGPLWWAAHHRYHHRFTDTDQDPHSSTKGFWYSHVGWFLNEENFAIRKSIIKDWLKYPELIWLDRFSLPVVLATAFAIYALGEVLAIYAPQLKTNGLQLLVWGFVVSTVLLTHATLCINSLAHRYGSKDFETDDQSRNNFFLSIITLGEGWHNNHHFYAGSTRQGFFWWQIDVTYYLLKIMSWCGLVWAIKPVPERIYTSSKKSNSLKDKKINITNI

SEQ ID NO: 3807 - protein, 497 aa, Zea mays
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVSTATAEQSGDGVVAKKSVLEIEREVAARWMNAVNKKKTGVC

SEQ ID NO: 3808 - protein, 531 aa, Enterococcus gallinarum
MAKEIKFAEDARAAMLRGVDKLADTVRVTLGPKGRNVVLEKSYGSPLITNDGVTIAKEIELEDHFENMGAKLVSEVASKTNDIAGDGTTTATLLTQAIVREGLKNVTAGANPLGIRRGIEMATKVAVEELHNISSIVDSKEAIAQVGAVSSGSEQVGKYIADAMEKVGNDGVITIEESKGIETELDVVEGMQFDRGYLSQYMVTDNDKMEAALENPYILITDKKISNIQDILPLLEQILQQSKPLLIIADDVDGEALPTLVLNKIRGTFNVVAVKAPGFGDRRKAMLEDIAILTGGTVITEDLGLELKDATIDNLGQASKVVVDKDNTTIVEGAGDKSAIDARVQLIKNQIADTTSDFDREKLQERLAKLAGGVAVIKVGAPTETELKELKLRIEDALNATRAAVEEGVVSGGGTALVNVINKVAAIEADGDAATGVKIVLRALEEPVRQIAENAGYEGSVIIDKLKHADLGVGFNAATGEWVNMLEAGIVDPTKVTRSALQNAASVAALLLTTEAVVADKPEPAAPAAPA

SEQ ID NO: 3809 - protein, 479 aa, Unknown
  Vibrio sp. Ex25
MTNKKLTTAAGCPVAHNQNVMTAGPRGPQLLQDVWFLEKLAHFDREVIPERRMHAKGSGAYGTFTVTHDITKYTRAKIFSEIGKKTELFARFTTVAGERGAADAERDIRGFALKFYTEEGNWDLVGNNTPVFFLRDPLKFPDLNHAVKRDPRTNMRSSTNNWDFWTSLPEAFHQVTIVMSDRGIPASYRHMHGFGSHTFSFINAENERYWVKFHFKTQQGIKNLTDQEAEAIVGKDRESHHRDLYEAIERQDFPKWKMYVQIMPELEADEVNFNPFDLTKVWSQKDYPLIPVGEFELNRNPENFYAEVEQSAFNPAAIVPGIGFSPDKMLQGRLFAYGDAQRYRLGVNHHQIPVNTPRCPVHSYHRDGAMRVDGNFGSTLGYEPNYKQEWAEQPDYSEPPLRINGNADHYDHRVDEDYFSQAGNLFRLMSEEQRQTLFDNTARAMDGVPDFIKERHVNHAYQADEAYGKGLEIALGLNK

SEQ ID NO: 3810 - protein, 310 aa, Glycine max
FGSRTFADFCLSLSYHHNSQSSETERDGERGGIQKQLQRWQQSGNVNVNVNVDANGELMYVKVMTDEQLETLRKQIAVYGTICEQLIEMHRTLSAQQDLAGVRLGNIYCDQLMTSGGHKITSRQRWTPTPVQLQILERIFDQGNGTPSKEKIKEITAELGQHGQISETNVYNWFQNRRARSKRKLQNVAPSNTESEVDTEVDSKNKKTKAEEEFQSQHNITTSGGAEKLCFQNPQVYSDHLHYLNPDSNKPYSMCQSDCNLKSTRNSSHVSVFNEMLSNSRSEYVGGKMEVAGSVSYNLFHQTGDCNLAG

SEQ ID NO: 3811 - protein, 362 aa, Glycine max
MFRVCDVRRLRSLPPLFSRMFSSEPVLTQETINQHVVKAEYAVRGELVLLANKHQKTMQQNPNHSLPFKEIIYCNIGNPQILGQKPLTFFRQVTACCEYPALLDLPNVMPEDVKERAKKLLASMGNSTGAYSSSQGVPIVLNNVAKFIEERDGHPANAEDIFLTDGASVGVQRMLRLLIRDDKDGILIPIPQYPLYSATIDLYGGQRVGYYLNEEANWRLDTPQLEKALDEAKKKGINTRALVVINPGNPTGNTMDRKAMEEVVDFCYRNKLILMADEVYQDNIYKEGQSFISFKKVLREMEEKYQKLELVSFHSVSKGFYGECGKRGGYLEMVNISEPVKEHKSLQPGGSTTSRAVATAEE

SEQ ID NO: 3812 - protein, 475 aa, Aspergillus nidulans
MLEDPSYAEIVRWGDDGDSFVVLECEKFTKTILPKHFKHSNFASFVRQLNKYDFHKVRQNNEENGQSPYGQNAWEFKHPEFRANSKESLDNIRRKAPAPRKQAQAHDDSVPTQQIDLLNQQIVAQQQQIQHISDRYAQMSVDHQLMLQEVLRVQKTVVNHENVIHQLVNYLVSIDARQKRDNKAGSFQAQVGASPSQVTPMDDGVSTPLQQASKLLSDMNAEVQFNLVPVESMGEPPKTGVVSTPTMETAPRRVAPQPAAAATNPALVYPKMNGEMEPVVYPVGATNGIDPMYGEHVNNVPYTVPPKQDMDDRRQFPENRKKSNHVDPGWMRSPRILLVEDDATCRQIGGKFLYSFSCEIDTALDGLEAVNKVQDGSKYDLILMDIIMPNLDGVSACHLIRQFDRTPIIAMTSNIRSDDIQLYFQHGMDDVLPKPFTRKSLLEMLEKHLVHLKTVPQGMEAPPTCDRSHVGTSLN

SEQ ID NO: 3813 - protein, 160 aa, Zea mays
MDARMFGLENPLVAALHHLLDVPDGDAGAGGDKAGGGATRTYVRDARAMAATPADVKELAGAYAFVVDMPGLSTGDIRVQVEDERVLMISGERRREEREDAKYLRMERRMGKFMRKFVLPDNADVDKVAAVCRDGVLTATVEKLPPPEPKKPKTIEIKVA

SEQ ID NO: 3814 - protein, 370 aa, Unknown
  Shewanella sp. MR-7
MTQLFSPFKLKNITLKNRIAVAPMCQYQAHDGLSNDWHQVHYTSLARGGAGLVVVEATAVSPEGRITPRCLGLWNDEQAAGLAKIATAIKDSGAVAGIQIAHAGRKASANIPWEGDDHIEGDQGWQTLSPSAVAFGENLGKVPTAMTIDDIQRVKADFVAAAKRALDAGFEWLELHFAHGYLAQSFFSTYANQRTDEYGGDAEGRGRFLIETVEAVRAVWPEHLPLTARFGVIEFDDKDEQTLSESIALVKQFKRAGLDMLNVSICFSTPTANIPWRPAFLAPIAERVRREVGFPVATSWGMDNPHHAEQAIQDQQMDLVMIGKAFLANPHWPYQAAQTLKVSRPSWVLPSSYAHWLERYSTVKVESSID

SEQ ID NO: 3815 - protein, 350 aa, Arabidopsis thaliana
MKFGETFTEYLHGEEEWFLEKCRFVEYKKLKKVLKKCKTCNSTKSDDGQIIPSATSSSLSDSCECKACPLIFVQQSNGERNDLLGCDQMFFEELMKEATDIAGFFRSRVRHLLHLHVATGMQRYMIRLRRCFTDEKQALVQEGQILIQYITMNAIAIRKILKKYDKVHSSENGKNFKLKMRAERIELLHSPWLIELGAFYLNSGLDNVGNFKNSFGRVACENLNEDQPVLKLMLPNSIELEYDLTCAICLETVFNPYALKCGHIFCNSCACSAASVLIFQGIKAAPRHSKCPICREAGVYAEAVHMIELHLLLKTRSKEYWKERMMNERSEMVKQSKMFWNEQTKHMIGY

SEQ ID NO: 3816 - protein, 404 aa, Oryza sativa
EEADQVERKLVLGRYELGRLLGQGTFAKVYYGRDLRSGESVAIKVIDKARLRRTEGMVEQLRREISIMRMVRHPNVVGIREVLASRARVFVVMEYARGGELFAKVARGRLTEEHARRYFQQLVAAVGFCHGRGVAHRDLKPENLLLDEEGRLKVTDFGLAALPEQLRQDGLLHTQCGTPAYVAPEVLRKRGYDGARADLWSCGVVLYVLLCGFLPFQHENYAKMYQKIFKAEYQVPPWVSGDARRLIVRLLVVDPAKRISIPEIMRTPWFKKGFVPPVPTSPVSPKKWEEDDVLLDGGDSGAMSPRTCNAFQLISSMSSGFDLSGMFESEQKAATVFTSRAPAATVIQKLEAVGRSLGYSATRGKGWKLRLEATASVQRDVKSVGCISFSFFARGYVQAKSRDV

SEQ ID NO: 3817 - protein, 540 aa, Rhodopirellula baltica
MAKQLLFEDHARARMLAGVEKLAKAVATTMGPTGRNVIIDKSFGGPTVTKDGVTVAKEIELEDRFENMGAKLVIEVAQKTSDLAGDGTTTATVLARAIFKEGLRNIVAGSNPTAIRRGIEKAVEAACDQLVEMGRPVSGKQEVAHVGAISANNDNVIGELLADALERVGKDGVITVEEGKSRNTEVEYVDGMQFDKGYVSPYFITDSSTMEASLEDALVLLYEKKVSNIRDLVPLLEKTAQTGQPLLIIAEDVDAEALTLLVVNKLRGTLNVCAVKAPGFGDRRKAMLGDIATLTGGTLISEDLGMQLENVTLEHLGRAKKVTVDKSNTTIVEGAGKREDIDKRVAQIRAQIEQTDSDYDKEKFQERLAKLAGGVAVISVGAETEAEMKQTKARLEDALHATRAAVEEGILPGGGVALVHCREAVEAAKKKAKGDEKIGVDIVLGALDAPMRQIADNGGIDGSVVVDEVLQKNDPKIGFNAHTGEYTDMVKAGVIDPVKVVRTALTNAASIAGLLLTTEALVTNFEQEDKDKRPVEGMVS

SEQ ID NO: 3818 - protein, 450 aa, Geobacter sulfurreducens
MQTRTRITLGLVVAILCLTIGVAAGWRYYNPAADQVGAEHLRLFREVVSIVRSSYVEEVSGKKLLEGAINGMLASLDPHSSYLPPEPFTEMKTEISGSFGGLGIEISMRDGKLTVVAPIEDTPAWRAGIQSGDHIWKIDDTPTRGLTITQAVKQMRGEKGTQVSLSILRNGNGKPLVFPLVRDIIKTRSLKSRTLEPGYGYVRISQFQERTGDDFAAALAKLRSDNGGSLKGLVLDLRNNPGGLLDAAVAVAGRFVGERLDNGLIVYTEGREHFAKRSYSATIGEKEPRYPLVVLINGGSASASEIVAGALQDHGRAVIMGTTSFGKGSVQTVVPLKDGAGLKLTTARYYTPKGRSIQARGIEPDIVVERAGFKELPDKGRAGFLEKDLDNHLSGAESGEGEKTPEQDVKKLPAAPATPEHEVDKDYQLLRALELLKGWDAMRKVATAKH

SEQ ID NO: 3819 - protein, 492 aa, Solanum melongena
MDLSKYRPSSAYDTPFLTTNAGGPVYNNVSSLTVGPRGPVLLEDYHLIEKLATFDRERIPERVVHARGASAKGFFEVTHDVSHLTCADFLRAPGVQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPINYRHMEGFGVHAYQLINKAGKAHYVKFHWKPTCGVKSMTEEEAIRVGGTNHSHATKDLYDSIAAGNYPEWKLFIQIMDPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRTWEPDRQDRYINKWVESLSDPRVTHEIRSIWISYLSQADKSCGQKVASRLLVKPTM

SEQ ID NO: 3820 - protein, 532 aa, Enterococcus raffinosus
MAKDIKFSEDARAAMLRGVDKLADTVKVTLGPKGRNVVLEKSYGSPLITNDGVTIAKDIELDDHFENMGAKLVSEVASKTNDIAGDGTTTATVLTQAIVREGLKNVTAGANPMGIRRGIELATKAAVEELHSISKEVDSKDAIAQVAAVSSGSEEVGKLIAEAMEKVGNDGVITIEESKGIDTELDVVEGMQFDRGYLSQYMVTDNDKMEAALENPYILITDKKISNIQDILPLLEQVLQQSRSLLIVADDVDGEALPTLVLNKIRGTFNVVAVKAPGFGDRRKAMLEDIAILTGATVITEDLGLDLKEATIENLGTAGKVVVDKDNTTIVEGAGDKAALTDRVEMIKRQIGETTSDFDREKLQERLAKLAGGVAVVKVGAATETELKELKLRIEDALNSTRAAVEEGIVSGGGTALVNVIKKVSDLDAEGDVATGIKIVVRALEEPVRQIAENAGFEGSVIIDKLKNADRGTGFNAASGEYVNMIDAGIVDPTKVTRSALQNAASVSALLLTTEAVVADKPVEGGAAAAPA

SEQ ID NO: 3821 - protein, 377 aa, Dehalococcoides ethenogenes
MTLRIKVLLGTILAMVGLLVSFGVGYLSGGIAALNSDENLSSIVNAWQIITTEYVEPDSIDQAALAEAAIKGMMDELDDPHSVYLNAEDYQSSLEYDDGKYVGIGATVQIEDEAIVLVPYDGSPAALAGIQAGDILLEVDGQSVAGFSLADLSPLVRGEKGTSLTLLVERSSSDQPLLFEVTRDEILISSVTSEMMGDIAYIRISRFSERTDEELEQVLKNLGSAEGIVLDLRGNPGGLVSSVINVTSRFVSSGVVLTTVDNEGNSSEYSVVPKTVTTSLPMVVLVDQYSASGSEALSGALQDYGRATIAGKTTYGKGSVNRTFNVTPDTGIYLTIGRWYTPNGRMIEGQGITPDIELELTGDEAVSWALGFLHGDT

SEQ ID NO: 3822 - protein, 207 aa, Triticum aestivum
MVQPKKKFRGVRQRHWGSWVSEIRHPLLKRRVWLGTFETAEEAARAYDEAAVLMSGRNAKTNFPVQRSSTGDPAPAATRDVRGGSSSSSTSNLSQVLSAKLRKCCKAPSPSLTCLRLDTEKSHIGVWQKRAGARADSNWVMTVELNKGAGPSGDAVAAQSTVSATTASSPASTMDDEERLTLQMIEELLSSSGPASPSHGEEGSFVV

SEQ ID NO: 3823 - protein, 534 aa, Streptococcus mitis
MSKEIKFSSDARSAMVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVAAAVEALKNNAIPVANKEAIAQVAAVSSRSEKVGEYISEAMEKVGKDGVITIEESRGMETELEVVEGMQFDRGYLSQYMVTDSEKMVADLENPYILITDKKISNIQEILPLLESILQSNRPLLIIADDVDGEALPTLVLNKIRGTFNVVAVKAPGFGDRRKAMLEDIAILTGGTVITEDLGLELKDATIEALGQAARVTVDKDSTVIVEGAGNPEAISHRVAVIKSQIETTTSEFDREKLQERLAKLSGGVAVIKVGAATETELKEMKLRIEDALNATRAAVEEGIVAGGGTALVNVIPAVADLELTGDEATGRNIVLRALEEPVRQIAHNAGFEGSIVIDRLKNAEVGTGFNAATGEWVNMIDQGIIDPVKVSRSALQNAASVASLILTTEAVVANKPEPAAPAPAMDPS

SEQ ID NO: 3824 - protein, 370 aa, Thiobacillus denitrificans
MSTLFSPFRLGTRVLKNRIVVSPMCQYSAEDGCATDWHMIHLGHLALSGAGLLFVEATAVSPEGRIAASDLGLWSDDNEAALRRVVDAIRRYAPPLALGIQLAHAGRKASTDVPWAGGHFILPEQGGWQTLAPSALAYAPGDAAPRALDTAGLERVRGEFVTAAQRAERLGFDVIELHAAHGYLLHEFLSPLSNVRDDRYGGSLENRMRFPLEVFDAMRAALHADVPLGVRISATDWVEGGWDIAQSLAFAEALRRRGCAFIDVSSGGLSPAQQIPVAPGYQLPFAAQIRGETGMPTMAVGLITDPHQAENIVAGGHADLVALARGMLYDPRWPWHAAAELGARADAPKQYWAAPPHGHGTLFKRDKDAE

SEQ ID NO: 3825 - protein, 507 aa, Xanthomonas oryzae
MRPGSLMVLALLAPTLIAPPVFAQSVLTRDNGAKVGDNQNSQTAGPNGPTLLQDVQLIQKLQRFDRERIPERVVHARGTGVKGEFTATADVSKLTKAKVFSAGERTPVFVRFSSVVHGNHSPETLRDPHGFATKFYTSEGNWDLVGNNFPTFFIRDAIKFPDMVHAFKPDPRTNLDDDSRRFDFFSHVPEATRTLTLLYSNEGTPAGYRFMDGNGVHAYKLVNAQGEVHYVKFHWKTLQGIKNLDPKQVAAVQAKDYSHLTNDLVAAIKKGDYPKWDLYVQVLKPEDLAKFDFDPLDATKIWPDVPEQKVGQMVLNKNVDNFFQETEQVAMAPANLVPGIEPSEDRLLQGRIFSYADTQLYRIGANGLSLPVNRPRVAVNNGNQDGQGNIGQTTSGVNYEPSRLQPRPQDASARYSELPLSGTTQQAKITREQNFKQAGELYRSYSKKDRADLVQSFGESLADTDTESKHRMLSFLYKADPEYGSGVTRVAKGDLSRVKQLASSLQD

SEQ ID NO: 3826 - protein, 545 aa, Bacillus clausii
MAKDIQFSEEARRSMLKGVDTLANAVKVTLGPKGRNVVLEKKFGSPLITNDGVTIAKEIELEDAFENMGAKLVAEVASKTNDIAGDGTTTATVLAQAMIREGLKNVTSGANPMGIRKGIEKATAAAVKELKAISKPIEGRESIAQVAAISSADEEVGQIIAEAMERVGNDGVITIEESKGFSTELEVVEGMQFDRGYASPYMVSDSDKMEAVLDNPYVLITDKKITNIQEVLPVLEQVVQQSRPVLIIAEDVEGEALATLVLNKLRGTFNAVAVKAPGFGDRRKAMLEDIAILTGGQVITEDLGLDLKSATIESLGRAAKVVVTKENTTIVEGAGDPEQISGRVNQLKAQVEETTSEFDKEKLQERLAKLAGGVAVLKVGAATETEMKERKLRIEDALNSTRAAVEEGIVAGGGTALVNVIKAVKAVDATGDEATGVNIVLRALEEPVRQIAHNAGLEGSIIVEKLKAEEVGVGYNAATGEYVNMVETGILDPVKVTRSALQNAASVSAMFLTTEAVIADKPEENAGGADMGGMGGMGGGMPGMM

SEQ ID NO: 3827 - protein, 367 aa, Pseudomonas syringae
MSAEALFTPFRLGSLELSSRVVMAPMTRSFSPGHVPNSKVVEYYRRRAAAGVGLIITEGTTVNHKASNGYPNVPQFFGEAPLAGWRKVVEAVHAEGGKIVPQLWHVGAVRRPGTEPDGSVPAYGPMEKVKDGQVLVHGMSKQDIDEVVAAFAQAAADARAIGMDGVEIHGAHGYLVDQFFWEGSNQRSDEYGGSLANRSRFALELIKAVRGAVGPDYPIIFRFSQWKQQDYTARLVQTPEALGEFLQPLADAGVDIFHCSTRRFWEPEFEGSDLNLAGWTRKLTGKPTITVGSVGLDGEFLQFMVNTDKVAQPASLENLLKRLGNDEFDLVAVGRALLVDPDWALKVREGREQDILPFSRDALTTLV

SEQ ID NO: 3828 - protein, 462 aa, Glycine max
PSISQTDRVLSHESTVAEEVRKPMPETESAAAAAVEEENNTALFGKYEVGRLLGCGAFAKVYHARNTETGQSVAVKVISKKKLNSSGLASNVKREISIMSRLHHPNIVKLHEVLATKTKIYFILEFAKGGELFARIAKSRFSEDLARRYFQQLISAVGYCHARGVFHRDLKPENLLLDEQGNLKVSDFGLSAVKDQIGVDGLLHTLCGTPAYVAPEILAKKGYDGAKVDVWSCGIILFVLVAGYLPFNDPNLMVMYKKIYKGEFRCPRWFSMELRRILTRLLDTNPDTRITVDEIMKDTWFKKGYKEVKFGDLGLEWKSEGEGVKDLNAFDIISFSTGLNLSGLFDSSCGVEEGERFLLRESPEKVVEMLVAAAEKEGVVVRMRKECGVELEGCGGNFAALVEVYRLPGELVVVEVRRRDGDGGVFRDVWRNKLRPCLCAASSSTTSDRDGTTLAQPVAGDS

SEQ ID NO: 3829 - protein, 169 aa, Mesorhizobium loti
MSVRDLIPWSRGGGPAPSIYRGDDMDPFLSLHRNVNRLFDEVFRGFDTPSVLGRMAPLNGTWPGVEFSETDEEIRLTAEIPGLDENDVEVMLDDGVLTLRGEKKAETEDKDRQFSERYYGRFERRFGLGREVEDDKVAATFKNGVLTVTLPKTKRAQANAKRIAINGNK

SEQ ID NO: 3830 - protein, 280 aa, Streptococcus pyogenes
MMVTTVKMTSGYEIPVLGFGTYQAADGEEAYQSTLAAIKADYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTPEDKKTIRYLSGMSAIPNPDTTSF

SEQ ID NO: 3831 - protein, 181 aa, Arabidopsis thaliana
MAQQSLIYSFVARGTVILVEFTDFKAYCVVAVDSAGRQIPMSFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIIALILIIVLSVCHGFKC

SEQ ID NO: 3832 - protein, 520 aa, Zea mays
  misc_feature (492)..(492): Xaa can be any naturally occurring amino acid
  misc_feature (504)..(504): Xaa can be any naturally occurring amino acid
MMVGHSHVVCRLKHRGPDWSGLYQHEGNFLAQQRLAIVSPLSGDQPLFNEDRTVVVVANGEIYNHKNVRKQFTGAHSFSTGSDCEVIIPLYEKYGENFVDMLDGVFAFVLYDTRDRTYVAARDAIGVNPLYIGWGSDGSVWMSSEMKALNEDCVRFEIFPPGHLYSSAAGGFRRWYTPHWFQEQVPRTPYQPLVLREAFEKAVIKRLMTDVPFGVLLSGGLDSSLVASVTKRHLVKTDAAGKFGTELHSFVVGLEDGIDAIEEVIYHDETYDVTTIRASTPMFLMARKIKSLGVKMELHRETCRKVKALHQYDCLRANKATSAWGLEVRVPFLDKEFVDVAMGMDPEWKMYDKNLGRIEKWVLRKAFDDEEHPYLPEHILYRQKEQFSDGVGYNWIDGLKAFTEQQVTDEMMNSAAQMFPYNTPVNKEAYYYRMIFERLFPQDSARETVPWGPSIACSTPAAIEWVEQWKASNDPSGRFISSHDSAATDRTXTSWRWSTATGTXANGTVNGNDVAVAIAV

SEQ ID NO: 3833 - protein, 449 aa, Thermoanaerobacter tengcongensis
MIELVKFPKDFTWGVATSSYQIEGAVNEDGRTPSIWDTFSKTEGKTYQGHTGDVACDHYHRYKEDVQIMKEIGVKAYRFSIAWPRIFPEEGKYNPKGMDFYKRLVDELLKREIIPVATIYHWDLPQWAYEKNGGWLNRESVKWYVEYASKLFEELGDVIPLWITHNEPWCSSILSYGIGEHAPGHKDWREALIAAHHILLSHGEAVKVFRDMNLKGAQIGITLNLTPAYPASEKEEDKLAVQYADGFANRWFLDPIFKGNYPEDMMELYSKIIGEFDFIREGDLETISVPIDFLGVNYYTRSIVKYNEDSMLKAENVPGPGKKTEMGWEISPESLYDLLKRLDREYTKLPMYITENGVAFKDEVTEDGRVHDYERIEYIKEHLKAIARFIEEGGNLKGYFVWSLLDNFEWAHGYSKRFGIVYVDYETQKRILKDSAFWYKGVIEKGVIE

SEQ ID NO: 3834 - protein, 359 aa, Unknown
  Annona cherimola x Annona squamosa
QMGFAENQVSFDLLEQYLEQHPEASGWGSRLSSFRDNALFQDYHGLKTFRQAMASFMEQIRGGRAKFDPERIVLTAGATAANELLTFILADPGDALLVPTPYYPGFDRDLRWRTGVKIVPIHCDSNNKFQVTPQALENAYAAAKSMDIKVRGVLITNPSNPLGAAISRPILEEILDFVSRKNIHLISDEIYSGSVFSAAEFTSVAEILAASNYKDSERVHIVYSLSKDLGLPGFRVGTIYSYNDKVVTTARRMSSFSLISSQTQNLLASMLSDVDFTKKYIETNRERLRRRYASTIRGLRNAGIECLKGNAGLFCWMNLSPLLEKPTREAELKLWDSMLHEVKLNISPGSSCHCLEPGW

SEQ ID NO: 3835 - protein, 227 aa, Zea mays
NLSWPASHICRVKSLSSNCTSLASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGTNVEDAFQCIVKNALKNEPEEELYVPDTVDVVGGNRAQRSSGCC

SEQ ID NO: 3836 - protein, 652 aa, Saccharophagus degradans
MCGIAGLVSPSLPIDSLKATATAMAQAIEHRGPDAMGVWVEQEQKLAFSHRRLSIQDLSESGAQPMHSHSKRYTIAFNGEIYNFLEIKKPLIDAGFEFRGHSDTEVLLCAIEHWGLEQTIAKAKGMFAIALWDSQTKVLTLIRDRIGEKPLYYGVINGSFVFGSELKAIFAHTPAKALTLNKVAIASFLRHGYISAPNSVFVEVKKLSPGCRIDINLAKQSDWSIANLTPQPYWTVAQSANQPYLYTEQNQSEAISALDEKINKVINEQSIADVPLGAFLSGGIDSTVVSAVLQANTSTAIDTFTIGFEEKSFNEAEFAKEIAKHLGTKHHEHYVNQQDILELVNILPRVYDEPFADASQLPTILVNRFARSELTVCLSGDGGDELFAGYNRYVFTEAVLKKAAALPAVFKSILKALITSVAPGKWDKLYQALNSIAKRKGGAEFGNKLYKMVSLADAKSKAAAYEYLMSYWQQPEQVLKAFNGELAMQSPLSLEDDFINAAMAWDQQWYLPGDNLTKTDRASMAASLELRAPLLDIELIDFAWTVSPELKVRDGKSKWLLREVLYKYVPKELIERPKMGFSVPISQWIRTDLSAWVDELLDKEFIEKQGIFNYAPIQHALLEHRSGSYDHGKKLWTLLMFQAWFKTNIIDG

SEQ ID NO: 3837 - protein, 667 aa, Moorella thermoacetica
MVAYTRLFEPIKIGKVEIKNKIAMTPMGVLGLATHDGCFSKRVVDYYVERAKGGTGLIITSVTKVDNEIERFKAGAVPVATANPLHFIATAGELTERVHAYGTKIFLQLGMGFGRVAAPILLESQPVAPSALPNFWDPSITCRELTTAEVETLVQRASEAAEIAVEAGFDGVEIHAMHEGYLLDQFTIALFNRRGDKYGGALEDRLTFPIEIVRAIKDRVGKDFPVVLRFSIKNYIKDWRQGGLPGENFQEKGRDVEEPLAAAKILEGAGYDGFDADAGSYDAWYWAHPPVYQKHGCYLPLTQRLKEVVKVPVIVAGRLEIPELAEEALVKGQADMIAIGRGLLTDPYWVNKVMTGRSKNIRPCIGCHDGCLGRGFLGRPLSCTVNPACGREEEYAIDRAPEAKQVMVIGGGVAGMEAARVPALRGHRVSLYEKSDRLGGHVVEAAVPDFKADDGRLLEWYKTELGELQVEIHLNQEVTPEFVEEKNPDVVVVATGSTPAIPDIPGVNKDKVTTVSDLLLGKKQAGDRVVIIGGGLVGCETALWLAQQGKDVTIIEILDDLMRAGIPVPYMNRMMLLDLLKMNGVKWLTETSVLEVTDDGVTLIGKNYQRSPLPADTVILAVGFGADQRLYNALRDKIPNLYLIGDSREPRNILAGIWEGYEVGRGI

SEQ ID NO: 3838 - protein, 607 aa, Pseudomonas syringae
MPLRTDDNWRHGAVLLDPEHTRFALWAPDANYVNVELQDGQGVQSLAMLPQPDGWFVLEARCEAGTRYRFKIDHELEVPDPASRAQDDDVHSQSFVVDPLAYSWQNTSWQGRPWHEAVIYELHVGAMGGYAAVEKHLPRLAQMGITAIELMPLAQFPGDRNWGYDGVLHYAPQSSYGTPEELKHLIDTAHGLGLMVILDVVYNHFGPDGNYLGSYAKDFFRSDLHTPWGDAIDFRRPQVRDFFVDNALMWLLEYRIDGLRMDAVHAIRDETFLPEFATRVRGQIEPGRHVWLNLENEFNQAGLLEKGFDAQWDDDGHNTLHVLLTGETDAYYSDFAQEPTQKLARLLSEGFVYQGEQTRHGHTRGEPSGHLAPTAFVLFLQNHDQIGNRALGERLPQLCTPAALRAATALLLLSPMIPLMFMGDEWAASEPFLFFTSHHGELADAVREGRRKEFADFAAFADPEKREHIPDPNDIKTFEASRPAFSAVDLDTDKGLDHRSWVDFYTQLLALRHKEIMPRLPGARFLKTDILGDKAVSARWVLGDGSELRIDLNLSEQAVDAPPQQNARQIFSSAAKSSELSPQAILNPYTAIVSLTASDVLEEQDEQ

SEQ ID NO: 3839 - protein, 413 aa, Erwinia carotovora
MADSTSPRRFTRIDRLPPYVFNITAELKMAARRRGEDIIDFSMGNPDGPTPPHIVEKLCTVAQREDTHGYSTSRGIPRLRRAISRWYADRYEVDIDPESEAIVTIGSKEGLAHLMLATLDHGDTVLVPNPSYPIHIYGAVIAGAQVRSVPLVEGVDFFNELERAIRESIPKPKMMILGFPSNPTAQCVELDFFERVVELAKQYGVLVIHDLAYADIVYDGWKAPSIMQVPGAKDIAVEFFTLSKSYNMAGWRIGFMVGNSELVNALARIKSYHDYGTFTPLQVAAIAALEGDQQCVRDIAEQYRQRRNVLVRGLHEAGWMVDEPKASMYVWAKIPDAYAHLGSLEFAKRLLSEAKVCVSPGIGFGDYGDTHVRFALIENQDRIRQAVRGIKTMFRADGILPTTKPLAGKGPAA

SEQ ID NO: 3840 - protein, 704 aa, Rhodospirillum rubrum
MAKRSTDALTPAEIADAKILRGTGGETHQIAEGDTPVLTTQQGIPVADDQNSLRIGPRGPTLLEDFAFREKIFHFDHERIPERIVHARGFGAHGTFETYEDLSALTSADIFQRAGEKTPAFVRFSTVAGNLGSSDVARDVRGFAVKLYTKQGNWDIVGNNIPVFFIQDAIKFPDLIHAAKQEPDSGFPQAQTAHDNFWDFISLMPESLHMALWIMSDRTIPRSFRFMEGFGVHTFRLVTAEGKSSFVKFHWKPKLGLQSVVWNEAVKINGADPDFHRRDLWSAIKRGDYPEWDLGLQVFDDAFADSFPFDVLDATKLIPEELVPIRIVGRLVLDRTVDNFFAETEQVAFHTANIVPGIDFTNDPLLQGRNFSYLDTQIKRLGGPNFTHLPINAAKCPFHSFQQDGHMAFVNPKGRANYEPNSWGPGIGGPRESPESGFHSFPAEDGGEKRRVRGELFADHYSQARQFYRSQTPVEQTHIKDSFVFELSKVETPAIRARVVSHLLTIDQTLAQKVADGLGLAELPEAAKPARPLVEDLPASPALSILLNPPKDFSGRKVGVLVSDGVDGAFLDEIERLLTAEGAQMEVIAPRVGGFTAKDGTLRPAHQKVNGAPSVLYDAVAVLLSTEGAKLLLNEATAKDFVSDAFAHAKVIAFTQAAQPLLEKAGVIADEGCLLLDTPAKAETFLGLCRKGRRWEREAKVHAV

SEQ ID NO: 3841 - protein, 375 aa, Oryza sativa
MASFAVSGARLGVVRAGGGGGGGGGPAARSGGVDLPSVLFRRKDSFSRGVVSCAGAPGKVLVPGGGSDDLLSSAEPDVETQEQPEESQIPDDNKVKPFEEEEEIPAVAEASIKVVAEDKLESSEVIQDIEENVTEGVIKDADEPTVEDKPRVIPPPGDGQKIYQIDPMLEGFRNHLDYRYSEYKRMRAAIDQHEGGLDAFSRGYEKLGFTRSAEGITYREWAPGAQSAALVGDFNNWNPNADTMTRNEYGVWEISLPNNADGSPAIPHGSRVKIRMDTPSGVKDSIPAWIKFAVQAPGEIPYNGIYYDPPEEEKYVFQHPQPKRPNSLRIYESHIGMSSPCSISFSLVCYCIFLEIRQCMQSEQKNHLNGPQKNE

SEQ ID NO: 3842 - protein, 130 aa, Triticum aestivum
MESKAFVSVTFLIVTLLLCRTIQSRSCRSDEKTTEKTMILGGVHDLRGNQNSGEIENLARFAIQQHNNRKNKVLEFKKIVKAREQVVAGTMYYLTLEANEGGQAKNFEAKVWVKPWMNFKQLQEFKESSS

(The sequence listing continues in the following parts.)

What is claimed is:

1. A plant cell with stably integrated, recombinant DNA comprising a heterologous promoter that is functional in plant cells and that is operably linked to a DNA comprising a nucleotide sequence that encodes a protein comprising SEQ ID NO: 148.

2. The plant cell of claim 1 further comprising DNA expressing a protein that provides tolerance from exposure to an herbicide applied at levels that are lethal to a wild type of said plant cell.

3. The plant cell of claim 2, wherein the agent of said herbicide is a glyphosate, dicamba, or glufosinate compound.

4. A transgenic plant comprising a plurality of the plant cell of claim 1.

5. The transgenic plant of claim 4, wherein said plant is homozygous for said recombinant DNA.

6. A transgenic seed comprising a plurality of the plant cell of claim 1.

7. The transgenic seed of claim 6, wherein said seed is from a corn, soybean, cotton, canola, alfalfa, wheat, or rice plant.

8. The transgenic seed of claim 7, wherein said seed is a corn seed that can produce corn plants that are resistant to disease from the Mal de Rio Cuarto virus or the *Puccina sorghi*, fungus, or both.

9. A transgenic pollen grain comprising a haploid gamete of the plant cell of claim 1, wherein the gamete comprises said recombinant DNA.

10. A method for manufacturing non-natural, transgenic seed that can be used to produce a crop of transgenic plants with an enhanced trait resulting from expression of stably-integrated, recombinant DNA comprising a heterologous promoter that is (a) functional in plant cells and (b) is operably linked to a DNA comprising a nucleotide sequence that encodes a protein comprising SEQ ID NO: 148; and wherein said enhanced trait is selected from the group of enhanced traits consisting of enhanced water use efficiency and increased yield, said method for manufacturing said seed comprising:

(a) screening a population of plants for said enhanced trait and said recombinant DNA, wherein individual plants in said population can exhibit said trait at a level less than, essentially the same as, or greater than the level that said trait is exhibited in control plants which do not express the recombinant DNA, (b) selecting from said population one or more plants that exhibit the trait at a level greater than the level that said trail is exhibited in control plants, (c) verifying that said recombinant DNA is stably integrated in said selected plant, (d) analyzing tissue of the selected plant to determine the production of a protein having the function of a protein having SEQ ID NO: 148; and (e) collecting seed from the selected plant, wherein said seed comprises the recombinant DNA.

11. The method of claim 10, wherein said recombinant DNA further comprises DNA expressing a protein that provides tolerance to exposure to an herbicide applied at levels that are lethal to wild type plant cells, and wherein said selecting is effected by treating said population with said herbicide.

12. The method of claim 11, wherein said herbicide comprises a glyphosate, dicamba, or glufonsinate compound.

13. The method of claim 10, wherein said selecting is effected by identifying plants with said enhanced trait.

14. The method of claim 10, wherein said seed is corn, soybean, cotton, alfalfa, wheat, or rice seed.

15. A method of producing hybrid corn seed comprising:

(a) acquiring hybrid corn seed from a corn plant which has a stably-integrated, recombinant DNA comprising a heterologous promoter that is (a) functional in plant cells and (b) is operably linked to a DNA comprising a nucleotide sequence that encodes a protein comprising SEQ. ID NO:148;

(b) producing hybrid corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA;

(c) selecting corn plants which are homozygous or hemizygous for said recombinant DNA;

(d) collecting seed from said selected corn plants and planting said seed to produce further progeny corn plants;

(e) repeating steps (c) and (d) at least once to produce an inbred corn line;

(f) crossing said inbred corn line with a second corn line to produce hybrid seed.

16. The method of claim 10, wherein step (d) comprises detecting the presence of said protein in seed or plant tissue with an immunoreactive antibody.

17. An anti-counterfeit milled seed having, as an indication of origin, the plant cell of claim 1.

18. A method of growing a corn, cotton, or soybean crop without irrigation water, the method comprising planting seed having a plurality of the plant cell of claim 1, wherein a plant producing said seed has been selected for enhanced water use efficiency.

19. The method of claim 18, the method comprising providing up to 300 millimeters of ground water during the production of said crop.

* * * * *